United States Patent 7,868,149 (PLANT GENOME SEQUENCE AND USES THEREOF) - sequence listing, part 48

SEQ ID NO: 25539 - DNA, 14711 bp, Oryza sativa
ctattcctaattttttataaatcctatgttccaaaagtgcccatagtgattaggatcctaccttcaaaacccatatgtctctaacgttgaaggtataggatattaggatcctgtcccataggatattaggatcctgtcccaatgtcctcaccattatgtctaagtattttgctatgtttttattttgtaatggcatttcttttttttccctcattttacttgttcattgtatttgtaataagtttttttactcttatccaaatttttatgacaatgggttacaacattgctagaatttttatttttctaaaatatgccatgtcttaacttgaccacattctagtttctattttaataggctatatatatgttcggttactgtttttttttcaatcaatttattctagtttctatggagagtttagttccaaactttttctttgaactttcaactttttcatcacatcaaaactttcctacacacacaaacttctaacttttccattacatcgttccaattttaaccaaacttccaattttagcgtgaactaaacacaccctatgagaataggttgggctgctgcctatttcaatctgtcaattttgacttttttgagttagtggtagtggtggttcacacttcaccaccatttccgttacaacttgaaatggaaggggaggttaggttaggtgggtgtgctccgttatcgcttagtcgcttgtctcctcggaaccaatatttcgttaacctgtcttctgaaattaatagaaacgctgctagccacacttagcaatcatatcagttgagcttgttacccttgtttgaagtcttgatagtgaccagcgttacgattgattcttagactatggacatacttcctaacatcttatgcaaagccattggactagaattgagaagcatatgttgatcttaaatgtgtgacaatttaccgtcagaaaccgtgtggttaccttggtgactactgactaggcttattgccaaggcacaacaaccgaaaccgaccgatatatcgacaaagttaaaaaaacaaaaattagaattttttttcatgttttcctcgctcggtaaccacaattactaatattaccattggggaggagcaacaaacccccccccccccccctcccccctccttcactctcgttttgaagccatagctagcaccatcggcctattgtgttgagttgtgattcaaattcatttacacttaataaaggccagcttctgccggagcgaaatggagactgaagctgggccattggttgtgcatctggggacgtccgggggtggggggcgaagcccccgctgtacggatcgtaataccttttagggtttcatctcatatatatatatatatatatatatatatatacacctcttgtaagccgccgtgcggcgttgtaacctcaccccgatatagtaaagatattttgctggctgacgcccgtggttttttctctcctactttgagagggttttccacgttaaatcttgtgtcttcagtgattaatctattgttatttatcgtttgtttgcctatcaattcctaacatataacatattggacacccccaatgcatggtcgtgtatattcttcttccgtgtaaccatatagaaatgaaaaacatgctacctatgtactcgcacatatatcacctgaatatggtaccatgatcagatatatcgcttgaatatgctaccatcaaacacgagacaatgactgatcaattttgtacgtgggagtgggataccccacaagacttgagaggcatgcaaaacgtggtttcaaattgggatggggaagagggtgcctgacaggcagcaacgaaatcgtgcgccaactgttgtgggaaaccgcagctaacaggtgacgagtaaattaaagctataactggcgtggttttatttcagcattagggatgatgatcatatatgtacagccttttgagtacacatttctctggataaatgaagcaattaagccactctacctcgtaccgtaccaaaatagatatgtacaccacagagtaacatacggcacaaggtagggaggcataagtacacgctgatacagagaggaagtgggagagtggaatgtgaagaggtctctataaactttaccaaaactacctggagcctatctggccttgtgttaaacttgctggggttggtggttatcttgagaaaatcacctgttacctgtgcactataggaagctttctatggggggcccgtagataaacaagctacggttatatcatgagattaatctcattgatgtcgtccatggggatctccaggcccatcaagtctagatcctggagtccgtcgtcgtcttctatattcaaccagccgccgaaatcaacatccattcctgggagctccaggtttgacaagtccggcatttctgcgtcattcgatgcatttgctggttcctcatgcctagcactagcagcagaggtattgtccctgccgttgccagaaggcgttattttggcctgcgactgtggatccctagttagagcgctgctgacaggagcagatatgttggctgtcttctgtttgggttttgttttattcttcctttctccttttgcattggatgatgacgggcgcccagatctgctaccatctcggttgtgccccttcccttccctctcgcttctctttccttttgtgttgctcacaagggaagtaccaaggccagacgttttcagggttcctcctgttatgctacctacaacttcatcaagcaacaattcccgttgttttacattatttgtccagggatcctccttcgaaaatgacagatccgtaaggtgactgcttgctcgagaggcatctgatgtactagccctttggactgattttggtaccgtaatattgtctgaaaatgaaatgagagtcagatcagtagtgtaaatatcgaagacaaggcaaaacaagaatatatataaacgaattttataacttcccaaacaagtatggcttagaaagatgcatgctcggtagatcacaaaaggcacaaaaatattatctgggggaccataataccttgtgaagcagaatctgggtcgcttctgtgagaagttgctgatacaaacatatccttgaaaggggtctcatcaaagcagcaagctcctgactcctcatagttctggcaacgtgctattgttcgtttaacaaaacttagagcagcatgtttgccagctctatttacatttttgctacttgaagaaccacagaaggcctgtagtttcacagtaacaacaatcaattatttaataagtatcaaaaaatagtgaacttaaagtccacaaagcaaacaaggtcatcaacagagtaacatatcaattggccaacagaaacatagttgccagacaatgcaagactacatgaacttaaagcactggtcagtgtgataaattcaaaatatgaaatgatttaccacgtagagggagtcaagtttcatctcaaaaaaaaaaaaaaaaaacagagaagggactccaattaggttaaaaagctactgcaaagtcaccataactgcaacaacattataatgggaaatttcagctgttgccactagtgagtgtccacttctacatatgctactaatttttgcaccgtctcaaattttattttcaacatccaactgttagaatacttctaaaaatgtcaccatcgccccaatgtctggttaacaacagcaattaatagctggccaataaaactgccagcttggcaatttcgatgacatggaatagaaagggggaagagacaggagggactgtctctctgcaaacatcgatgcgaggcacaatacacgagggaggaacccacttcgaggagaaaataggtgtatccatgatgctgatgataagattgaggcccattaaaatgaataaaatataataagtattaattggtagagacccaactgttgtatgaattattttagatggcaggggctcttgatgacatggaagacgagaggagtcattagcaaataattatttgagtattaattattttaaacttgaaaagggattaaatatgattttttaaagcaactttcctatagatttttttttttggcaaaaaatacaccgattaacagttcggaaagcatgcgcggggcaaacgttggagttttcttctcaatctcctcatggcgaacacagccctggtgattgtgctcagttcaactgatggacatgccctaatgccccttagacctaatacatgtcatgcaaggagggcatggtagtggctgatggctcctgtcatgtcacctcccttgacctttatgatttctacttttcaagatgaggttatgagtggaactaccacatatgacatgcttcatgatttcaagatgagattagagttgaactaccaaatatgaaacgtattagatgaggtcatgtcaatacatgcggtagctcaattcataacccctggagagtaatttgagttgcaccttttcagatgaggttagaggcaggctaagggtgtgttcttttctcccctttcccaacttctacttcctcctttttcgcgcatacgcttcccaaactgctaaacagtgcagttttttgcaaaacaaattctatagggaagttgtattaaaaaatcacattaatccatttttcaagatttttttagctagtacttaattaatcatgcactaatgagccacctcattttccgtgcggggagaagttccaaactcctcccaaatgcaccctaaggctgcgttctcttcttcaactctaaactgcaacttccacgttttcggttagcacgctttcgaaactactaaacggtgcgctttttgaaaaataaaaaaaggaatatatagaagtttctttcagaaatcaataaacccaatttttaagtttgttatagttgatactcaattaatcaagcggtaatggattacctcgttttacgtgtcaccgaaaagctaaaccaagttgcagattcaaactaggcataaggctaactctaagcagtgtacaagtgtctaatagtatttgatgcaagcacttcccacttgccaggcatgaattggaggatgggagtcatacaagttatatgcatgtgctaaattgtcagtgaaaatacagaatgcaatactattgtgacggagccacagcacggaaatttttgtcccacggattaataactcttagaatggccctccgtcccaaaataagttcatttttcaaccatcccacacataccaatacaaaactaaaaagactagaaaacaccccactttatcaaatcctaatgcaattattactctctttatatagtcccaatgcatttatacactactttcacaatgcaatgattgttcacaaccgagcttattttgggacaaatgggagggaccaaaaatgaacttactctaggacggagggagtaatacataattgctcatacaactaaattcgattatttacctatgtatttgacactgaacaatttgcaatttatatcgaaagacgatgaaagatagaaacaggagttttaaaactcgacattatacattcgacggataaatagaaatcattactaataaaaaaaaagaaaattcacaatatagacatgaagcctcaaatagcgaacattagcaggcttaatcagagttagattgttaaggctgtgttggcaactaggaaaactacatagtagacactgcaccttagctattgacccaacccaacaaataaaacaagaaacatcaatcagcatgtatttctcgcccagaagacttaccatgtatttctcatacgctatcagcaaaagcctttccatggcacgccgtgaaaattccctggttacagggtaaccacatagatgtaagggcttgaatctcaagaaatagtttcccaacaaaacaatgatgtgaaatacctgtgctgtgactcctttttagttctaagaatgccatccagcttccgtagcaagtttttcttatctacaacctttcacatcataaaaacactaagattaattttcacatcactcccttcagtcatcacaaaagaatgatgctgttggctttccaaagtcaagaaaatgcaacattgaccagtgaaatttattgtgtaatacaatgagtgttctctttttgacaaatttattcatgttatttcacttatccagatagaccaaaaggcacattatagaatctttcactgcaaatgtgctctaaggtttcttcaccctcttgtgacaggagcatgtgacaggtactaatcagatattgaaaatagtgaaatagatcaaggagcatgcacatgcatccagccgcacatagtgaatataagtagtacctctttatgaagttggccttctaatttgcagatttcggaattgatatcttcatcttcactctgggcaagatcaggctggcacaatagcagtgtagcacaataagagctaaaacattatgaaaactttgatgtgctatttaatgaaacattgagatgttgcaggttaagattcaaagtttatatggtactcctaagaaccaaatgtttcaaagaaaatactcatgatgaagcttcttggagataactgacataaaactattcttatcatgtgcttagggatgtagtgcaacatatatgatccattttaattcacaaaactgacagaaattgtgtacatcttaagaggacatagataaatatggaattaagaatttcagcttgtagtcatgagccagtattgcacaatagtttgtcatccctatatatagaactaaacccaaatggccaatacccatatttaaacactaagacaactatatctagcatttatttgtcatcccctattcatattcttatttggatcgtgtactcgtgctaccaaatataatatggttgtagactatatcaggtcagtatccaatttctccaagcattttaacaatcacaggaaaatcagagcccataaaaagcaacaaactacctaaataatgacaagaaacctgaagttttaaatcttttggactatttatatactccataatccatgatagaagaattagtatcagcctcttctgataatctccaagttattacccaattggttattgcccaaaagcaacagattaaaataaaataataaactgtaacaaaccatgcatagaaatgcaaaaaaaatagtttaactcaagcaacgcgaaattctataccagcctaacaaaaaaaattgttgtacagaatgatacagttgaacagtgaaacaacacataccacgggttcaatggatacaccaacttcacttagctcaatgatgatcctatcactgaagcacatctcactgtactgaaactcaggccacaccttggccttctccatggcattattgcctttatgtgatagttcatcatgatatttccaatcagaatctaacatcaaaccattagaacctttccctgcagcttcaaagttcattaaagactccaacttataaccctgtgaatgcgatttccatcctccttcctcgaaatgaatttcatgtgtatcaaatggatatgtttcacttctgtaaatgttgttggtaatattatcaaccttgtcttcatcaatcagagcttgcataagtctttggccaactgatgcacctcctcgcgccccaattccttggacaagttgatccaggataggttcaatgcagcttgtctcccatgcaatccctacatcattatctatctcattcagggtatacccattttgaagagcgctatggtcatctttgttgctaccagccggagttgatggttgcgagatgtattcaagactaccctgcaaaagccaaaaatatcagcataataaactgaacccaaagaaagaagcagatagaagtagaagaaaataagtagttatccatggtaaagtgagcatcaagccatcaaccaccccatgcattctactacttctatacagtttaactatctgcaactgcataactaagcagacaaacttcagatattcctgcagtaaaggtgcttaaaagtaatataaagtaccttgtacttccgactttcatcaccttcaattgacctgctcgcggtggagtcatccgataaatggatctaagcaaatgaaatattgatcaaaaactaccaaccgctctactgcagagaaaattagtacatcttctgatacaaaataagatgaccctgcaatacctgctgacttaaataggctatatcttctgttgtcagataactaaagaatggttcaacctgccgccagaatggacttgaattagcagatcctgtaataaaccaatcattattcaaatagttccagaaaaatatatctagataaatggaaggatgtcacaagtgaaaccaatacttagagcagaatttgctgcagcaaggagctcctcatgatcatcttccgattgcactgaaatgttaacagtatgaaatcatcatgatcacaaagaatggaagccatgtacataatagtacggcaagaacttaccaggagagtctaactgcgcattgctacttatatgtctaggacgtgcattgcctttgcgctccgacatcttctttatcagtggtcttccagatttactgaacaaaataatcacagtaagaaaaaatgacaagttgattggaatgctggtaattgaagaaatcacctttcatttctctcagtgactgtcctaacacttctttgttttgtagttggagcattttcaagcttgtcaattgatgcaggggtgctgggcctggttggagtaaaacctcgtccgatccttccttgtcttcgtgcagcatctccaacatcatcatcagcagataacttattccttttggaaggatggccaagcattgcgatcttttgaaaaccagagtgcccgtcatctagttccccagcccttttgcttttgtcccttaactttttctcagcaacaccagattcatcaccctcagatccagttgaaagaccatgatctccccgtctagtttgttgcgaacaatttatagaagcacgcctaggtaatccggcagactcttcattgatagagggactttcaagcgaacctgataccgattgaccatcagtgtttgtgataatagcgactaaatttgactttcttgctgaacgtgatatcttctgaggcctctgcccaccccactgggtgggaggggataatgaatgtgtagactttgtacgtttgggattgccagatccactagtagaattaagcttagtcatgccagaaggatgttcccaatcatcagaattagcttgcaacctatgaatgtttggcgatgacttcagtaatgaaccagaattcgaacggggtcccctagtagacccatttgcctttggtactgcagtgacattggcaccaccatcatcttcgctgggcctaaaaaaacttgtagaaataagcacatactgtacaaatattaagtcttcacatgcagcaggaaattactacctaagcttattgtgacaactggcaagcaatgaatttagacaagattgtaacatagtgaatttggagaaagaacgcatcttacttgttatgagattttggagctgatatttccttatctaaaacagcttgacgatcccttttgttagtaggatggaatccactgtcttgatcactcctacttaaggatcgcccaaccccattttgtccagaaagtaaatctgatttactaatgctcgagactgatgagacagttccagacctgcccatataaaagttacccagaaaggaaacgcctggtcagattgtaaaactttatatacaaatcattttcttattagctgaattgcttagtttgaatgttcggagaaaaaataacttgataatatgtttttcaatcatcatgtctatgcaatatgcaaggtcagattgtccatgatgtaagatcaaacagaataaaggactgcatcaaaagagaatcaaaacaataaaacatgcagaaaaggatgatagaatctctgacctaaaactaggggagtttgtcattcttgccctagcttcattattaaatttgtgttgcatccctggtttctgctcccggtctacatcaacatttcttgaaggaccagtcattgaaacatctgccttaatagcagaacgttttttcttcatctttggcttttcccaaccatcaataccagttgctagccccctaattttttcttctggaactgctggaccaccaccggtgactttgccaggatctgcacttctatcagtagagcccagtccccttgacagaacagtggtccttgcatccatctagtaaacaagtaataagttgtggtaatcagttttaagaacaatccaaactagtaaaagttttaagaaatggcaaaccatcatgattatgtgcacagtaaaaatgcttatcatattaaacatgctaaaactaatagctacaggctgcatgcttaaacaagaaaaacagatgaataaaacaaagtcaacaataaagaaaagcacagattaatacagcaaggccaaaacaggcctatggcttagctgcaagcaatacatactacgtaagattcaataatacttttttacctgaaaattgtcagaactaacttattcagaagtataacatcacattatcgcaacaatagtaacctacaatgatacatagagatgtgagcataacctcgaacatggatgtgcgtaatctcctattctgtcctgcattctttatcctctcttctcctctcggagataccagttctgtgtcatctgcatttagatggccttgggggggcatcttggatataagtcctccagacaacaatgcagtagatcgttcatttgatgaaccatctcctctggaacgcttccgcaaaatattcgggcaacatctctcaatctttgttacagcagcaccataagctctagatctttccctgcaaagatactcataattgaaaacatgttctaacagtttcaagcaaatgtagtccacatagccatccatatgtactgagatttttttcccccaataatcttcccttagaagggtaaaataaacattatcaaagaatagtaaatcacaaataaaagttgcctctacatatataatacagatggttgctcaatcaagtacgtagtgatgcagttgtttgcaaccctatcgcacaacttaagttaatctcacaagacaatgtagagagtagtaaaataatacctagctttgtttgagatgtcactaagattattcttcatgcgtctaatctcttcaaaaggaagagatgagttccgtcctgtgcatggagttgatgtagactcttcaggggaaattccaagaatcaaacttattgatttttttacatccaaccgagatgtctttggctccaaagttgttgtccgcaagtccatggcaagtgattgaagcagagtagcagagtcaactgctggtgaccttgatgaacctgatactgggaatgctgcataactatcgccactctcacgaaaacttgctgacctttccaacgaagcagctgaatacagtccacgttgcccactgaagtatccatgcccatcaggactaccagacatcaagtcagattttgtactagatgccatcaccctgctggtgacaaacttttagaccgttaacaagttcaacatgtctccagaggatgtcaacagcctcatcttgcaaccatagaactcaaatgtccaaggcacagtggaaaatctcaaatcaaacaaatacctgtcattatagaaggcacagtaagtagcagatgaacttgaaatcaatttttcagaacaatccagagttgtctgtatgaccagagtacgttgcaaaataatagcttttaccaaacaaaacatctggcttttaaaattgtaccaccactctatttcaatgtaaatgttcgagtacgtgataacttgttttgttcatattttgctattaatacaccaaaaattgttttcaggtattgatcaattaacataatttgcaaagacatcaaatgcattcagtaaaccaaatatacataaatcaggaaacaattgaagttgccagattctacagtgcacgtgttacattaatgcaataacattgtattaatatatgcaaccagctctacaacagcaaaagcagcaacagcatttagtctcaaacaagttgcaataagctaggtgaaatgcgacaacctctattcttccaaaatctgatgaactacgcgtgaattactagaggatataaagttcggcaaacatctcagtgagatatctacttcattgtcaccttccaccaaatctgcttaatcatgccacagatgacaacacatatggccgagcaacgatcaacaaagatactagcatctccttcagactagttatagcaccaaacaagaccattcgaccacctccatcgccaactgaaatgcacccacaaatgacacatactagtatactaccgtgctacaacagaaaaaggacagcagtccgaattgatccaaagttctgggaacaaccaattcaaagccatgatccatggcacgaccaacaataacctaacaaagctaccaaagctcaaaatgaagcaatcagaattgctctccactcatcaaaccaagcggccaccaccaccaactgttacatcgcccacagaacgatcgagaattacctaaattcaaagcagaaccacggctccacggtgcagctacgagacccctagcacgacatggccgatccacgcacaccatcgccccctcctcacggatctcacccggagatccagccaattccggcacaacccagcacgcaccacgacctctcgcataggcacagccctcccccaaatccccaagcttccccagccggatcccacgcccaatccccgtgcgcggatcagcaccccccaacctcggggacggggtggcccccccacacccaccgccacgcggcgccgccaaatagaccccaagctcccttccccgaagctccagcagccgcccccacaagcgcgaacaccggaatcggcccggcaagctcggccgaatcggattgggggccgaaaggggagaggggggttgatggggggaagaagctctagggcttaccgagcgcggcggggatccggatctccgggcccggcgagggggcggcgatcgtcggaggccggcggcggattccgagctaccggtaatggaggacgcggaggaggaggaggtcgagccggagagagagagagagaaagagaagcgagcttcgagaagcgtggcttcggggaaggcggagggaaggtggggtcggtcgccggtcggtctgaaagctctgaaccggaggggggtggaaccagtccagttaagggcggtgggtccgtgcggatgacaggtgggacctgagcccgcgtggcagtggctgattgggcggagtttctttttttccccttctctcgcctccgccgcggcggtgtatgtgtgtattatcggtgtagagcaaagcgtgtactcctagagtatatagcgttagctgcggtacggtccggatttaggtttcccctctctagttggggaaaaacacgaaactcgtgaaaatcatattaaaattttcattaattttacgaataaaattactgaagatagatgtagatataaaatatacggttactaaatcttttaaatcttttgtctaaactcaacttcattttgaaagaaacaaaaacaacaaattccacatggataatgtcatgttactattcacctcagatttgtttatttactcccaaatagcatgtcatagtgctagatccgcctgacatagcctacgcaatagttaatacgtgatacaattataatatcaatagtgactaaatatctttgaatgaaaatatattttctcttagaggacacaaaagacaaatatcaggatggacccgagtgaccaactcagtagataaaaggttttgtcttataaacaaaaattttaatggttatatttccatgaagttgtaaaatacatgttgtctaaaaagaaatgtttcaatgaagttagtcgatatttattgaagttgttgttttctatcatgattgcataaatggatcactaatacattttatttgatttatcaggttaattttctacatgattaatgaaatgcttaataaggtcttgaacaacaatggcagatgcaagatatagcaatggcaacatgaatctatgaaggtaactgaatgtgcagagatgtgaataggctttcctgaaattttctcaacaatcatagcggttaaattggtaggacccggaacctcctggtggtgaacaccggaacttccgggcaggatgagtatcccggaacttccggagttcttgagtcaggaacttccgggcaacaaaaaaaacgaaacagggaagtaaaacaggtcctagctagagacgatcaggcacagagttgcacaagatgtaaatctcaagataccagcagatttaaacacagatcatgcacaagagagacaaaggcgattttttcccgaagttcggatcacacggatcctactctccgttgaggtgctcaaaagagccgagtctcgattaaccccttgcctcacttatgcaaagatcccagaagaagtccacatccttcaactcaacacttctaagtcattttctagaattgagtgaccaccaagatcca

SEQ ID NO: 25540 - DNA, 5910 bp, Oryza sativa
tctcaagataccagcagatttaaacacagatcatgcacaagagagacaaaggcgattttttcccgaagttcggatcacacggatcctactctccgttgaggtgctcaaaagagccgagtctcgattaaccccttgcctcacttatgcaaagatcccagaagaagtccacatccttcaactcaacacttctaggtcattttctagaattgagtgaccaccaagatccaactcacaattccttttagaaaagaccacaagtgcaagttgctctacctaggacaacctctgaaaactcaatacaagaatctttactcacttacctcatttccttgcggaggtgaggaaaaccttcacaaactttcccaggacatccacaagatctttagaagctcacgggcgacacctaaccatctaggagaagatctccaagagtaataagcccaagtgacagcccacaagatatccaaagtgctcaatcaaacctaatcttcaagccatctccaaaacgctcctacactctaatctaatatctcaatctcacaagataggctctagatttgagtggagaaagcaaaggaagcttgggagtggctagaaaaccctagaacatgaaagagctgaagtggaatggccaaagggtgacctggggacgaaatccatatatataacggctaggtgacgtcatctagccgttactcacaaatttgaactggaaacctgctaggaggttctgggcaaaagtgccaggaacttccgggcagcacttaggaaatttttgcttttgcaatggcgcccggaagttccggccaaaacctccgggtagccctctctgtcccggggagaaaaatcattttgcaaaaatgattccaaaaatattttgactcatggaaatgactaagagcactttgtataccctagaaccacacttgaaacccctcttaatagtacggtttttcctaaactcaatttcgaaagagaaaaacctagtctaatcaccttcggtgtttttcgcacttaggaacattcaaattggggggtctccttgcattcttagccatcacaacttgctttgggactaaactcctgtgaataaacttgataaacatgttagtcccctttaaccaccttgtcattaatcaccaaaacccactagggagtttaagtgcaccttcagtaacaactgcaaaactttacaatcaactgaacaaatctaaacctaatatttggaaaattcagaagttacaaggttaaacatcactcatgtacttacgaattaaaattttcaggataacatttttgtagcatatgatcgcctttagttataaaacatcacatgaaagtactctttggacgtgaggtggctgcaacaagaagtgaagatgatggacttgagcattgccgacagcaacaacggtagtttgatctggcctaagggttagagtcggttgaattttgctgagctagacggctgtagtgagttgcaaaaccggcgaataacaaaaggttggttggcaatgccagtgatggttgggatgcaacacggtatctagggtctcaagttttgctagatctgagatgtttctacctgaatctcatccatatagcactatgttggggcggggggcttctatctgatagtctgatactagatgagttggcaagcaaaaactctaggggcctggttttgaatcgaatggatctatatgatgatatgggcaaagttgagtaagagcaagttagaggtgaatccgtgaatggatcatggatgaagaatgcatgttagggctgcgtttcaagatcgatccagtgcggttcttggtgtgacagggctcatcatgcagtagaagatcaaagcttagttttctattctttgctcttatgtattgtttactttgttatttctcacttctaagatacaatgtaagtatttttattccatttagcaattcaaagctatggattatcatgtcctcagtggcaaacatcttatcgattatcgatagcaccgtagtacgttttttaagctcttactatcgctgtaatttttaaaactttcttaattgacattgtcctttcgactaatcctcgtaaactgtgttccgtcgttaatcatccatcgagaatgcgcccttaccacgtgatctggcgacgtcctctcttagatttttagcacaggcaaaaaaaactctttagcacatgattaattaagattaataattataaacttaaaaatagatttatttgaattttttaaacaacttctatacagaaaacttttttaaaaaacacagtttcaaagtgtgttaatgaaaaacaatgaagtttaagtttggagttgaagaaaaagatctgagccttaagacactaacacaaactaacatgtctgtcctagaaggggttaggttgagttttttttggacggaggaagtagataacataaatcaacacatttattatctagctacataaatgtgaatctagactttcgttgtcttaggaggggtcagattgagttttttttggacggagggagtagataacataaatcaacacatttatctagctccagcctatatatttctgaacaacatcaatattttaccaaataaaaaaagaaaaatatgaattattctgaaactaaaccaaaaggatccaaattttaatgtgcacgtgaatcgtgaatcactaacgcgtaaatatacttcaaaaaccactgttacgtacaacatttttcctgtacagttgcaggacaacagctatggcaagcaaatcaaccggaggattttacatttttacgacgacaaaaagatatacagttgctggacagcagctatggtgagcaaaccaacaggagtatatacgagaagaccttatagaaatatgacaaattggacatagaaatgaaatatcgtctttcccatagcaactggattagagttgaacatggtatcatgtaatttatatgaatagcacgcatccataaacatcttgctgtcaagatactcgtaactcggacccaaaacgttccaactcgtcctactcatggactacatttcgtgttctcgataaaagcgagatccgaacagacctgatccaaaagccaacctgcgactctaagcagaaaccatacacaaacaaataaataataacaagtgaacgcccaataggtaaagatgaccctgacatcttccgactctgcccaaatgttctcaacatagctcatggctaacgacttttaacttccatagacgggaagcactgacaaacttacccttcccaccgagcactagtgttctggaggtaacacactgctgattactctgaggtggcagctgatttggtgtcagtctccttgactgcttcggtcgattcctcctttgtcgccacttcctcagacttcttttcagttacgctgagtttctccagaaggccagcggcagacgaatcttcctcggtttctttgccttctgtctttgcaagtgattccgaaatctcttcaaccaaatccttaaatttcttgcaatctaggaattatatgataggaatcttagtcagttaaattcagatagttttcagaagattcaaataacagaatgaaatatgtgcaacaaatggaacatagtagatgaagaggatgctgctcatgcagatgctactagacataatgttgtagctacataataataaacacgttcattactaatggcaaaaattatattgtactattcaagaaaaagatgcccccacaaacacatgaaagttacaaagttcactacttcacctttacagacaaggaatgaaagaatgtaatctgtaacgactgctaaaaatgtgttaacacaaagaaagcctattttttctaccacaacagtgtgtacctaaatcattctaccgcaatagtgcctaaagaagccaatggccagcaagagcaaacaacctgtgttctaccacaacagtgtgcacctggatagctacacaaaaatatacattgggaattatacatatcaagtgtactttaccacatacttcctccgtttattctagcatttcccacattcatgttgatgttaattaatctagatggatatatatatctagattcattaacatcaatatgaatgtggcaaatattagaatgacttacattgtgaaacggagggagtaaaaaacaaaacatgaggtaaacagaatgttaaatatcatggaccagtctagttcattattattctgtacattttaagtttcagtaagattgttctccacatgactagcaagtagcaacataaacagagagacatcatggtgtcccatctccagtttacctcatagggtctaataacagaatcttaaaattgaacatgacaaatctcaataattattaaggtaaaaattagatgaaaactgtaatgacagggaagaccaggggaattggtgcccctatgttatcccacccatccgatccaaagcgtgcgaaaatccttcaaggttagctatccaacactcctcatagaaacatcatatgaaacaaccaatagattcacaagtacccccaattcaacatgttcttaagcacaactttggttaagcaaaaattgcaacccatcaacgttcaacggaatctcagataggaaaactactattgccaccatgaacaaaagcaaacggcatgatccaacataatactaccaagcaaggataaccacactacatagtagatacgactacaacagaacaaattagcccagagacgacgggagcgaacaactcactttcgacagagccaaaccggattgcgaacatctcctccttaagctcgccgtcggcgaagtccgccgcgtgccagacgcacgacttgtcactgcccgcatgctcctgcatcttcgtggtcgaagcaactgcacacaagacgacacaaagccttagcaacgaggttattgggccacatgaatctatactacacaggcaccgcgattgcaacatctgtaaccaatcctcccccgaagagaagagagagagagagagagagagagagagagagagaggcggggaaattcggaggaggaaattagtttggggagaaacctaggtggttcgcgcagatcttgagcgtcttggcctggcgcatgacgaggcggaccttgccgttctccttgtgcttgaggagcttgacggtgcccgtcccccgctccttccactggttcccctccttgtcaaaccggtaaagcttcgccttcctgcaaacaatcgcgcggatcagcgccaccagatcgaaccgaaaaaaagcacacgagctacaagagaggggagaagaggagagagagcaagcggcggcggcggggggggctcacatgtcgaggagcacgtcctcgtcctcctcgccggtggtgacggcgacctcctcgagccgcacgatgggggcgacctgggcgcccgtgtcctcctcctcgccgcccgcggcggcggcgacggcggaggcctcctcctcgtcctcggggcggtccacgacgggctccttgtccgccatcggaggagaagagctaacgtctgctgctctcggttccagaagtttcggggaggagggcgatcgtggggggagaggttggtggtaagaaggaggaggagggggcggcgcgctagggtttttgttagccacgggagaggcgccgccaccgccagcggtggtggggtggggcccggttggagcggggagggtggggccacggctgctgtgggtcccgccaggtggtctgcgtgttacctacgccggcccggggctaaaaaaaacaactgtactaatttcccttgtttttgtaatttttgttaggccctccgtaataaaaataataattataacttactcatttttttaatttctttaagaataaatttcataaaaccctatctatctat

SEQ ID NO: 25541 - DNA, 2517 bp, Oryza sativa
aaatgaaaaagtggttaactcaaagttgtagtctcagttgagctctacaattttaatataaagttttatttcatctgactttatataatataattttaaattgtaaaatcatagagctaacaagttgtgttggaaaatttgcatttagatcccttgccgccctttggccctcccagagggcggcacgcgattagatttgtaaatttttgaaatataaaaattatttttgtaaatattttaataaaaaaaatgtataaataaaaaaatttcgtgaagtgtgtacctgcactacatgggttgacaaattcgtacgagggtgtgagattgtattctagtggggaagaaagattaacatgtgaaatagattctgtttagttatctaccagcataaggacgatgtttagttatccaccagcataaggacgaccattggtagcggttcctaaacggttactgatgacttattagccgtttagggaagtccctcccttcgtcgaatacatgcaagaaatgaatggcaaagcctcttgttccaaaagaaaagatgaacatagaattggtatgtatggttgtctgagctactgacgttcttcaatccaaaagaaaagatgatgaaagaattatgcccgtctcaactagatcaacggactcctcgtcagtcctaaagagaaaattaaacaattacctatgcaatatctaaaaaattgcacttaacacttttcaactaagtgattttttccgacagcgtcttgacaagtgacaactcgtgtgaattcataaacaaaataacgcaaatactgaaatagataaagcacctatcatttgcatcgaataccattagcaattacttcatcacattatttgaagctgcagccacctctatgtaccaaaataccggacatcgcaccatacctcgacagtagatttaactcatagttaggcagcacagaaggccaacaatcacacacatcataggtaatcatcattttgtgctttcatgtgacaatgagtgtgcagcaggacggatcatttcccaggaagtttgaaaaagtactcgattttccacaactgaatgtgatataatagcatcagatgcagtggagcaagtacaaaactaacggaagcaattcaaaagaacaatcagttattctttgtttgcatcatttgaaccctcctccataggcactgcttctgctgcatctcctttcttacctgtagatgacaaaatggtagttaggtgagttgaaggttccatccaggtgaggcaacttaaatacaaaaaaaccagtaaaattgtgttacaaagaacaggacaaacctttcttcttttttgcaccacttttcttctttgtttttgtccccaaagcaagccatgccttgatctcagcgttgtcttcaatggatttagtgggctgcaactcctgaagtgaatgcgatgttaccctctgtgaaccagatggcagcagaagcacagtaaacttgatgtgtgcaacaaggtcgcctgcacaaacaaccaactattaatacaaccactagaaacgagaaatatggcatgtagcagtaatcaacagaagcggtttgtacaaataaacacaaataatctcaaaaggaggatacagatttgtactcgccccaaggcttatctcataaaaacaaggcagaacaattgccaaaattctacagtattcaacacctagagcgatgatatgtgtacctggcttctcgtgaaggacagggtacggctgcaataattcatgattcatgcattccaccaaacctaagcgtgcacgcttctcttccaatgccctgtgacaattcaaaatgcatgttacaatatagtaaacaaaaaggtgcgtctgaagtaagcgttattgtagcaacctagcagtgaagggcatgataggaaacttctggcttatctcactgaaaatgaacctagatgctttcatcttcaagtgataattcttgtctacagctctcttgtagatggtggtctgcttctcatccaataacttgggctgtgcgtcgtaattaaaaaaaaatgtaaaaaaaaaaagcaaacagaagacaatccttcaaataaaagcagctattctcaccttcccttctccagtgctggtgacaatatcaattgcatacacttcattttcctcaaattcagcatcatccaccttcgtatcagcattggacacactaagtacaactttgttaccgtcaatgacaaactgtttcagctgatggctgagaactccttccacaattttgcagtcataagcagcagcaactttctgaatcgcttcggtgacatccttgttctgcaaaagaaaaattgttactggcaagatcagcattctaatacaaaccaaaggcatgcaactgaattaattcattgcagagaagacatacaggttagctcactaccaaacagtttttgtgtgtctagcaaaacataatagcatagtaagagaaacaagcacaacatttgtgtgcacagttgacctagacactaaatgtgaa

SEQ ID NO: 25542 - DNA, 6000 bp, Oryza sativa
aaaaccatcaatatgacatcccatatcactgtcaaatgaaaatagaatcattaaggctcaaagtagactaagaacaagttgaaaaggtcagaacagcacaatacattttgaccatatcattttcctccaggactgcctcatcagtggctagcggagagaaatggcagactgtgttgttcacagatacacatgttggaaaagcaacacctctttcaatcttcctcttcacattcttgtagatgttgccagtttgcctgatatcaataaagaaaaaaaataagtaatcagtaaaacgagagagagagagagagagagagagagagagagagagagagagagcattaagacaaagttagatgcattactctcttatgtaagaatcgcccttctcacagatgtcaacaatcttggctttcggcttgcacaaagacactaccaacttaagagcatctgttcaccaataaaaatcaatttagcactacaattctagtatcaccatagaagacaacatatttggcattcaggcacaatcgcagaacaaaatgatattggcactgtgccagcataattgaatggacaaaggaaagaagggaactatcttaacacatattactcacaactcctctctacttgtgatatctgaaacttatattgagttgatactacctaactacgaacatcacatatcagacttgcaaactgggcaaaaacaaatatcttagcaaaaaacaacctttttggctcaactaaatagctaaagacggctacgctaacaaaacaaaacaaagcctgtggcaaatctaccctggataacagagcaccattttcccctcaacaaaacatagaataatcacctcatacatgtaagagcaacaatagcggagtgagggacgggagaacgtagaggaggaactagtgattctgacaacaccagacatcagaacacaaggctaaacacaaatgcacatccctgtgcaatccagtgagtggctctgtggctatgcacatgatttctcgacaggcagagactcagacataatattgcactcattgaatagaaagccagtgacaatacagaagaagagcatgctactaacctagaaagaaagcatattactcttcaacgaagctgctaaaactaacactagaatccaaaccgtgtaaatcgtctacatcacagaaattcttcccttaccaaaacatagtccataaataaaacagctaaactcccgtagctaatctttcccaagctaatctttcccaagtaagacaaggtaacgctaacaacacagagcataaacttccctagcgtgcttacggataacaaaaccaccgccattacccagcaaaaagcagacaataatgaactcgagcacgacagtaatagcaaaggtaaaatcgagaggcgtttattactgttgatgatatcggcggcgtccttgtacttggtgacgacgtcggaggaggagaggtcgagctccttctcctctctgacctcatcgtccgacgacatctgcaaaacgagagcgccaaaaaccggaaaaaaatcagagaacgcgaagggaaacgcacgagacggcccgaatcgaaggcgagaacgcgaggaggaggagacgcgcgaatcctcaccgcttcgatccgaacaggcgaccggaggctggacgtggcggtggcggtggcggtggcggcggcggcggagaaaggggaggtcgtagtagggttagggtttggagggggtttgggggggattagaattaaagcaagggggagtgaggttgtgagccgccgccgggggtggcttctgtacttggctagggcttcgaagtgcgcgggggatcacgtgacactgacaggtgggtccatgctgagacgcttggatgacgagcggggccctcctcttgcccggcaaccgtgggtgggccacgggagaaaagctttggcgcggcccgggcgagccacgtgaacgggtattgcggaagctgccggagttcgctgtgatccgtccgatgagacgattggtagatccaacggcgtgcgttggttttaatcgtttgtgcctgaactggtgggctgcatttcggcctgttttgggtgttggcgtgatcaaaccgcggcccatcaagacgggtgcttctctgcttccgtatcaccggcccagctagtaggattgcagtgttcatactgggaataagtccattttgactccctcacaatatagctccaacctcattcatatccctaaaccacaaaaccggatatcttgacacccttaactataaaaaccggtgtaatttaactcctctaacggtttttaatagtggtttcactgacgtggtgctttgacatgatctatcctaataagacatcatgtgggacccacatgtcattctctcactcatttttttctttctcttcctctctctctccttcctcttcccgtagaaagcacggtccggcacagcccgtaaattggccgggctggcacagcctgtatgtgggccgtgcctggtcctagacaacgggcacgacgagcggcatagcacggcacagcacgactagtgggccgtgcttgggccgacacgacacgcgaacggcccgtaggcacgacgaccgatggcccatggcaacgataatggcctatcaggcctagccactagggcgcaagcacattggcgtcaaaggcttagcggcgtcccttcgtcttcgttgcacccgtgacccgtgcctccgtcgtcgcgcatgctcggtgcctcctcccgcttcgcatctcgttccaggccccggcaacaagctcggcaccgcagtttgcaggtctaggacgcatctgagcatctctggccgcccgtcacacgcgcgtatgagtctacatctctatgagatgctcagagcttctcctgcaagaatgcgatggtgtccggcgattcccttccgcattggcgcaatgaatcgaggcgtcgctaccactagtccattactgtcatggtgaggtcgactggtcgagtaccggggatggggatggctgatggccgaacggacgcagccatagcgtcgcgcggcgtcggacaccacctgcgatgtaccgctggacaaacagagagctcggactagtacttgtgattcccttgctcggttgtccttgccctgccccgctgctgtccgttcgtatcctggcatcaccgtttgccgcctcgccacgagcccacaaccgcaagacgccgtggcagggtagcgcccgccttggattgagatggagatgggacgcctggtggcagagaagcatgggcatggcgcatggccattggttgtgcgtctatgtctccatggagccagcaggcagcaagtgtgttttgtggtgtgtctatgtgcaagtgtaactagaaacaactagctcatgaaggcaatttgttctataaattcctcctcctcctcttcttcccagcaaataaaaaatgcagcacaaataaacagaacaaaagcaatatagttatttccctcccacaacaaaaatgtggggtgatactcgtcggaggtcgacctcatcgagacccccgcaaaggctcgcctgatccttcccgtaggtcggtcgatcatcgccaactatccccgggtatggacgattaagggatggatgaccgccatatggatggtctggagggacatggggatgatcctacggaatagcccattcccgaggccaacgacgacacggtcttgcccatgccgggaggcgaggccaagctatccacaccatctgcacggagagtggagtgttggcggcacttcgaaaaaatgaaggtaatggtggacgatcaacttgtaacacgtgctacttgtaaacattatgggaaaactttgtctgcatcttctagttcaggaacaggacatctcaaccgacaatatttggcgcaccttaaggataaagcaatggtggaagcaaggtagacgcaactgagcttctgacccgacggttctataagtacatggacctatgagccatgagtagctcaagatgaaaattgctcgttacatagttttggaggacctaccaattaggatgggtgaaagcaaaaatttgagaggatggtctggaatgctttttgtccaccgtacacccaagtttcaaggaaaaccaccaaaaacgatattgttgtgttatatcgttctaggttggatgagttgaaacactcgttcagtactcttcgtttttcttttgttgtgacatctgacatttgaacatccaagcaccaaagaacctcttatgttactattgtcatgcattatcttgacaataatcgcacactaaataagaaggttatagggtttaaaatgatgttgtcacatactagacaagccactgctaccatactactagatgtactgcaagaattcaatttaaaatctagggttatttctattactcttgacaatgcatcagcaaatacaacggccatgacgattttggagccaaatctacaaagtacattggaggttatgttatccattagagatgcatctaccatatcatcaacctgattgtgcaagcaggtattaggagtcgttgagaatttatagattttttagtgcaaataatttatcaattttaatgcatccgtgacaaggaatttattgtctatgcaggatttagtattattactaatttactcaaaaagattcgtcaagttgtttctatcattgagggtcaatcagtgatgaaggagagattccgggactattcttgagcaaagaataaacttgtgaggatgcttggcattgacgtgaaacataggtggaacacaacatacctcatgttgcgtcaaccgaaagggtatgaggaaataatttctgttttcatcaattcattgcactttagaaacaatgatattgataaggatggtgatggtgagattttgcttcttactgaggaagaatggaacatagcaacacgtctgcgtatattcctaaagcctttttataaagctacagtcctactatctagaatttactatcgtacttcttgtaaggtgcttgaatgtctttggaaattgtcccttgtgtttcaaaaaaaccgacatgatagagttttagcttctgttgttcaacccatggaagaaaaatttctcaaattcttcactgctattccacacctttattattttgctttgatacttgatcaccgtaaaaagttggaggttgtggagactgctttctatcaataggtgatgcaatgagtcttgattattttgaagcttatcaacatgctaaagatgagttgttcaaggttttccgtctgtaccaaactaagctaagtgttgctcgtcaggtgcctgaggaaaccccacaaaaaaagcaaagcaaatcaagtgcaatgaatatgtggaagaagatcaggggcaagaaacaagcctcctcatcaggtagtaggtcaaattggaatccagatgcagagcttaaccattacctcaacaccaatcacacaaaacatgatcgaacattggatggtgaaaatttcgatctccttgagcggtggaaagagaaagaacgaactcttcatgtgctagctcactttgcacagggcgttctattggttccggtttcctctatctcttcggagcatgcatttagcgaggttggaagaattattgaagaacagaggtcatgccttgcacctgacacagttgaggcaatattttgccttaaagactggattaaagcatattaagcaaggacacaataccggttagaggatccaaagattactgatgcagcggcagacgcattgatggaatttggcatcaccacttatggcagcggtgccaatcgaaattaataatgcaatttctgtaatagtgtaagaaagttgtactcttttccttacagggggaaccctactctagggtgtaaggtttttaatgaggcaacaactttgtatccttattataaataaatttgtttcctgcccccaatttttacgtctcaagttatttgtagtcggtttgagaa

SEQ ID NO: 25543 - DNA, 934 bp, Oryza sativa
  unsure (1)..(934): unsure at all n locations
aaaaatgcacttcaccgtaagtgcttttttattgtgataagctgacgaagcttacttcattgtgagtgtttttttatcttgataaatccattgaattgttatgctaactttgtgctgcaaattaaataagaaatttcacctgtgcagcaatgtttgcatgaatttcctgataggaacaataccatctgatggttcacttgtgaattttaatgaaacttcgtgagttatgttctctatgtttttcattcctgtctaattcaatatatatatatatttcagcaagcagagtgggggatgtcgtgtgatagagtgcttttgtttacctctccatgatgccctatactacttcatacttgtaatatatcatactaggacttcatgcacgcttcacggtgccctaccgttcattaagaggtatatactttacgaaccattattcaataatcttacagagcaaaaaataggaggtttatagtaggaacatatagtaaatttagagcacaatgttcggttaaatataggtaatgaacgtgctagcacaaccgcatttagcttgctttaagttaacggatcgtacaatagataagataggcatgtatgttctagtttgtttttgtccacagtacatataactatgtattttcttacttagagggatgcaactatcgtcgacgcctacgaagttcgagaggaagacggcgtggtggcaccgatgatgatccgccttcaacaaccccaaacatcagagttgagctggccttgcgcccattggaatgtttttatgattggcagtcgagggtggttcttctcatattcacttagcgcctctctattgttttcacttccactgtaataaacgcagtagtcaaacaacttctcgatgtgaannnnnnnnnnnnnnnnnnnnnnnnnnnnnnnnnnnnnnnnnnnnnnn

SEQ ID NO: 25544 - DNA, 27238 bp, Oryza sativa
agatctgcctagtaataaccaccgagcaggcacaacatggagagggatatcaatgagaaagtaagaagttcggcgatgctgttacctggttgggaaaagagcttgaagaagctgacgtttccttgcttagtgtatagaagagcagagaatgagtgaagtgcaaagaagaggacaactgcctgagagagaccaaagaagaggatggttacctacgagaaggaagaaaactgtttggtagtggggaaagagatagaggaatggcatgtatactgattgctagcttgtcatgtgtcttttcaaagtcttcagaagtagtaggtaggcatggagttatgtatatgtatacatattaaataggcaacatccatagttgtttcggtgtaagtgattttgtggattccttgcacggtatataaaaggagtttgattagctaggtttaatagagagtcttgtttatgcaaaggattgtttgcagacgatcaagatgtagatgcattgggtaaaaatttggtaacaactatatgaaaacacctgaaaattgcacttataatagcctaatagcatgcatcgtaagccttatcaatgtctaggcatcattggcatatgccaaattgaaagtacttgctgctgtttgctagcattcaggattatcatgatacatcatgatcatgcaaaatcctatctatatggatgtaagagggatcacatatacatttgtcgacagattttctcctaaaaatttgacaggtataattatagtacaatcatgatgtaagtacattgtaacttacatgtaacttgtatgtaatttttaaaatctctctgtaacatgctatttcggtggaacggatgtcgtgggaacaaatcttctcacatatgtgcacgcggtgacttttttccttcttcacttgcacaaatcttgaaacaaatcaaccagttcaaaattatgtgaaagttacatgcaagttacattgtagttacatgcaagttacagtgtaattacactatgattgcactgtaattacatctgtcaaatttttaggagaaagtttgtcgacaaatatatagcaaaattgatgtaagattagcactaccaatctttttcacaaaagcaacaattcaatcttagttcatctcacatgcatgcatccaacatgatcacaacatagtttgtagtggcaacagattaacatcactaagtcattttgtttcttctccttgtgtagacacggtaggagtcatgttgacttcaaccaatgaaggttcatgctaaggccaccacaactttgcacaacaaaaaacaacatgcctatatccttgattcattaggccttgtcgatgacattggaagtatatgcaagaacttataaggaatctacaaaaaaattatacttgaggcagaaacaaagctagtcagcaatacctgccatcagcagtaccatcatagttgtccttgaacaatttcttagaagcccatgtaccaggagatggcctgggcctacatttggttttatctccaagttagatcataatatcaagatgcctctagtaaccagattgataaagaaaggaatgtttttaccttttcctgtatgcctttgaagtgctactgttggttgcagaagcaggagctttctgagtaaggctaaggtgctcatcatccggtttcatagcatggacatttagcacgtgagatgtgcatgatatcagtgtgaaaaaagtgaagtaaagaaaccaacctcatcacattcatcctctgcagtaatctgtgcaggggtctttgatgcacatccattttctagatcctcatcttaggatgcaatgaatgatgggctaatcaaggctagttcaccaccattgtgtccaattgatggagtgacgctttaggctaggcaatagagagttcttgctacgggcaccgccaaagacaagagggatacaaaatagacttattccaaatataatacacggcccaaagagacgaggaaggagaagtagacttattttatggagaagcacgatggtcatgcctggttcatgggccatgggtgcaacccgtggctaggcacaacccaaccgacgtgtagattggccgtgctaacccgattgacattggcccaggcctggtcgtgcctgggccgttgttgacggtcgttatcgatcagtttcgaccgtcaatattactaaaacatgagagaactagtgatgcttgcaatgcataaatatgttagaacaataatattccactagtattaagtctactaacctttttgcagagaataacaataaagtgaaggagaatcgacatcaacaccaacgataaaacaatcagacgatgtcgaggaccagacttatgtatgaatgggccaagaactcagaattgacacgatgaattgggccaaaattcacaagtctgtggagtggagcaatagaggaggccaccagccgaaattgggctggattgggctagccccaggttcggccgaaccaatccaggcgccgatggatccaggttttggcaaggacgtccaggattgcatcccaatgacggttggagggcacttcggacaattccccttccacaaccgtcatacctacctctatataagaagctcactctcttcacttcaacacacacctcaagcaagagctctctcattcctctcaagtttagtttagtagtatctagatggtggaatagaattagaataggaatcaggagtccggaagcctccggaagagttcgggtatggctctaggagctttcctttccttttttgtaagctttgtacttttattagaaatactcttttaaatacatttctggtattgaaatactttccaagtatatgagtaccaactttacattatgttcttattatactgaatataccgctagcttatctgggagatgctttggtgagggtataatgtttggttatgcaattactctatgtcatgacgatgatattagagtagtatctggtcgattaggcggtgtgtctagattacgggatatcattatttagggttatatattgcggatgagaggcgggccgcttatggtgacagatcagtacgggtattccctctgcgcctatatataatcctaagttaatttattggggagggtattcctccgtatttagccccgggtggatggtcatgacgggctgtcgtaaggaactcggcagtcaggggtggcttctcgaagtaccaggagggcatcggatagagggtattagctagtatatcagttaactagaatgtatgtatactatgtatattagaagtataggaatagattctctttctcttttctttccacctagcttagattatttattatgaggatgagtagaaatgcttgtgtgtcactctacccttggattatcttaatccctgcttagaatatgattatcacaagtaatatataaattattagttgagttctctctacatgatcttcccacgggataaaataaatatgatacccttggaatactctcgggtgaaatgctacaatggtatatccgtgtgcttgcggatgaactctgtaaccataatataccataagtatttctgcgccattgttggaaattatatttctagtaatgtcattaagaaataccaacaagcatttctggcgctgttgccggggaagattcataatagagattacttgtagtaacactttatatttacctctgtataatcattttcctttgcaggctaaccttgtttgttttcactttttgttgtgaaaacagggtagtgcatgactggtttcaacctgccggaaaactccaaagaaaatctagaagctttcttccagagcgtcaggccgcgagtcgttgctccgtagaaaactctaccaacagagaaaccagccgtaccagcgccaccaactttcaagattatggccagcaagaatctcgtgagttcgttgctccctctactgacaatatggccgtcgggccgcaagtcaacataggagatatggatttcgacttgaagtccagcctcatcacgatggcgcagactagcccgttctgtggcaagcctaatgaggatgccaacgctcatctgcaacaattcctggagatatgtagcacgtacaccatcaaggaagtcagtcctgacgccgtcaggctgcgactgtttccgttcttcctcctcgggagagcgaagcagtggttctatgccaactgtgctgctatcaacacttgagataaatgctctatggcattcctctcgaagttcttcccgatgggcaaaaccaacgctcttcgtggacgaatttccagtttccagcagacaagggacgagtccattcctgaagcatgggaacgactacaggagtacgtggccgcctgtcctcatcataagatggacgactggctgatcctgcagaacttttacaatgggctcaccccgatgtcccgcgatcacctggacgtggcagctggaggagcattcttctctaaaacggttcaaggagccgttaaacttatagagaagatggtctccaatatgggttggagcgaggaacgactccagacccgtcagcgaggcatgcacaccgtcaaggagacggagttacttgctgccaagctggacctcctcatgaaacgcttggacgaccatgagaaacggccacaaggcaacgtcaaggccttggagtcacacgtcacgtgtgaggtctgcggcggcatgggtcattctgggaatgactgcccagaaacccatgaggaggcgatgtacatgggcaacaacaacgggtatcgtccacaaggaggtcaggggtggaaccaaccgcgcccgtattatgaaggaggaaataataacggtaacttctctaaccaactcttgaataagatgacagaaacccagttaactcagttggcatctttagtccctgcaaatgaatccgggaggatttcagggcaacctgactcctccattgaaaatgttaaggcgatcacaacgaggggaggtaagtctactcgtgatccgccgtatcctaaccttgcaggaactaatgggatgtcaaaagaaacgccatctactaactcggctgacaagaagattcagccagagaagacagtgccgtaggagtactgcgacacacgtttgctgccattccctcagcggagcaggaaaccgtcagtggacgagcagttcgcttgttttgttgaagtaatccaaaagatccacatcaacgtgccgttgttggacgctatgcaagtaccaacatacgcccgttatctcaaggacatactcaacaacaagagaccgctcccaacaacggaggtggtcaagctgacggaacactgcagcaacgtcatactcaacaagttcccggagaagaagaaagatccggggtgtcccatgatcacctgctcgatcggggcacaacaattcgaccaggccttgtgcgaccttggagctagcgtcagcgtcatgccaaaggatgtctttgacaaactcaacttcacggtgttggcaccaacaccgatgcgcctccaactggctgactcgttagtccgttacccggcggggatagcggaggatgtgccagtcaagatacgggatttcttcatcccggttgattttgtggtgctagacatggacacggggaaggagacgccgctcatcctagggcgtccattccttagcaccgcaggagccaacattgacgtgggaactgggagtatccgtttccatatcaacgggaaggaggaaaagtttgagtttcaaccaaggacggaacaatgctccatggtcagaatcaagtacgggccgaacccgcagaatattcaagtggtcgaagtggagccacccaagacagatagcctggtaaagttcatgcagaacttcctggagaaggaaacaacaatgccaaggaaccgttattggaggacaccggtaaaatcacctgtaccagtcaagaagttagagcacccggctcagaagaagccgtttttcgcaccaaaatcaaagaaggtgtggaaggaaaagccaaagacgcccgctccatcacctctggagacgggtggaaaatccgcgcactgaatcgaaaggaggtacggttttgcatgtcggactttaaatgacgcgaccttcgccaacaggtaaattggtatgtatctgcatatttgttttcaacaatttgaatttttgcatcaccacatatttgaatttcaaaattgcatttaggatttttgaattttgaggaaattcttcaaatgaatttttcagagcaaaccaaaataaaattttcaacaaaaattcactgtgccacgaccgcactgaccgttggattccatcggccgaaagtggggccggttgggcccaccaggggttcggccgaaccggccaggcaacggtcggctgcctcactttttgaggcaacggctagtgggtcccacatgtcattcttgaccgttgtgggcaccctataaaagccagccggccaagagagggaattccaccccatttcaacacattttcattccctctccaaagtttgctctcaagtttattcatgctttgatagttcctcaaattcaaatctttaattgcatatatacaagttgctttggcgaaactaaccggctggtgaaactcttgtcaattctaacccccgccgagttagcctgttcttgttccattgtgcagtatgaggaggcgactgtctcgtctgttcaagggatcaggctatccatcaagtcgtcatgacgaatctagtactcgttcatcagctgatgtctcgatggaagacaccgacgctccgcgacaactcttgagcgacgctgacctcgaccatgacagtgatcgggagagacaagcctactacatgctgagcgatcgggagtgtgctcacacgcgagaatactcgccggagctgctgaaaaagataggtatggatgttgaatttcgttatatttggaaagctgttggttggcagagatttgctgtggtagatgagcctggttctcatttgcttactttgcaatttctgtgcactttgaaagaaatagaagatggtatttctttttgctttttccgtaaggagttcacgctcagatggaaaggcttgagtacacttcttggttttcacgattcctgtaaaaccgatctctagaaaggaatttctgggttcgagaaaaatagattttgggaagatatttctggtgctccaatttgcaagaaacctagaacaaatgatatccataatcctacacttaggctcatgcacaaatggatttctatgactttgtttcctagaagtgatctgagacccattaggggagatgaattaattatcatgtttgccatggttagaaagataaaaatttctcctgtgaaatgtatgataagacaatggttagaaagtataaagttctctgctcttgttgagtgcacttttctgattacttggatagcaaaagggctaggggtcgttagcgaccaaattgcttttatctcagccgctcgtctgcatattgatgaggcctatttagtgcaagggcatattttgaaacatggagtagatggatctttgatatactttttccccggttgtacaaaagaaatcccgttgccaaatgcggggtattatttgtacaactgccatgaactgaccattcccctgcagaccatagaagaatctcgtgcaggtggaacatacagggagacgcgcaacatgacaaggaacgaataaggaagttcatcatcctcgacacccgtgcagatgtatgaggcaggttgggcaccaactggggatgcacccggatggacccaagctccacgccatagcatcggagtctcaacctgggaaagcaccagtgaggaccggtggcatgcgcctcatgacatccactggggggactaccaaccctccagatcaagtggtgtgcctccatccccaagtgaatggcgctcaagttcgtctcgttgggacttgggtgaaatcactaggagaatagacacccttgatgtgcagacgggagagattcagtacaacctcacggaacacatagctcagacgcaagaatgacaacaatctgctgatgctcagttcgccagcatcaacagcatgatgcagcaacagcacgatgactttcaagcgtactttcgctttcaggggttcaatcctaatcaaggaccctgagcgaaagccaagcttggggggagacttcgctccccccactgaggtaacttgtatcacattgcatatttccctttccagttgcatatttgctttccaattgcatcttataaaacttgaaaacaacataaaaatttgcaaaatagaaaataccaaaaagataggataggtttgagtcatgctaggtaagacaagctagttctctttgttgaaatgatgaatagttgctctgttgcatatctctgatatatgggttcttggtaagtactctctcaaaggttaaatataagtagccaacaattatccgggaacctgaggtaaatgggctgcacttgctgatctaagtctaagctgttgcgagatatgagatagtaaatatgagtagctatgatcctgatactaggttggcttgaattccagatgttttgtttttcaaaatgataaattgaaagttcctcatttgatataaattcctaccagagccaaaaatgtgctatcatgattaaaccatatgcattttggttgcttgccattccattgaactttgtcaaactcttgtgacttgtgtagatacttctcatgctctatgatcaagatcatacacccatatatatggacatgctaaactcctacactgggagctaagcaatattccattccatatccatattaccaccaaaataaattctccatgctttcatgtgctttcttctcctaaaaagaaaaaaaagagaggagggaaaggcatggttatgaaaaaaaaagttatgctccatcaagcatgagcatgattgaaaaaaaaatgtaatcatgccctctcctaatcaataaaagaaagatttttgggagaagaaagtaagcacaaagaagaagcattttgtttatttttatttatttttcctcatacaccatttccactatataccacacacacattatgcatgatcttgatcttgagtatgtttagttatctgctttagtctaagtttttgactcagtaataaatgtgaatgcaagtatgccatgtttgatccctaccgagctccacatataaaccttagagttggaatcaacaaggcaacatttgatgaggaaatcatgctgatacacttagagagactgagtgaatcaattgaggaacttggttttcttttccaaaatcatttgaaaacttccggaataagagttgaataaagattgggtgattggtgctctaattgttgttctatctttcaaccgcccaaggcaaggagaagcagtgtctcgtgggaatcaggggtaagggtaagccaccgtgccaaagattatttaatctgagagagagtacatgtaccttgcacctgtatctctgagatatgcagcatagtagcagctcctgattaacaaccaagtcattgtttcctttcgttcttcgctcgggacgagcaaaggttcaagcttgggggggtttgttgacggtcgttatcgatcagtttcggccgtcaatattactaaaacaggagagaactagtgatgcttgcaatgcataaatatgttagaacaataatattccactagtattaggtctactaacctttttttgcagagaatgacaataaagtgaaggagaattaacatcaacaccaacgataaatcaatcagacgatgtcgaggaccagacttatgtatgaatgggccaagaacttagaattgacacgataaattgggccaaaattcacaagtctgcggagtggagcaatagaggaggccaccagccgaaattgggctggattgggccagccccaggttcggccgaaccaatccaggcgtcgatggatctaggttttggcaagaacgtccaggattgcatcccaatgacggttggaggtcactttggacaattccccttccacaaccgtcatacctacctctatataagaagctcactctcttcacttcaacacacacctcaagcaagagctctctcattcctctcaagtttagtttagtagtatctagatggtggaatagaattagaataggaataaggagtccggaaggcttcggaagagttcgggtatggctctagtagctttcctttcctcttttgtaagctttgtacttttattagaatactcttctaaatacatttctggtattgaaatactttccgagtatatgagtaccaactttacattatgttcttattatactgaatatactgctagcttatctgggagatgctttggtgagggtataatgtttgcttatgcaattactctatgtcatgacgatgatattagagtagtatctggtagtttaggcgtggtgtctagattacgggatatcattatttggggttatatattgcggatgagaggtgggccgctgatggtgatagctcagtacgggtattcctccgcgcctatatataatcctaagttaatttactggggagggtattcctccgtatttagccccagttggatggtcatgacgggctgtcgtaaggaactcggcagtcaggggtggcttctcgaagtaccaggagggcatcggatagagggtattagctagtatatcagttaactagaatgtatgtatactatgtatattagaagtataggaatagattctctttctcttttctttccacctagcttagattatttattatgaggatgagtagaaatgtttgtgtgtcactctacccttggattatcttaatccctgcttagaatatgattatcacaagtaatatataaattattagttgagttctctctacatgatcttcccacgggacaaaataaatatgatacccttggaatactctcgggtgaaatgctacaatggtatatccgtgcgcttgcgcttgcggatgaactctataaccataatataccggaagtatttctgcgccattgctgggaattatatttctagtaatgttgttaagaaataccaacagctgtgtcggaccgaacaacccatttggccatatatagtaattactagacaaatcgttgaaacaaagaagatgaatttgcattactcataaaggacaagagccgataacacatttaagtgagaagttaataatatgatcttacaaaatattgaaaaataaacaagagagtatgtcgaaacatgatttcagcaataataaaagggtgtagcgcacgagacctaaaagtggatggatgaggagacaagaatttagacagcttcaggccctctcgatgagaggtaataccctactcctttttggggatttgaatccgccaggcgtattataactctgacgatctaattatgtcatgccccctagagggcctcctgcccaccttatataggatggtgggcaggattacaagatagaaaccttaaccaatacggtatcggtttcctaaatctattttacaatattaccaaaccaggactttagaccgttccataatatacaaggaaacgtaatacccatgtcatgatctgttacatatttcatagatataaggtaccctctacaccgatcggataaccacaccgtgtgggtatggggtacccataatctctacagtagcccctgagaccttcacagtcgaaaagataatcttctctcgaaccagattactccaaagccgagtgcttcgatcatctttgccatggtctcccgagtacttttagcaaatctaaagactatggagggctgaaaaataattaaatgtaaacttaggtgcatcgactagatgcacctaataggtgtaacccccgactatgtgcttagttgaacaatctaaacatatagtcaaggagtagataatacaaccaactgagtggttttgataattgtaatcaaccaagtgacttgatatcaatatataacatatgcggtgtcaatccccaaataacattatccaagtgatataccgactgctttgtaaaaattgatgcgagcaacctaaagctgactacatcattgaaaattcacatagaaaagcaactataaaaaaagcttgaatgctatgaataaagaaatttccaaagtattgggcatacgccatgcgcacactgcttttaacagatgtgcttaagtccctaaaagacacatggtttcaccacacctggaaatatacggcatatgtggtttaaaatccgagtaaataaactcataaaggatttaccaaccgcctggaaaatgactaagatatataatcaccctaagccataatattggtcaataaaaatgcacacttacgtgaaaaaaagcaacgatattgtatccaatcaattgcttaaaaacccaaacagcaccttgacttatataaaaaagtcagcggggcagctatataaagctttactgtttgacaccttttaagatgcattgtaccaactcctaaaaagttaagtaactacggtataaaaggattttaaggtattaggcacttgatcacgtgcactttagcctaagcaaaaagtgcgtaagtccctaaaagaacatgacaggccacacctgaaaatatgggctgcagacatattaggcctaggccaaaaaatatgccttcaacaccctttaaaggatgacgcatgtaacatgctcccgagtaataaatcttccaggtgatatagaccaagtgtagctcatatgaatagcttctgatctgagtgattatcccttatgggatactccaaaatatatataaaaattgaatcccaactggcgcaattattcggttgatagcccttacggggaataatgattggtccagtcttcgatcatagaaaataatctcagaactacgagtgcatgttgcctgtatatagaacaaaatccaacttgaaggtataatccttgtgcttgagctcgtaagcccctgagcatatagcttatccttctgttgtagtcataattgtccattgatggtagctgatgcagtcggcatggagatgaaatgaccaacatgaagatgatattgctcatcagaggtgacggaagatgtcagtggtagtaaaaacagtgacaccaatcaaaggttatgaagtcgcatagctgtggaggcgaagaaaccagtcgatagcagtcaggtcagctagcagtgaagatgaaggcgcccaacaacaacgacatagcagtcggtggcgacgaaaccaagccgatgatgaagacatagacatgcatcaacggtgatggcgaaatccaccaatcatgaagatgaagaaaatagtcggcgacgacaaacgcatccgacggtaatgatgattagcagcaacagagatagccggctatgatgacgaagttgcccatcaacagcagcatagtaggctatgttgaagaggcttgacaggatgttgatgaagatgacgatgtcggcgatccagtcaataatggtgtagcagccgatgataacgacgaagacgctcatcagcgtttgcgtagtagctcaaccgtgaaggtgaaaaaacaagttggcgttgaaagtcggtaattccagaagcaaccgaaggcgaagatgtaggcacctcttagcaacggtggagacgtcagggccgatgaagtagatgtgctggtgatgatgtcagtgacaataatccatcaaactattgagaagatatcgaagctcgagctgtttccttgacgttggcatgtccataactgagattgagacaatgcttcctgatttatgacgatagcagtaaaacttggcgttgtagctgttgcagatgcttcatttggaggaaaatagatattgttgttcaactcatcgaaactgagctgattggttaataaccccaaactcccggacatgtagattacatctcaaacttgacacttgagcaacttggagtagattgtagcggcgtggagaaaccaaaattgccggtgaaataataagagttactgaagtagaacgtctgctctgaagcgaaaacgaaactgatgactcccgaagtagattccatagaactcattggctgattagttgattgcttcgtctggacataaaacttgtcgagatttgagccgtatatttgtgtagcccccgactctttggttagttgggaaacagctgaacatagagtcgagaactgtagcttcttgtcgtcgaatagccataacttgagtgaagatatgtgttgagcatgtctgggtagaaatcttgaatactggaacaccacttgttataataacatggcatcatatttagtgacgcataccgagatgtcgaggctcttggagacgtcgtggctggtaaagtagcaaaacttgcgaagtaccggcaatagagtttgctggtgccgaagacaatgaagatgaagtagctccaccataatgacaaagttgcatagccatgatgaagtgaacacgagtcggcggcatcataagcaaaccggtagcaaagacgcgtgattgtgaagataaaaacaccagccgacggtggcataaccagtcggcgacggaagaagtagagtgatgaaaaaacgaaaacgtccttgagcggcggcataataggccagccgtgaaagtgaagacaccacgagtggcggcgaaggcaaaccagcaatgacgatgacgccggtcaatgatgatgaagacacgcaatcgtgaaggcgaataatccagtcggcgtcagacaaggtggccagcaatgaagacgatgacgtccatcagtagtatagtggtataaaccagccgtagaggcgagggccctagtcaacagacagcttgcgttgaagatgatgacgcctattagcggcggtggcggtggcgtcgtggccgtgaagacgatagcacaagttggcatcatacgaggcggccggtcgatgaaaatacagacgtccaacaacggcagcataatagcccagccgtgcagacggatacaccagtcggtggcggcgaaggcaagccaatggtgaagacatagacgcccaacaacagtgttgtaaccaaccaaccgtataggtgaagacaccagtcggcggcggactagacgaaccggtggtgaagacgtagatgcccgacaacagcggcataataggccagccatgcaggcggagacaccagtcggcggcgccgagggcaagccggtggtgaagacatagatgcccaacaacggtggcataataggctagccatgcaggcggagacaccagtcggcgccggcaaaggcaagccgatcagtgaagacgtagacgcccaacaactgtggtgtgaccaaccaaccgtgtaggcagaaacaccagtcagcggcggactagacgaaccggtgggtgaaggagtagacgcccaacaatggtggtgtgaccaaccaaccgtgtaggcaaggacaccagtcggcggcggcgacaacaagccaatggtgatgttctgattgatctattcctgaagcataggagataagcttaaagccatgaatccctattatgcatatctggatctggatcctgcagaacaaacgtatagaatgagtagtatctgatgtaaatatagtacttgaggaaaattcaagatttcaaaatgtttataaatatgtatttctcctcttgttaattttgatttccccaagcagatgactccttacgtttaaacactctgcccgactagtcatagcccccaagcaccgggagtcggcctaggcacttcctaaacatgcataggagtgacatgcgttcgtcattaatggaacaaagtttcacgaatcaaaatttactactcaggtactttcgcaattgttaagagcagaaaaaaatttatcttatctctatacttttgatttattccgaataatacttagcaccttgcgttactcggtccatccaacgagcccccggtgctaggaatcggcccaaaggcaactatccatcgacaaaccaaacggaaagcataggaagatagaacttttgtactcagattatatcgcaagcaatcaagataaatattatgaaaattattgaaaaaaatatgatataacatctgtagcccccgactcactagtcaacggagaactagttgatgcaatgaggcagaggaaaaggaaaaatatcatataaaaaagaaaattaatgatgacttagcttttggtagtccccttgctgacgaaaacaccagtcggcaccagtggaaccaagctggtggtgtagatgatgaagcccatcgacggtggtgtgaccaaccaaccgtataggcgagacaccagtcagcggtgacaaaggcaagtcgatggtgaaaaagtagatgctcatcaacggcggtgtgaccaaccaaccgtataggcgtgagcaccagtcggcggcgacggaagcaggctgacggtgaagtcgtagacgcccaacaacggcggcataatataccagccatgcaggcggaaacaccagtcagcggtggcgaaggccagccagtcggtgaagacgtggacgtccatgaacggtggtgtgaccaactaactgtataggtgaggacaccagttggcggcgacggaggcatgccggtggtgaagtcgtagatgcccaacaacggcggcataataggccaaccgtgcaggcggaaacaccagtctgcgacggcgaacgccagccggtcggtgaagacgtagatgcccagcaatggtggtgtgaccatccaactgtggatacgaagacactaggcggcggtagcgaaagcaaccacggccatcggtgaaggcagatcccagcgaggtgtcctggatgacagccaacatgaataggcagccgtgccgaatatatagatgaacatactatacatggcttgatgtattgcattgttcctcaaaaaattgcatggcgtcgggtttggcgcaattgatctggacagaagagatgaaactacccaagagggcaaaatctccgcctgtgtgtgcgcgtcgaggccgtggtaggtgcagatcatcgtggcaaacaaaaattgcaaaggtccagtggccgtgaccagcgctcggagagttatgcatgtgtgattgttgttgaataaggcgactggcggcgacgtccacggtgctgatgaagtggaggccccctggtcgaaattgttgatgacatgacagctcctggttgattgaccaaattgccatgcacgctcgtttgcacatgtatcagattcagatggaaacatacacttgcatgattggtcgtggagactcatgatagccattgtcttcgagtattgctgatcagggaaataactcggcgacgactgctctgatcggttggctccaagtgcaggctgattccgatttggattggtaattgagtatcgctaggaaatttgacatcgtctataaaaaacgctggcagttgagaattgatccgttgcatggtatcgccaagcagattgaaccagatgatgaacacaacatgtcaactttcttcaataaaaccagtaaacatgacggcgatcaaacgagatgaaagaggtcttgagccttcccgactgatttgcatctgaattgaagaagcggaaaattccaaactggtggacgaagaaatcgaaactcccaaagtgagaggcttggggtgaatatgaatccggcgacgtcggagattggttccaccgcacttcttgataggaaactcgacgcacccctacctggcgcgctaactatcgaaacatgatttcggcaataataaaagggggtagcgcacgagacctaaaagtggatggatgcgaagacagggatttagacaggttcaggccctctcgatgagaggtaataccctaatcctgtttggggatttgaatccgccgggtgtattatagatctgacgatctagttatgtcatgccccctagaaggcctcctacccaccttatataggatggtgggaaggattacaagatagaaaccttaaccaatacggtattggtttcctaaatctattttacaatattaccaaaccaggactttagaccgttccgtaatatacaaggaaacgtaatacccaagtcatgatccgttacatatttcatagatataagttaccccctacaccggtcggataaccatgccgtgtgggtatggggtacccataatctccactgagtaagttaactgttgtattttactagttttaaactaggtattattttaccaggtttatttcatttactgaaaactctagttagctcaactgttccacacatgcattggctgggctacgtgcaagtcatcgtgtgtctgtcgatcacatccatcttcagctagcacgcctttgagcgtcgctgctctttgccaacaaggtgctattccacttgtgccatgtctgtcgtcctacctttgtctcaaatctagtctacttcagatcaaatcactgcaaattcgtttagccatagattttagatatgtttatttctatcggggacaaattgtagaatcatcaagtaggaaagctttgcaaattaatggaatcaacattgatgcaagaatcttcgatgaaaaatgagacgaatagagcaattgcttttgcatattactatctcccaaatttccaggttccaaacaattctcaggtgttgccaacatctgacactaaaagggcaagtaaagaaaagatgaagtctagtttccctgtgcccaccattacacaagacatgttagatcatcatcatccttcgcacaatgtcttctatccagcatatctctggtattaaacctgtcacttaatagagatttgcaagttcacgtgtatgttggtttttaaactccttaacacaacacactcctctctcctcattgagctctatgtcaagcttagctttgcaaccacaacgagtgagggcctgcggatctcttttctggtttgtcttttcaaagtgtttcaaatccatatagccttaagttgagcatacaaactgactccatatgaccatacaatccttccacttcacctagtttttaaaggtcttgctctacttaatccgatctacttctggtctataacgatggatattaagggttgagagaacaatgtatcttacctagcatttctgcgtgcacacctgcttttgggctcacaataaaacccttacccttagcatactcaatatagaattagtagtctttgtcctcgcttataaaaaccacattacccatcatttttgaaagttcaagtgccattaatttggttttggtgattaatgataaatccaattatgtgaaactaatatttttataagcatttctttgcctagtctcatgtggacatgaaagtggagtgtgtgagaggtgattaccggacttcttatgagttgagatagaaacattcattgatgatagacctaaatcacaaggatgaaatgcatggagatcaagctatatgtatcactgtttctctccatgtacatattgatatgttcatatataatatttccatgtgaataacaatatacatgtgagactaatgttttgtttgagtcttttctcttgtttatctctttacattgagaacctaaagatgatgaaggtatacatttattttaatgtttatatttgataaatgccatctatccttgtatagggtaagctcctaatgtttcattcttttatgcatactcttgcttcacacaaacattttttttcatacagttagggggagcaaatcctatactttagttatgcatgtaattgatccaagttattcactttcatttaattgggatctttacatttgagtgtatgtttgagtatatggcacttgtggtattgattaatactcatcatttattcatattcttttatacatgcgatcggttggtcaacttgtggaggttgacaactggatcattgggactaataattttattgggttgaatgaaagaaataggtcccaaggattgcaaaggtgttgatgctcaagtgatataattacacctaacgataccaagaatgacaaagtgaagatattgaagatgtgggatacgaagtggctactatggcaagacggtgaagggcaagcgaagctcggtcacgatggaccatgcggcggtgaagggcaatcaaggtgcttggcgccgaagaaccaaatccggtggtgaaggacgagtgacagctttgtcatgatagaccgtgtgaggccatttgaagctacaagtaaccgcatcaatcatttgaagaatatatggtgaaacggtttttcggcattgatgtccctttagacaatgaaagaaagatggaaagaaggcattcctattggtataattctcttcctatttacatttgagtttaggaacgccgtactattaggagggatgcaacgtcgagatgtttgtgtatcatagtgctaccttgagagaaacccaagctttaacttatcctttgagtggttttagaccttatttttggttgagttggtagtcctctgagtgagctttccatagagttcaacatcatcaaaaaaaagggactcccgagcgaaaagttatagtcgttttactctgtgctttttggaaattccgaaaaattatcggaaaactccgaaaatttttggaaattctaaaaatggctgcgaaactgagattcgcttctgtaaattttcagacttatccgaaaattcatttcggaatttccaaaaatcgcagtcttggcctccaacggctagtttttgagaggctcgagtatataaactcctccagccctcctttgaggggctgctgttcttgggcaacattagacgcatccaaagccaaataggcatcctcatttccctacctttgtgatgcctctttgtgagagggatttgagaaggggagagagttgtattgagagattgagaagttgagagctagtgagcttcattccatcctttgtagtgcctctttgtgagtgggatttgagaagggaagagagttggattgagagagtgaggagttgagagctagtgagattcactctatactttgagcactcgagttcatagcaagcaaatcttcgatggtgtttgttactcttggggactaagatctcctagacggctaggcgtcgccggtgagcatccaaggttgtcgtgtgccacggaaagtttgtgaaggcttcgatttcgcctccgcaagggaagaaatcaacagtgaaaccaatgagtgcatttgtgcaacctcgtgaggaaagcgttgaaatagacccggccttgtggcccctcaacggagacgtaggatccatggatccaaacttcgggaaacaaatcaacatgtcttctctcttggtttgctcgttcttgtcatctcccatattgtgcttgagcttgtttttactcgatctacttgcatgcttaattaatatagttagtgaccttatatattgcatagataccttatttgtcaccttttgattcatatacattttgtttgttcgagctacaagttcatagctaatgttttattccgttatccaccgaacttttcggttgagatcggaacttccaatcccatacccgaagtttcgatttgaaccgaaagctctcatcattctaatatgctatgaagttgtgataatttttaggaacgcctattcacccccctataggtggcatcaaggtactttcgattttatactcctcccaaacctttaggccaatgtaactagaattcatgttgtcggactacacccaaagatattacaaagtaaatcagaaataacacaaaaaaaaggccatgtttgaactaaacaaaaccattagttctcactagcactaatgtcactaacagtctaacactaatgctataaactcacatgtttacgtaataactttctcggtaggctctaggcatggagcagtttgtacaactggttgtccaaactattgcacttccgctaattgaaatttgagactgtaaaagtggaaccattctccttacatctcctcctcccaccgtagtcagagcgtccttactccttacactcctcgcatgcataactaccgaacccattgctttaacctcaatcacccttctagcccatccctaattttatgtatgtatgacccgttacaacatataggcctgtttctagtctaaaaaaatacaacaattgtttctaccccaagctattaggttaaaacgtaccaaatcaccatatagttttacccacaccacaaggcagggtggagctagaataaaatggagaggggtaccactcgcttgctttactttgtttttgatcaagtataagctgatatgggtgcttgagtttgaattgaggggtgcacatatggtgaaactaaactaattatagctaaaaaaaattcttaaccgagttcttgggagccccctctggtaatttaggtctgcccttataggcacaagcatttgtcagtattggctctactaccaatttaccagaggcatttgctcgtaggcggaaggctcgtctgcctgggaaaacggttttggcccgcttgcaactacttttttttttctagtttgattgttacactcccagtttctaattcgtcacattttggggagagtgagaaaattaactaactaagaataatcatgacactcaaatagatagagaaacaattgaaggctcgatattgattctagtagtaagagtgatttacatttacgtacttttgtataacagaacatgacctggacatgctaaatttctattagtccattatcaaactttccatacaagcataagtgatctatgattaacaaaatgatatgcgcatctatactaccactactacttttcacatgtagagccggtggaatataaaggcacaattttaacatgaacttcagggacagtggagaacaatcagttacagagccagccaggagccaccccctaggactcatttccattactttgtcataatttcctacaaattcatacagattttagaaatttatatggagtctagaacttttaaagacctatggcttgagccctagctgccctagatctagatccatccttgagcacatctctccatgttagaatagaacacagccggcgagacatggcctttggcatgccagaggaaagtgctagcagctgcaccccgcgtaaagtcagtggcaatgcaatagagcatcatcgaagcagggatcaacaacggcgatgacctgcggtgatgatgacggggacaaacggtgtcaaggggaccaggaccatccccgaaaattccgtggccccatgcaaaactttaaacttaagttggcttgtaagttaacaataaaacactaaatcagctgatccgtacatacaaaaaaaatgaaaaggaaaagcggaatataagggttggacttggagtatataccagaatactgaagctttgtcgctgcaactgccaatcacccacctgcctctatggccgctacagcagcaacttgcttttgattgtatatgcgtcgccagcagcctataggctccaagaaaactaagagcagtgacaggctgacagcaaccacgagcgctcagtgttgctgctgtcattgcattcctcccgtgttgcaatactaatggagcaatgcgaagtgaccctaggggaagcaactagtgagctaggtaggagaacccacggattaggaaacaaggagaactggagagagattaggccaattgtgaataaaaaaactcaactgaacttgaaaaaaaaaagaaacgaaaaccaatatggcattatatatgtagggtacttaatatatgatttagggccctgtagagtcacacaacctgcacgggactagggacggctagggacagctctcgcaaggacaacgaggatgaacggtactagagactgctggaagaaacaatgtgggcgatgatggttcgtgcaagtcttgcatacggagtcgatgccgccctccagttccttcacattagacgtctttcgggactagtattggggatgaactaaggaggcgacagggaacaacactgaagcatggggactaaagtcatcctccgcgcgtccacctaagtgggtgtcgccgcttgaaatcggacacttgcggagctctagcgcacaaagattacagtaatacggtcaatatatccaatgattcagacagtaacaattggaggaggcgatgttgaaagaatggcagcagcatgtagtggtgaaaaccgtttgcaggccatcagagtagagcgccggtgataggagggattttgcgacggcgaaagcgggatgtggtggaaggaggcgcccttcgaccaagggacctaagtaatggaaggggaaaatccaaatgtgaaaattatcccggatcacatagctagtaaagtagtaatatgtcttataaaccaacaactcatattgtttttatggttgtacaatagagaacacggtaaaagcatcggcacattttacaaaggcttccgcatgtgctcctcggtgataatagcataacacatctgaagcaggggtagaaccgtggctttagcagcttgggcccgagccctactcgtggaagaaattatcatattttcagactttctcaacatcgcttggcccaaccctactcctctagcccagccccacgcacatcctttcccaacctcaagtggccaggttcctagcctaatagacggatcacagcccaatagacaacccaagtgaccaaccctaattcagtgtcctcactcctcacttcccaatagacaaccctaaactataatctccaccagtctaccgtcctcactcctcacgctgcactcatgactccaacgttgcatcatgcatcggtgcatgttcactgctcctctcatctcgcaacatcggctggggcgcgcatcgatagcggcaacaacttggatctgcattctcgttttgatcccccaaatccaggttagtctagtctctaatctttgatgtacattctcattttgtatttggttgtagacaagcagttagtgagaaatttggtttgatttcctagataaagaggagcagaacaaatataggggtgaatgggagctttcggaagttatgttttaaaaagcacaattggttgctaaggatgcaattttctgttttaattgcttcctttctaagcaaaacatgagatgtttttgttgtttgaagagcgagataattttgctagtgtcgaagatattacagaacattatcataatcgtgctttgagaaatgaagatcatcgaggtatgtcatatattccttgtaaatagttaagttctcataatttgcagtaatatcatttttcagattcaagttcagcctctctccatactgtagtgctgttgatggagagtgaagatcatgggggtattccaatgaaatgttaattcagttctttttaatttttactgtacttccgttccgtgtatgaattgtcatggtaattttagccctcatttttgctttttttttgacatttttactgtacttggtctatgtgtggtcatgggcaattttaatcttcaatttgagctctaggctagaagaaatcctaacgccaccactaatctgaagcacgaaacaaatcaattaaagaagccataaatgataaatgaataatccttcatgcataaaaatatttagttatccataaagagacgacagacgtatgcaacgttcatattaattgtcactctacagtgtcaccgagttgtcggtccaagcaattttacccatacatgaaaaccatctgagaaagggcatgagagtagtactgcgtcaatacacatgcagttgcacacagtagctgagagagcgagccggaaacatctggtcgccggtccacgatcggtctacgcatgggcttccccccgaccaggtggtgcgtgcgagcctaccacatgtccacatgcatgcacggtgatcgacatcccgatcgacgtgtcgacagtgcagccaccccgccgctcgctcgctcgcgctcgcgcagtcgcgctagcacggacatacggagtagtatatgcgtatgcataggcacgcgcgcgcacgcgcatgcagcgaaccagagcgcgccgcgcacgggcggaggcatagcttgcgcacgtacgtgtcgcgctccggcggcctcgccacgacgcgtgtcgcggaggcgcgcgcgcgcaccgagccgtccgcgtcgccgcgcgacacgtacgttgccggcgccctgatcccgccgcggagcaccgccccgtccgtcgccgcctataagaaggacagcgcggccgcgtcgtccatccccatcagctcaagccgcagaagacatacacacacaaacacaagccacccttccgatttgttcatcgatcagttcgcagcgtacgtcaggctagctaactagtgtttggcaatggcgtccgggcagcagcagcagggcaggtcggagctggaccgcatggccagggagggccagaccgtcgtccccggcggcaccggcggcaagagcctcgaggcccaggagaacctcgccgagggtatgcaaaataatactgaaacttttgatagatcaaacttgccatttcattcggtatttcggttgaagtacgtaactaatatgcgtacgtgtgcatcgatcgatcagggcgcagccgcggggggcagacgaggaaggagcagatgggggaggaagggtaccgcgagatggggcgcaagggcggcctcagcaccggcgacgagtccggcggcgagcgcgccgcccgcgagggcatcgacatcgacgagtccaagtacaagaccaagtcctagactacacacacttttgcatccgtgaatgccagtgtgtcgtagtcgtctcagttgtagtcatcgagtcagtcttagctagctagctctcttatcaataataatgtaggtcttgacggatgcacgcatttaggcgcccgtatgatttgctatgttatgtttcatatggtgatgcgtgcttagctttagctagctttggtagtttggtttaggtgctgatcgatcatggtcagtagctagggtatgtgttttagtttattgcaggatcggtcaggcaggggctgaatgctagctaggtgatgctttggcttttcatggccagcagctgctagcttcttgtttccaactgatgcctctgctgggtgtgtcctttgtaaccgtgcttgctttcagttaatctagctagctgttgttcatccg

SEQ ID NO: 25545 - DNA, 7865 bp, Oryza sativa
  unsure (1)..(7865): unsure at all n locations
gggctgaatgctagctaggtgatgctttggcttttcatggccagcagctgctagcttcttgtttccaactgatgcctctgctgggtgtgtcctttgtaaccgtgcttgctttcagttaatctagctagctgttgttcatccgaaagtgccagtgtctatgtctgatctatcgcggctaattgttgctgttgctagttgatctttgattcctcagagatgccatgtgcaggatggaattattagcgcaaaacacaggagaagggacaacaattttaagttgcctaatttttttcttaaaacacctgctggggcgtgcacacaaaaaaaaaatcaagtacctcgtctaaactgaatgctcaagtttgaaagtgaaaacaggacgtgccgtgccaagaacttcgagatatctccgagttctcttaagcttaatggaagataaacctgcctctttggctcaactcctgttcccggacgctgttagtaagtaagtagtaactggcgatcgatgaattggatgaagccaacagccgcgcagacacaagttagaagaacgccaccaccatatggttttcttagccaggctgaatggttgatcagaaactcagattacatgcaaaaagagaacctctggggctctccagttcacagagagcaaaacgagtgcaaaatgaacggacgagcagccatggaggaaacattaaaaatatttgaggactgaattctgaagacgagcaactgactaaattttttagcgtggtttgatttgtatttttttgtatcactgcgagatgcacagcaaacggagtaaacatttgtgtacattttcccctccggacacctatttaaatacgtactctgaattcaacaaccaaattaaatgcagcgcacaatgcatcaatattacttcaccttggtcagctttatgttcttcgcacctaaggtcacaaattgtttatgctctattacgaaattattacctgcctgtgctggattccataatttcataatcaaagacacaatttgatcgaagcagtgctcaagttttgcagcccactagcactgaaccccccacaggtgttactgacattattcatctacagtctgtctacacaccctacaacatcggcggcaaagtagcaaaacgaccccctgtaccatctcccgtctgcagctagcattgcatcgcagaacctttagaagatgtttgatctggatcagttcagggaatcaacaagaaacgattctacattctactacccagcaccgccaaaagagcgctaatacactcgcgaacatagctgctgaacctagctccaccaacagttgcagagaaccatcaatctgcatcttccacccaaaacttcgctgtcacagaatcacagtccagggcgattgctgctttcatcagtggctggttgcaagggcggtcaccagaaggcccaagacgaagaacggttgcgcgcttgcctgcatttggcaaatgtaagattgcactgatcagatgactgtgcgttggttgtctccagtttctactgcttggcagtttcagaatggggaaggaagagatgaatgaattgaagaagctaacagaagcgcacctggtatttgacgtcatacttcacagggtccttgaggaagtattggaactgctccaaggaaaatgaggaggattagaagctactccctccatttcatattacaaccatactttgactttttcctaagttatgaattttttctaagttaatttttttaatgtttgactaagtatataggaaaatatacaaatatctataacactaaattagtttcactaaatctaatattaaataaattttgataatacgtttattttgtgttgaaatattgctatatttttctataagcttaggaaaagttagagcgccttataatatgaaatagagtgagtagaaagcagagagcgactgaatttcctggcagccagagtttagtttgcagtgttgtttgttttttaagtcataaggactgtaagaagaaatgtttttgccatacatagtttggtggcactaattccatactattgtgatattgtctgaactgcagatggctaacctaaaaggttcactcactagcattacagggagaaatgttaatattcacagcagtttgaaatgttttgtactgagtgggatcagaccagagaaataaaggaaaccatttgggagaactaattggaacgaccagctcacctgaaagaccacctgaggaattgtgagtcctagcagtgccagggcataataaggcttgccggaactgaaaaggtagcctgaaaaatggaattcattttgtcagaataatgcaatattttatggtgcttcgaaagtactagggtcgccactcgaaaacatagcaatcctcagaataatcagtttgctacggaaattcacaaagatgacatagcaacatttatctgctggacagtttgctgacatgggatgacgggaaacatttctaaagctaattctgaacatttaggaaacatttcttgtttcacagcaactgcccttttatagtttctttaaaactttcgtcattacactggaaatttaaacgacaatatttttaaatagtaaccagatcaaatttccgcatggttgtgcagacctacattgtcttacttaaaactctgcatctagttctataaatacaattataatttgcatccatctatagcaatcaatctttattgttacagtatagagtatagacccaccatgatcgaaccgtgcaaatatttctctttttctctgaataacatggtaatttttaggcctctgagcaaacatggtagctcctttaatgtttagccctccccttataataaaataaattcataacattatggcatgctaaatagcagcatgacaagttgacaacatggaccacataatcaatgaaaccaagatacagccttgaagataatgtttgaaacaaaagcaacataatgaaaatgcatgtctttacctgcaacggataattgagttatgtcaatcgctcctacacatatccactttgcagtttccataccaaaagcaaccgggagtgactgaaaaaaggtaagtgatatggatgattgcttttctttggaactacagaaaagggctgtgataactctacactacagacagaagaagaacctgaagccccagagctctatctccctcaacactcttaaagtcatttacaatagcaatccctagctagaaaatcacgaaagacggtcaatgatcatgaaaagcatacactgttacaagaaaagtaatcgtatgaagatataccccagctatgctatacaaagaagtcaggacaacaatatcaggagtaagggttccaaataatgcctggccagcccacctgcgaagaatacatacagataggatatacatctaatttcttgcatataatatcatagatttttactcaatatggaagaagatccgcactgttaatttaccagggcaagccaatgtagctcgcaccaagagcaaagtttccaatccatccattctgcttgagctgaaatgtgcaagggtgtttttttttcaattttttcaatcaaaagctgttgactaattatgatgtactgtactaaaaacaagggggattgtgtgattcagaacagatgtatcaaataccttcagaggtggagctgaatatatgtaagaaagcaaggacccaccaacagcaagataaaaaataataggaaaatcatgtcctgcctgcaaaatgtagcaaaaaaaattaagaaaacaaagaagagcgttttctttttcaacctgctaatattcaagatcagttagctggagacttacccatacatctaacagagcacccaggccaagccctgctaacaacagtgcccaaatttgagtaatgacctggatgaaatcgttgccgtcagtaaatacatgagatacattttgcatgacacaatgattgttgagacagttgcacctggcaacatcattagggattgcatcgaaacttcgcaatctctagtgtatatatataaaaaaaactagtagtcgtggtggcagtaagtctgccatcccaccaccacttctttaatcgatgaggtattgtgtagatagttgatcaataaatatatatggcttgtaataagattattagtttattacatgatatatatatatataaccttttcaattttacgacttatggtatattggtataccccctctatttttctgtatgatgttggttagtcttataaagaaaaatggagggagtattttgtcagaaacccattgctaaaggtgcttccccaatgttaaagtgatagctgatggcacataaatcagcagagtagtcatttgtcattagctgatgaaactaaacaaaactgtgaataaatatgagcacagaaaagaaaggaaaaagctccattggcatacctcattttctgatatagcgcctgaaggaataggacggtaaggttcatttatcgcatctatatctcgatcataccagtcgttaattgtctacagtcaggaacatttgaaagctgacatatttgttagcagcagtgcaaaaagttctccatgcagcataatatgaagttatgaagagagtcgataaaagtataaaacatatccaagtcctaacagcaaacctgtgtgtatcctgtaagacatggaccagacattatcatgcagacaatagattttgcaacatcttcaactgtccagtggaaatttcctgaatacaagaggttagaataaactataagcaaataataaatttatggttgtacaccaggaggaacactgttcataagtacaggtactgtcagcaatgagctaatagtatgccattgccaccctaaagaactcttttggctggacttatctcgcatagagcctagcccacatatattcaatcttttggctgattccactctaatacagcgataatcaggaagtaacttcatcacaaaataagttgcagacctacagatcttgtaaattatgcaaattggcaacacagtaaaattactagggttcagtaaattcatcatttagggacgatgcacacttttaaaccgttgattaggtcttatgaatgcttgcaatgtagtgacaggcacacatgattataaagtaaaaaaagtagtttaccaattctacaggtgctcaaatgattattaggaagtagaagaataaactctccaaacagataaaatcaacgaaaggtaccataggcataccagaggcagctgctccacaaagcactccccatacaagcggaggccatgtcactggcttagtaagttgaaggcgaatcttccatatgtcctatatgcaccatgtgaaagagttaattgattagcaatatagcattagttgtttccatacatgaacatattgattgcaaaaagagaaaaagatgcatatcttatcagcttctagaaatgtgaagtagagtgcttaaaacatggttttgggggaaaagcttgcaaactaaggaatgcttcaaattgaaatcctattttctattttgaatgattatgtatcgacattccaagccttccacaacatgagccattagtactaaacttgtcacaatctggagaatcgtctattgccttaacaaaaactgcgaactactacaaacaagaaagatgcatagagcaaagcgtatcactaatcatcaatctattgaagaacgaacggcatgaatgtccataacttggtcaaggcacctagctagtatacacataactaaaatgacccaaacaacaacaacgcggtaaggtagggcgtgcgccggcgtggcatcataagccgcagctgcatataacatttgtgaaaaatgctccaatgctctcccaaaaaggtagagaaagggccatgtatggcatccaaaaacaggaaattttcgaggaggacgccactgggtagcgcatcggcaatcccgctacagcacacaccaagaacccagtgtaggacatgctcaatgcccatgcatatatgcagcgctctatatgctgctaaaaccccagtgcccagtgctctatatgcattctgcaaccagattagaacgtagcgcaagggagcgggatgggagactcacgttctcttgcttggcgcccttgatgccgagcagctggttgaagctggagcctcccgcgggagctttctcgggcgcattggccttcgctgcgcagccaacccaaaccgcacattaggaaaacccgaaaacgccatagaaatcaatcgaacaaacagggagacgcccgagcttactctctttgtcggtctcggccgcgcggaccacctggaagtggcgcctgcctgcgaatggaggagctcagacgcatcagccacacacagcggggctagctgcaagaacaagaagctagagagagagagagggaactgagggggaggcagtacggttaagncgaaganaagagggcggcggggagcgaaggctgagaaggggagggcgnaaggtgncgnagnagncgncggtgnagaaggcgncggcgagnaggtggnaggtggccattggagactgggggtgggtggggaagacgcacaccaccgaggcgagaggagggaaggataacgcgatgtttttgaccctttttcggcctcgtcctcatgcgtgtgttcatgccttgtgcctgttctcctactacagtactacacaagcactccggtcatccgaccaaccgtgatggcgtgatcgcttgaccggagtactccctcggtccctccctccctaaatcattttcatgcaatgtgacatattaaaataaatctgaatagacatcctatcaaaaatctcttatatttagagacggagggagcacataactatacgtgtttcctatgtctctttcaatcttaaagaaaattcctaatgtttgtgaccaacattgtaagagataaaattaaataattgatatttgtgattggatgaataagtagctgaagaaaataaaatcaacgatggttgtgattggttgagatgagcttagatgaagaaattattatattcttcgaattggaggattccaacaagatttttagaggatactgtgtatgagagctttttttaaaaaaaaattcctttcttgctgttcggatgtggaaacagatcgtagaaaatccaaaggaaaatttcatttaatgctaatttcacatgaaaagtacgagaaaaatccaaccacctcaagctcttttttttaattcatatcctataatccgaatgctctcagcttttatattcctttgtttttcattcttatgttttacaattggatttcttttctatttctatcgtagtaatatgttttgtctatcttgtaatccgaataagctctagatataactatattttttgggtagggaaggaaatattatttttggagactaactagcttgcattccacagatttcagagtcgatattacacagaattttcaacccttagatcaagatccgacgcacatcaataacagctacagtaactacttgatgggcttcaacctaactggaccaaccaacggtgctcgcacgggctaaaaaaaattataaacagactcatagtcaaactttttttatcacaacttattacaatataactgtaatataattacactgaaactaccatagtacagtgtatctacaccataattacaaccatagtacatagtacagtgtatctacaccataattacattggagttactctgtaattattgtgtaattttggctatgcaactaaattaaattattcacttgttccactggtgaagtgcaagttctagcaattggaattcatatgctcatccc

SEQ ID NO: 25546 - DNA, 1813 bp, Oryza sativa
  unsure (1)..(1813): unsure at all n locations
tttttgggtagggaaggaaacattatttttggagactaactagcttgcattccacagatttcagagtcgatattacacagaattttcaacccttagatcaagatccgacgcacatcaataacagctacagtaactacttgatgggcttcaacctaactggaccaaccaacggtgctcgcacgggctaaaaaaaattataaacagactcatagtcaaactttttttatcacaacttattacaatataactgtaatataattacactgaaactaccatagtacagtgtatctacaccataattacaaccatagtacatagtacagtgtatctacaccataattacattggagttactctgtaattattgtgtaattttggctatgcaactaaattaaattattcacttgttccactggtgaagtgcaagttctagcaattggaattcatatgctcatcccacaaaggcatttgctagaagattttgtcagcctacattaacactagtcggttactatggtcaacagacaagaaaacttatgttttgatgtggtaggtcaaagaaaaaaaaccgtgtgatttgaagtaagaaatccgtcgatatatttatagtaaaaccgttaattttttttttgcacctgctgactttatttttaaaatactacgacaaccagtatcagacaatcatttgggatagaataaattatataaaggtcctagatttttcaaggcaggacaaaagaaaatctaaaaaacacaatcaagaccttcttgatttgtcttacgcaattgcttcatctatgttgatgacaaaggtggcaagagcaaccatggcaagccgcaacagaacaagcatcggcacgtttccagacagggccttacatggccttgaccggtagagaatcatttagcattgaaaaaaaaaacaccgtcgaagatacaatgagcaggcaaccttgcaaccgatctggttgctagaacgatcccaccaggagcaaagagaagcaaacaagcaacaacagaagaggcctagaagcttaccctgatcggcctaggaactaaaatccaaagagtggaggtaaatgctccttcaaccattcttttctagcccagcagtaaacttatttttattgggcctgttcagctaccattattacggcaacgctgtagctgagacgttttatattgtacggctgcagctagctgcagaaaatgccaatcgaataggcccatcaagaccattgatatcaatccttgatgagcaattttttattgacttgatttgctataaggtattgtagtgttacagtatcataggacacgcaatccgttattcccaacatacttgtatcacgtcttttatgattaaaccattggcacatacagtttagggtatgttaggctcggctgaacaaattcaggttattttgccacggaaaaatatgagtaagtattaactattataacttagatagatttattaattattttaaaagaatatcttcccgatctgtcctcttcttttccccacacgggcacacggcgatggcggcaatgagctcgagcaagggccgaggggacacaagtagacggttttggtgggccaagatctaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25547 - DNA, 615 bp, Oryza sativa
  unsure (1)..(615): unsure at all n locations
gatttaaaccaaccccaaggcccaaccaagaaaacccgagacccgacaaaattgggattcagagtcatcagccgatctgatcattgccattgggccaatcagatcgncggtgtgtggccggtcagaccggccttccataggaaacctgatcttctcccaaatttggcaatgtttttctatttcgtgtctagatgtcaaatttaggcgttaacacatacccctgcctttttggcgaacttgtgagccgaaaagcataggacatgtggtcttagggcaataatttttatcggccatatgaggttctaagtgtttagtaaatcaatctctttgtaatatcctaacaaatcaataatttcttacgaacgattcacacaacttggtatagatatttccaactagataattactcaccgagcaccttgcacttagacccaacaaatggcgacttcaagatgtgaggtcgtacctatcatcgttcgtgtctcctaatttccttagaagcatattaacattttgcccccgagcaaaatcggctttgttgaatgcacgatttcgaaggtaagataaacattgtgttaacccctatagaatcatgtggaagagattcatctctaa

SEQ ID NO: 25548 - DNA, 311 bp, Oryza sativa
tggcacatgcagttctcgctgttacagccgcacgcatgcctatgcatgggatgatgtggggggggaggatttgctggcccttttcatgacgagcgtgtcgctggcgtgagacgtgtcatgggagatggaactgcggagcgcggctatctgttacgtcttccttctgttaaaagggtttggcaccttgcgttgggtgtgtgatgtcgcaatgtatgtgattggtgtggggaccaatagcaaaaaaaagtgagtttataattatagatagcttggttttaattttacatttttatattatatatcttttattg

SEQ ID NO: 25549 - DNA, 552 bp, Oryza sativa
atacctcttaatgaacggtagggcaccgtgaagcgtgcatgaagtcctagtatgatatattacaagtatgaagtagtatagggcatcatggagaggtaaacaaaagcactctatcacacgacatcccccactctgcttgctgaaatatatatatatattgaattagacaggaatgaaaaacatagagaacataactcacgaagtttcattaaaattcacaagtgaaccatcagatggtattgttcctatcaggaaattcatgcaaacattgctgcacaggtgaaatttcttatttaatttgcagcacaaagttagcataacaattcaatggatttatcaagataaaaaaacactcacaatgaagtaagcttcgtcagcttatcacaataaaaaagcactcacggtgaagtgcatctttgcagtgccaagggcccgagaagacactccgtcggcagcagtgatggcgatggaggcgggtaggtggcaatggtgttgtgtggcttcgtcgtctcgtcacggcgatgtggcaatgacggccacgcccatcccgct

SEQ ID NO: 25550 - DNA, 619 bp, Oryza sativa
  unsure (1)..(619): unsure at all n locations
nnnnnnnnnnnnnnnnnnnnnnnnnnnnnnnnnnnnnnnnnnnnnnnnnnnnnnnnaaatgttttgtactgagtgggatcagaccagtatttataaaggaaaccatttgggagaactaattggaacgaccagctcacctgaaagaccacctgaggaattgtgagtcctagcagtgccagggcataataaggcttgccggaactgaaaaggtagcctgaaaaatggaattcattttgtcagaataatgcaatattttatggtgcttcgaaagtactagggtcgccactcgaaaacatagcaatcctcagaataatcagtttgctacggaaattcacaaagatgacatagcaacatttatctgctggacagtttgctgacatgggatgacgggaaacatttctaaagctaattctgaacatttaggaaacatttcttgtttcacagcaactgcccttttatagtttctttaaaactttcgtcattacactggaaatttaaacgacaatatttttaaatagtaaccagatcaaatttccgcatggttgtgcagacctacattgtcttacttaaaactctgcatctagttctataaatacaattataatttgcatccatctat

SEQ ID NO: 25551 - DNA, 617 bp, Oryza sativa
  unsure (1)..(617): unsure at all n locations
nnnnnnnnnnnnnnnnnnnnnnnnnnnnnnnnnnnnnnnnnnnnnnnnnnnnnnntgtccaaggaattggggcgcgaggaggtgcattagttggccaaagacttatgcaagctctgattgatgaagacaaggttgataatattaccaacaacatttacagaagtgaaacatatccatttgatacacatgaaattcatttcgaggaaggaggatggaaatcgcattcacagggttataagttggagtctttaatgaactttgaagctgcagggaaaggttctaatggtttgatgttagattctgattggaaatatcatgatgaactatcacataaaggcaataatgccatggagaaggccaaggtgtggcctgagtttcagtacagtgagatgtgcttcagtgataggatcatcattgagctaagtgaagttggtgtatccattgaacccggggtatgtgttggttcactgttcaactgtatcattctgtacaacaattttttttgttaggctggtatagaatttcgcgttgcttgagttaaactattttttttgcatttctatgcatgggttgttacaagttattattttattttaatcctgtgcttttgggcaata

SEQ ID NO: 25552 - DNA, 653 bp, Oryza sativa
  unsure (1)..(653): unsure at all n locations
ccnnnnnnnnnnnnnnnnnnnnnnnnnnnnnnnnnnnnnnnnnnnnnnnnnnntgaggaaatgcttgaagtgaatttttcagagcatatcaaattaaaattttcaacaaaaataaactgtgccacgaccgcactgaccgttggatatccatcggccgaaagtggggccggttgagcccaccaggggttcggccgaaccgaccaggcaacggtcggatgcctaactttttgaggcaacagctagtgggtcccacatgtcattcttgaccgttgtgggcaccctataaaagccagccggccaagagagggaattccaccccatttcaacacattatcattccctctccaacagtttgctctcaagtttattcatgctttgatagttcctcaaattcaaatctttaattgcatatatacaagttgctttggcgaaactaaccgggtggtgaaactcttgataatactaaccatcgactagttagcctgttcttgttccatcggtcatgatgaggaggcgactgtctcctctggtcaggtatcacgctatccatcaagtcgtcatgacaaatctcgtactcattcatcagctgatgtatcgattgaagacaccgacgctcagagacaactgttgagcgacgctgaccttaacatgac

SEQ ID NO: 25553 - DNA, 695 bp, Oryza sativa
caaaagtagaggtagttagccatagcgcaccgggcgtaaggtaggacgtcctccttgagcggacgcagctataacttgtgagcagcgagcggctgactgaaatctaacaagagtcggtgtgggccaaggctggcaggtatggattcaggttccgatccggctgtaaccaccgatgagattcttcttttttttctccgactccaccatcaccaccaccaattaaaccgaccccacctgatctgactgactgactgacgaattgactgcccctgccgtaacggccgatgcagccgttgacaccacgcgcgtcgcctgcaaacacctgcacgcctagtcgcctcgtacgacgtaacacacgtaggagttgtacgcgaccaaaacgccaaacgccaacggtttggtgccccgtccgtcccaggcaggcaggcagcacagcgagcccaaccgccgcgcgccgcgcgcgtcgtcgcccgcccgtcggctgatcagccgtcgcgtccaccctcccccgcgcagccagctgatgtctcaccggccgcgcgcgccaccgcccgcctgcccgcccacgcacgcacgcacgcacccgtccgtctgccgcgcgcggcgcgtcgtcgtataccggttgctgctgctgccgcacacgattattcccggtaaaaacccgatcgaaaaatgtgaaacccggcccctttttt

SEQ ID NO: 25554 - DNA, 862 bp, Oryza sativa
caccacatcaaacatctctcgttacaaagtgaggaccgcggagcatacttgagccatgggttcctcgtcaatatttgtcagggccggcccacacacccgcatcgcctgcgaagggagagagagagagaagggggacggaggagagaagagagatggaggaaacggaacttgtttcggcggttgtcgccgaagggggagggaaagctggcggaggggttggggaagccccactcggcttgctcactgccgtcgaggaccatgcaaccgtcgcaagcatcctcgaccgtcaactgcctccgtcgccacggacgccccccacaagatgctgtcgagctcgacgccgagctccctatcggtagcgaccttggccatccccgataactaatctcaccggccctcgcctcctatagctagatccatccatggccgccgagcttgaggccagttccgggcatgaatggtttcctcgtgttgggctcaaacggtgtggtgaggcgccggacggctgccaccgtgagctttttgttgtttctgggatgggataggtgctggcagcggtggatctcgtgacaggagtagagaaaccaatggcggcgaagttcgccgctaaggtagggggcctgcgaaaatgtcgaagactacgaagttcagcaccgccagttagttgaggacttgaagagggattggtgaagaaatgggagaaggggagggagccgccggttggggacgagatgggtgtggggagggagaggatggggcgggggagtcaccgccgtgcaccaccggagacgatggcgccgagcttgtcgccgcgggagatgcgagagacggcgggagacggcggtgcaggagtgggaagaag

SEQ ID NO: 25555 - DNA, 447 bp, Oryza sativa
ttaactttcacatgctttgcaatttcctcaaacttttctactcttttaggggtggctgtccaaaaggcaacactttcacgaacctttgcaattgaatcttttatcacatctaaaccatccctcacaatcaagttaagaatatgggcagcacaacgcatatgcaaaagtttcccctctagcataagcttacgcttgccgatctttttgatgagttcagaaatcaccttatcatttgtggtgcagttatcaagagtcaaagttgatatcttctcatcaagattccattcaaccaacgcttcataaagatgttcacaaataacttcagctgtgtgtggagcgggcacatatatgaatctacaaatggaatattgcagcaagattaaaatgttgaatttaagatggtgacaagaggataatcatttgtgaatcatgtacctcatgataatg

SEQ ID NO: 25556 - DNA, 4006 bp, Oryza sativa
aaatataagctaatagtatcctcccgattggcctgttaaaacagaaggctttctttccagttctttctgattctcataacttggtgaatattccatagtgaattcactgcattctgacaagatgaactgttctttgcagaaaaacaatcctgccatttgctttgctgatgtagacaaaacaaaagaagtcgacccagcagaatcccaggaaaagatagcttctttacaactcacattcgacatagtctgcgatatttctcggtctaccaagaattcacttattacaaaacaggaactttttcacaatattcttgctaacaacttggagatagaagagacaggtatagcatggatctaacaattccaaccattttgtacttattgtctcatgctatactgaatgatttccctccttttatggactatcacttgacaggggagatagaagaacagctgcatattttggaggacctgtctcctgattggatatctaagaaggtgatacctggtggagatattctttacaggttagttttacatgacttgtatagggcatctgctaatatgtgttttgtgttcatttctaaataccatagtatctacaatcactatacaattctttttagtggacatgtaatttagagatattttacgggtgtcattaagtataaacgcctttgtttcccatgttgcagcattaaagaaatagcagatcagaaatcagttcgtgcaagactcgtagaagtcatatgagatactactgatgctttcaaggccgaagaatcaacaatgtgatgtgactactgatgttgtaggacttgatcagctggattgctgaaatcccaacttaccatcatgaaatcctctggattgctccttaatttcttcgtctacttccaaacattagcagaaacaaacgcagattactcaacatgttcttttactggcactcgacatttgagtaatcctctggatctctttagtgctgacatgctttggaattcacaccaccatataataggattgaaccatgctatctgtgagactctgaacagccttgttagattgcacgagagcacaagtgctgtggttgttcccacgagaatgcgatgttgcaaattcgatcggtttgtgtatgaatacgatgtaatgtaggtatgtagcacatgctcgtatggttctctgagtgtactatgttagtcatgagcgaagtgagggaattccttcagattggatcccttaggagagagagagagaaggtattatgaaatgtaatcagatctttgacgatccagtattagctagcaagtatatggactcagactttgatgattacctagtgtatgtattagcttcaccctttgaacatctcatttactctctctagctctcgattttactaataggaatgccaagtacataggtcgatgaaagttgacatctattttatcttacgccacttactttagcttgatttcgtgggagacacccaattgaatgatctcaagtgggttctattaccatgtgtttctggagctgatttcattcgagtagtttcttttttgtcttcaatccctttcctattcctctccacttggtgatgtgtggtgataatggtgcactagtgatgctggttgtatgatcctagtggtcacttgataatgctactgtaatcccaattgcagtactgtatttcctagaattattatgtaagcattcatctatgcattcatggcatatagacatcattcagcaaaccaagtcaattgacctagaacccttaaaaagattcttctattattataagtgtggtgatctttcaaatcaatatatcggtgtgatggtgtcaactgttaaccccaaataaattttctcaaccgcactgctctcaagtataactgttgcactttctacaaggcacattaacaatgaaatcatatagtcatacaagacaataatcaatttgcagaaagttgcagtcccaaggtcgtgtggatatatacgaatggatatgtacttacgttcctttcatgattctggtagcaaagctggattatataactctttgacgggttcatatttttctggattacaaactttgacgggttcgtttttcgtgatttgctttacacacgctctctgacgagagcaactcctcgcccattcgatatgcgggtatacgcttctgttctgggcgaacttagagcatctccaacagttagccatctcatctcactcttcaagttaaaaaatatcaaacatagcaagaaaatgtgatccaacagcctctctatttagatggctaagccatctcactggccaaatgaccagctcggatggccaaatctagccagtcagtttggctggccaaacacagcatcaacggctagaagctgcaatctctcatctgcctctccccatcgacgccgagttcctcctccggccgcccgcgagccggccgccgcctcccctccagccgtcgtcgccctggccagccgccgcctcctctccagccgccgtcgcccctgccggccgccgcctccccttcgagtgccgtcgacggcaagagagggagggctcgacggcgacgagggagagcaagggaggccgccgaggagcagctccacgcgccagtcgccgtcgcctcactcgcccgccgccgttgccatcctcatcccaagctccgccaccgccccccatgcgatgtcgccttccccatcgcgagctccgccgccccccatgccgatgtcgccttccccatcctgagctccgccgccgcccctcccaagccgatgtcgccgtcgcttgctgctttcccgtgctgcctcccacgccatcagcatttgcggtcgacgggaaggaaggaaaggggaaaagaagaaaagaaaagagaaggaagaggaaggagagagagagagaggggaagaagaggagtagagactgtgatgtgtgtctatttgttattttagagaggattaatagagagtctgttggagtgagtatctagtttaactaggcaaattagatgaagagttggctatatgggtgtttagagactccgatttgaagaagctgttggaaatgctcttataattcatcttgttcatcagactacttccacaatagagtagataatttacgataaatatagtctattaagatgtattaaaaattttagtggaaaatttattattaatttagaaacaccaatagatatgaaatttcatacgtaagacgatttgaattttttaaagtaaaacttacagttttatagaaaagagatagcaatatttttaatgtttgatttaatgaaaactaacttagtattattgatgttggtaaatttttttataaatttaatcaaagttaaacaaaatttaattagagaaagaaaccaagcatcttagggtctgtttagatccatttaaaatagcaaatgacaaatggcaaaaattttggtatagcaaaagtattagttggtgtttagatgcatcctaaacttttgccattctagcactaaagtgagagagagaaagagagagggagtggtccaaagcactttttggcacaatttgctactatagactagcaaatgccaaatgacaaattgccaagttttactactagtgtttagatctaaaatagcaaaaagtgcttcaaaatggcaaaactggaggatctaaacagggccttatatcattaagcagagggggactagtaaaaatgttgtaatttttttaacctctgaacaacgttaaagaaaacggaaaatcagttgttttacggtttggaggattaggctgcttgctcggttgggaaccattcccttcgcatgaaaaatggagcggtatattaacacgtgattaattaagtattagctatttttcttttaaaaatagatcaatatgattttttaagcaacttttgtataggaactttttgtaaaaaaaaaagcaccgtttagcagtttgaaaaacgtacgcgtgaaaaagatgaatatgagttg

SEQ ID NO: 25557 - DNA, 622 bp, Oryza sativa
tcctgcacgggaaggttctacgacgacggccagctggtggtggcgctgtccacggggtggttcgacgggaggagccggtgcgagaaggacgtcgtcatccgggcgagcggcggcgcgtccgtgacggccatggtcgtcgacgagtgcgactcccagcgcggctgcgacagcgaccacaacttcgagccgccgtgccggaacaacatcgtcgacgggtcgccggcggtgtgggacgcgctggggctcaacaaggacgacggcgaggcccagatcacctggtccgatgcttgacgacgacgacgacacacgtagtgacgtagacgccatgtaacacggccgtataatttcccattaataagcttatatatattccctaacagtgatgtatcgtaatttttcttttgtaaaattaaacacctcttgatatatcaagtaataaagagggaatactaaattatactaagagaattgatacctcttggtacatctcagatactataaaaatttttcttaaattttatcattctttggtgacagatgaagctctaaaagaaaatgaaggatggagatgttgtaaccgaacacaacacataccacaccatatttatatatttatattgta

SEQ ID NO: 25558 - DNA, 1246 bp, Oryza sativa
  unsure (1)..(1246): unsure at all n locations
atgatatacccatctagaagatacttgttttttgaagtattatacctgtatccagagactgaaactacagaagataatttagatttgaagctgatacttcatgaatcaattgcaggttaaaggaacagattatcctacaactgatggaacctgcataagagactacattgatgtcacagatcttgttgatgctcatgtgaaagcactcaacaaggcagagccaagtaaagttggcatttacaatgttggcactggaagaggtttgacaatatgagctttctttatttactttgattaaatgcagttcgctcatgctaggacagaatcagattttaattaaatgctgcatttgttggttattttacatcaaatttttacgctggaatacacacagatggttattctggtagaataattttttattgtatgcttatgaaaaattgacttctcttgtcaaattatctccattctgcatttttactcatgcatttcttgtgctgtcaatagtatattctaatatatgtatgattgctttcaggtcgttcagtcaaggagtttgtggatgcctgcaaaaaggcaactggagtcaacattaaaattgagtacctcagcaggaggccaggggactatgctgaagtatacagtgacccaacaaagatcaacacggagctcaactggactgctcaatataccgacctcaaggagagcctgtcagtcgcttggagatggcaaaagtcacatccacgcggatatgggtcaaactaaatatagcttgctgatcaataattctgctgaatcgtcgatatattgatttttttagttagtggtataggatcttggtgcgataccgcttccacagtcactcatttgttatttttttctctttttattttcaaaggtttgttgttattttctagcaaaaccataagcagtgatcttgatatgctggaaatcctggaagccttcctgtaagggcaaatttcattgttttttgacacaaattgctgataaaaagaagtgtacattgtctcttaccattctgagatgcaagcttgtgaactgaactatagactacaaatatccctgtgttttgttatctatggaatgctcatcaccatttcgtgccaactgttgggtacacgtgtattgttaagcagtatcaaatcaggcgtnnnnnnnnnnnnnnnnnnnnnnnnnnnnnnnnnnnnnnnnnnnnnnnnnnnnnnnnnnnnnnnnnnnnnnnnnn

SEQ ID NO: 25559 - DNA, 428 bp, Oryza sativa
  unsure (1)..(428): unsure at all n locations
nnnnnnnnnnnnnnnnnnnnnnnnnnnnnnnnnnnnctgtaacttgcatgtaattacactgtaactataatataacttgtatgtaactttcaaaaatctctccataatatattattttggtaaaataaaggttgtgggaacaattttttttcagatatgtgtgtactgtgattttttttctttctcaccaaaacaaatctttataatagatctaataatttaaaattacgtgaaacttacatacaagttacactgtagttacatgcaagtagagatggcaatgggtacccggtccccggtccccggtcccccgtggagaattctcccattaggtgatggtgatggtattaattgtgtctccatggggaatcaaatggagagaaagtattctccgtcgggtctggcgggggtaccgagctcgaattcgc

SEQ ID NO: 25560 - DNA, 695 bp, Oryza sativa
  unsure (1)..(695): unsure at all n locations
actatagggcgaattcgagctcggtaccccgcgtcgacgccgtggcggcctcgcggcgccggcgcccaccaccatgcccgcccggccaccgcacggcgcggcgatggatcttggactggatcaccgccgcaactccagcgcacctccgccaccacaaccgccacggcttcacactcaccctcctcctccccctcgtcgacgacggcgacggcgacagcggccacccggcgctgctcccgctcgccatgccaaagcaagacatgctagctagctctcagagagttgaaagcagcgtgtagatcgaagtaggagacgccgccatgggaggagaggagctttatagcggcgatggcgagagggggtggcgtgaggaggaggcgggggatggctttcggcggttttggcgggtaagactcacgctatgtggttgactgcgcattccttctttggttggttggtgtgggaatggcagttggctagcagctgcctagctccaacctgtctggctggctgcttctctttttttttcgccttaaatggtattcttttcctcggtctctatatctaactggatatatacaatcttttatattagaaacttagcatattaaatatgaaacttagccctcaaannnnnnnnnnnnnnnnnnnnnnnnnnnnnnnnnnnnnnnnnnnnnnnnnnnnnnnnnnnnnnn

SEQ ID NO: 25561 - DNA, 141 bp, Oryza sativa
ccagcggttcgcatcatctcatcccactgactctccgcttttgacagatctgcatatcctcgggccaacttatccagtactccgtagtttgccgatttattcacccgccagaacaccgcctcacctgcatcggcaagccgg

SEQ ID NO: 25562 - DNA, 687 bp, Oryza sativa
ctcccctttcttcttccgcctctcctccatggcgtgacctgactggcgatggtggccaccacagtcacacctcctcctttctctagcactctttcgttcgtgtctccctccaccttagcccgccgccggcctcctcatgcgcgtcatctccctccacctcgacccgccgccggtctcctcttgtgcatcagcgcgtcctagatccagtcgcctctcctcgccgtgtgaggagctctgggcaatggcgatgaccaaagaattaaagagcggccacttctctctggcaagctcctgcacctccctccctccctccctcaccgcacccgcagcttctccggttcagcagctgcctccaccacctcgacgcccgatgcagcgaggacggccttcgtgaagagcctcggcagatggcggacctgcggtgttctgtccggcgctccgagctcccgcgacggatgtcgcaggcgaagagaggtagaagatgagtgaagagagagagatagaagatgaggggatttttcgtccaatacatgcaaaatacgtatcttagtggcaccattgagattacgaacaagcagcagtggcattgttacaaatacacaaatagtaatggtatattttaaaaccggcaattttttagtggcacgtatctaattaacccaaaatttttaatatgtgagtgtgtac

SEQ ID NO: 25563 - DNA, 392 bp, Oryza sativa
  unsure (1)..(392): unsure at all n locations
nnnnnnnnnnnnnnnnnnnnnnnnnnnnnnnnnnnatcttagtgagcgggctcagggggaacacctggacgctgtgggtggagccgtctgacacggtggagagcgtcaagctacagctccaggagaaggacgggctgccgccgtgccagcagcggctgatcttcgaggggaggcagctcgacgacggcgacacggtggcctcctgcggcatccgcaagcactcgtacctgaacctctgcggccgcctcgccagctgcgactgcatccgcacgcacatggaggcgcagaaactgatccaagagcatcatcaaaccctaacgactcgacctgttgctannnnnnnnnnnnnnnnnnnnnnnnnnnnnnnnnnnnnnnnnnnnnnnnnnnnnnnn

SEQ ID NO: 25564 - DNA, 6364 bp, Oryza sativa
gacgacgaggcgacgcgccggcagcgcgggcacacggctccaagcaggcggggacagggggggatccaaggcggcgtgactcaccggcagaggaggcgctgaggcgcagatccgcctcctcctcctcgctgcgcgacacccaccggcggttgcccggctaggtttgtgcatgcccttgtagctgctgcttgattcttgggggttcgttcagtacttcagttttcttggtgtatgtatggtatgtttcttgatttggtttgggagagttgtaatctgttctcctgttctttctaatacattgtagtattgtaccctgcagtagcatttcattttgttatggaagcgattcagaaggggatatgggtgggcgtatggtgctcttgttttagatcatgaatgagttttggtaagatgatgttctaatttgatggagtaggttgtgctctggttttttctgcagtgtaattatcatgcttagtgcagtctaaatatgtgagatcaatgcaccagtcccaagaaatgaggaattatcacacatgcagtgaggatcattcaactggtgaggtatatgagaaattttagtctgcaaaccagtaacagttttttgcagttaattagagatgcagttcttttagttggatgctgtcagctctgttaacctagaggtagatcttagtactggttgagctgctagcatcaagtttttttttctggaggcattttttagtctaatccattcttgtagtctctgtcagggaactgtagaattagtggtcaatttagcatgcatgttgggactaaataaatggtaacaatcatatttttgataggaactcatacttactacaaaaatgaagtcttttatgctctatacttatacattagtctaaactttagtttcatgtcatgtatcaccagcagaaaatgagcaaggtggcattgtgcattcaaaaaacacaagctttggcagcaacctatatacaaagacacgcacacacaggtatttcaatctcctctctctcactcactgcacaatacactggccaaacaaagtgacctagtagtactgattaattaaaacaacaacaactactactacttttttttccttatcatgtccataatgataattcataattgtgctcttgcattcttcctcttgccaggattcaaaggattcaatttgaattgcatgctcaacttactttcaaatatggacttgaaatagagtattgttggaaaactatcaatacaaaaacatggacttcaaattgtttgatttaaaaataatggtgtgtatctgcatgtagggtgtttgatctaaaaagaaagtgcttataccaagagtttgtttacgctgatgaagctgacaattgcaatatgttggttgatgtgcatgcattttttcctaagctagtatcaatggccgtccttcaaatttgattgctgaagtatcactattttatatttattacttaaatttcagattatctttttcatcctggcagatttattagaacaaatgaagatttgtagaagagatgatgaagaagatagaagagataaagatttaaattgtgttcttgatcaagacattgtaaccctatataaatatgatgtacagttctatatttgtggatgcaaggatgattccaaagattctaaattttgtatgatatggatgattctaaagtttgacttatgtcatgtcacgaagttggtttccacataaactaatctatatttctttgttttttctgaatttctaatacttgttgattttttttatgtttttattttttttttctggaatttttttaggttgtttcctatttatatggattttctatattctttctatttttcctgaaatttctataatatttctaaagacatgttttgttgttcaaacactatttagcagtttgcctctctaaatcccccttcccccatcaaccccctccccctactcccaaatggtagtagagaaaattcccctaataggagtgattcctctggaggtggaaggggatcggttggtacaggggaaaatccctgtacgggactttttccctggggtttcctccccctgcatccaaaggagccctaaggcattgttcggttacacaaggattcgttccgggccaggaatgataggtataacaagaaatttataataggtataacaagagaccgggatttattccagatcaggaaccaatttacttatattaggtacaacaaaatatccggattagttccacacctcttaactggtggattaattcccggtctcttattgtccctatcatgagcaaattagtttccggcccaaaataaatcccgacctctcgttgtatctatcataaatttcatattatacttgttattcccggcccggattgaatacttgtgtaaccgaacaagggttaaaccggcgatagcaccattcctctacgccattctcttcgatccccgtctctagcagcgagccgcaggattcgtcatctcctaactccacagcctcccttgcaccctatcatctcattgcccaaggctattcctctaagcttaaaaccatcctctcccctcccctcccaccctggcccttacccaaaacctaaaaccttattagcataaatcatctttgaaaatacacagtaaaacatgaaggctagctagaaccgtgatacagtaaaataatatcttctcaagaacagtaaagcatctgttaaaaagagagcatggtgtgtatatctttcatgcatgctcctttgatctaatctatggattagaaggaaaatataacatcagcacttatattttaatgagaaaattactctcgtctagcttgcggtgatcaaaactctcaatagctgtattttaactgcaacaacgttaagttctgaacactcagcctctttttctcgaactaacaaattacggtacttttcatgcgagatactctggatcaagtcacaaatcgtggctcaaatgcatatacgcacggtgacgtgcatgcaaaactgcagatcatgggaacaaaatggtgttctctgttcagttgcagaccgagtagtgtgcaacaagcaagtatatattgaggaccaaattaaacacgacatgagactcgactcaactcaactcaaatacctcctgattggacaaatctggaagccagctgcactgcacattcagtttgtccccatcaatcggttgctatgagctgattataagctaaagtggcttatatacatgttcttagcggtttagaaataatattctaaaattaattttaaaattaagatcctgcatgtctaatgtaaatgatgaggctggttgtctatatattttccgacagcaagggcgtggcatccctttcacaagggaatcaaacccttccagaacttccagtcctgtgagaaaaaaagcttggaaaaatcgggctgacagctgctgcccagagaaaagctccgcactctgccaaaaatccaagactccaagtcaagcaacttatactgaagactacttatactgaccaacaacgacgtatatatacgtacacgtttgcacatgcaggacatcttcgtgtgcctataaattcgggaaatttaactatttgtcacttttacgtttggcaattagtcaaataccttttttagatttgtacttaacaatttgccatgggaaagagaagcttttgtatttttttttgccactttgtgcactgtagagcgtcacctgtgcatgccagcatggaactgacgcaaaaaataactaatctacccctgctagcaattggtactgtcctgagttgataagcttgaacacattgaatcttagtcataattttaactggagagataacaagagaaatcggcaacatgtccaatctatcctttttaaatttgcaagacaacaagatcaatggcaccattccggttacatcagttcatcaacttgtttaatcgagctaagtttgggtggcaccatcccaacaatgccagccaaattaaataccgtttttaatcttaggcccagttttttttttcaactacaaattacaacttcctcggtttccattatcacgtttttcaaacggttaaatagtgtgtttttataaaaaaaagttatgtaaaagttgtttaaaaattcaaatgaatccaatttttaattttgtaacaattaatatttaattaatcatgtgctaatgagctttctcgttatatgtgcgctggaaatttctctctcaactgagagatcgaacaggtcctttgatgtgtccaagacccgggcattttttgttggagaaatacaagtggccgtgcaggagcaattcaaagaatatatatatataggttcggttcttgtaccgataggctaattaaccaactatcattaatagggtcattagcggctggattacccaagtaattagtacattttactatctgccctgtaacaggggaggaatttttgtgttgttctgttgagagttctccaggaaagctgatggcgatcccatctgcgaattgacattattgctgccgctgtgaaggttggagaagaagctaggtctggagattattttcctggtcttgctacttggtacatgttagtgccctttcttctgatcgtgtagaaagcacgggtagaggattattttatctagggtttggtcttcaactgttatacgccgagctcttgattatttggtttgtttgctgctgaattttatctatatatgcaagtctggttaatccatcagtgttgagattaattactggagttgtgatttttattagctgctgattcagatcgttggtgacctcacgctgcctggcaagttcagaaagttaatttgttaattgctattggtaccgtaaaagagagggataaaattagggtactcggtgttgggtaatcatcatccttacccataacatccggtggatatatttcttcaaatattggttcgttattcgacttggcggtactcgatcttttatacaaggacgagcaggttgtcctcggatcatcaatgaccacctcataacagtgaacaacatccatccagattcagcctataaaatacagccaattgctagcaggggtagattggtcatttcacgtgcctggtccaccctggcatgcatgtgtggcgctgcacagtgcaggaagtggcaaaaaattacaaaagcttctctctagtggcaaattcttaagtgcaaacctaagaagggtatttggttaattgtcgaacgcaaaagtgacaaatagttaaatttccctataaattctgcttcaccacactcccttaaatcctacactaaaatttttcactctatcacatcgaacatttcaacacctgcatgaattattaaataaaggctaaaaaaatatcgaactacgtagattgcgtctaatttgcgagacgtttaagcctaattgctccatgatttgacaatatggtgctacagtgaatattggctaatgacggattaattaggcttaataaattcatctcgcagtttataagcggattctgtaatttgttttattattagactgcgtttaatactttaaatgtgtgtccgtatatccgatatgacacgttaaaactttgcacccctgaatctaaacaccccctaagaaatcctatacttttcttaaaatacattcagacgatgatatgccatatttagaaaatgcgcaaatattttggattagatatttgatctggtctccgtcccacatggcactaacgtggcattagaattaaaaaagtatacgtaggactcatttgtcattcacataaacaatattatgggacccactgacatgtaggtcatcatctttctccatatcttcttccttctctttccctcttccttatctccctgtctcctctttctattcaccttcatctggcagcgacgagggtagcggctcgacggcgatgagggccgcacggcggcgggcatgagggcgatggagcgacgatcgcggtgggcaggcgaggccctaacaacttgccatggccacccaccaccgcagccgctggcgtagaccccggagctgtggagcgacttagtcgctcactcgctcgccatggcgctctccttcgcagtgatggtcacgcggcgtccgcatcactatccgtaagtccgccgcgaagcgcaagccatccacctctggcagcccgtggtacggacccgaccgcgtcttccgctccaccgatccggctaggcacgtgcggagcccggcaaggaggagagaggaagatgggggcggcctccgccactagctctctccccgccagccaccgtcgaccgccgggctctccaccgacctgccatcactc

SEQ ID NO: 25565 - DNA, 18498 bp, Oryza sativa
  unsure (1)..(18498): unsure at all n locations
aattttcgaagttctcctgtgatgtctgggagatgaatgccaacaaacagataaacaagaacccaacaatcaaaaccttctgtagcataacctgattcagtatcatgtcatgtgcatgttttcaaaacaagaaaacatgttaagccatgcaaggtttgcttgttccactgcatgcgtataacaaaaacccgcagtcaggtaacataattaatctaaccaaggcggtgatgaattcttgagtacaattgctggaatgttttgtgttgcgtcaaacaatatatataatatgtgcggccatgaacgactccaaacctccaaaattaaggaggttactgccttactgatcacgttgcagtgtttcttggatttgcatggtagctgatctcagcagagccctaactgaaatataccataacatgatgtcaatgaggggtcggagttttaaactccgaactcctttgggatctctgacggccatttgatcacgcttgcgtttgcgcagattgaacagtgaaccgatcgagtagagagagccacggcggactcgtcgatcgaacacatgtgacatctcgaaccactttacactgcatctctgacatgccgcgcgccggacttgtggcaattcgtcagtaatcgccgtaataatgcttgtgccgcatgaacgaacgaacgtacggcgcctgatcgagatgccagatgaaccaacagtaaagccacccgttggtaaaaaaggcatgtgcgcgcggcgagcatctcttcgccgctgatggcggccggaccctggtcagacgtcggtgcgcgcggcagcgatggcatggaatccggagtccactatgaggaaagaaagctgtagtctttgttcgggttaaagaggattgaagaggattggaggagattgagggggaataatttcacaccacaataagtgtggaataaatcccctccaatccctccggattaaccgaacaaggccgcaaagggagaacaattgccatgtcatcggagatcagaattccgaccctcctcgggtctagctctgacggccttccaaagctaacaacatgtagtcagtcagatcacatggtcaatgtaaccaagacagtgctgaaataactaacattagcctagccacatctgaattattgagtgcaattatcgaaaccgtaattttgtggtgcataaaacaatgggaccatgaaattctactccagcaccctcttttcgaaaagaacaagatatcttccataccaagatcagaggcattcttctacttcgcccttagattactttgccatgttgacgctctgcatagcttttctctatcgtccgtgagtgccacggtgttcgatcgatccgtgtggcgctcgagacggcggccggccgtcacagctctaagccagcatggcggttcaatcaagcccctgtgtggcccaaatgagactaaaacctgtgtcaatgcggttataatttgaaaatttttagtttttatcaatttgggaataatggagtaatatttttctagcaaaaggcaacatatatgttgacagcgttccttatgatagaacctaagtactcaggtttaagttgtagattttatatgtgtattcgcatttacgattggttatattttaagtggtaaataaatgaaatatacgttgagagtgagatgcttgtgattatctaattaatcttaaaatatactacttaatttttcggagatgcttgtgtgtgttttataaggataagtgtggacaagctgtattgctgttctaataattttgctgagaatgtaggatagaattactatgctcattcatacataagttctacgtgatgagtagttaaccaacgtaagtgtggggcatgtgggctccttcttctatatttttcttttacggggaggacataagactggagctcacccacgcccagccgctcgtctagttttttttatctttaagatgcttttgctatttaattacaccatcaagatatggtatatcctaatactatgaatttaaacagagcattatattttaagacggatagagtatctatcaagtgaatggtgacactggaccaacgataagccaacaagccggtgtttttttttcttactaaatgcttttactatttattatgtattagtataagtgaatgttgacacttggaccagtgatcagccaacgaacctgccggcttgagaaggatgaatcggatgtagtgaaatcggtcaagcctccaggatggaccaatggaaatacccacaattcgtgcaggtcccatcctggctccaacttggcatgtacagcaacaagcaataaatatagctaggctttttagattgtcaattagacagctgatttgctaaaatagaggaaagaaaaaaatcaaatgtaaagcttcacaacgccttaaaattaactatttgcatttacaaaaggaatattttctatacataagggtaaggaaaatgaaaaaaaaaaggtaataaatattattttgaagtattaatagctagaaccttcgttgtctcaattgttatgcgaggttagtctctacatagctggcaagtcgactagggtgtgctctttccctagtttttccaactctcccatgtcgttttttgtgcacacgtttttcaaactgctaaatggtatgtttttttttaaaaaaaataattatatactaaagttgttttttaaaaaaatcatattaatctatttttttaaaaaatatttaatacttaattaatcatgcaataataagtgtttcgttttacgtgccgagaactaacccctcctcgcgaacgcagcctaagaggatataccatgcaacatatcatgtgtttgttttttgacgcatgtttcccaaactaataaacatggtatctcacacacacacacacacacacacacacacacacacacacgcacgcacacacacacacacacacacacacatatatatatatatatatatatatatatatatatatatatatattgtgtgtgtgtgtgtatatatatataattttactatacacacacatatatatatacatatatatatatatttatatatatacatatatatatacatatatatacatatatatatatgccttaaaaatcatattaacacatatttcttaagtttttttaagctaatacttaattagtcatgcgctaaatcttcgctctattttgcgtgttgtgggccgggggaggggttccaatccccacaaattgtacgggtaaaatcgaaccatgcttgaaaaaatcgactacaacacactgcagcaaccaattgttatatgttaaagtaaaatatcgaccacaaaagaagagtcgaacttagcgttaaaaagatggtttgcagctgttggttggctgcacaagatagggatgtacgcatgtgattagagattctttttctataagggtccaacgatccatgtcacatattgtagccaacaaatcaaaattttgttcgaccatactaatcgaactagaactgcaggtaccctaaagctgacaagttgtattccattcgaaagaacacccttacagttacatccactatccttggccatgggtggttgcttcatgtgaacatatatgtggactgtgggcctgtggcttgctagtgccaaattggttgttgaagaagggccgttgacccctagtcaatgacagtgaattgtactcccctgcctgtcctgcaggtgctataaattctgaacctcaagaactagaccaaagcaacaaagcgaggtgcagtttcagtgagggaggaaaaaaagagtgagaagaaagtcgagatcatgtccctttggaaggtgctcctgatggtaatcgcgctcatctgcgccctgcatactacttcaggtaaacgagttaataagtttttttactattgtaaatttataattaatgtctactaccttagttataaaataaatttagaatatcttaaattgatgtctaaaatataatttattctgagacggatatagtataatctctattattagagaatagagagaatagactgaggaatttaattgtataatttgatgcagggagacctcccgtcgtgggatatcctgctcctcgtcccaacggtagctcgggcacacgatgctacgaaggctgcaaccctccaggtagagatggcaacagggatccataacagagaccctctgctaccctccaggtagagatggcaacagagatccataaccagagactctataggtttttattttattaggagtcatatatgatctaattcttgtatctatggatttatcaacagaaaaaaaatccttacatgttggatagatgggtattagttctttagccactcgtaccccttacctatgggtaaaaaatacctatatgcttagcgtgatagtttacttactttgaacgttcatgtatggtttaatactagtatggtttatttacttgttatatatggtttaattcttgcatgatttgtttacttgtatttgaatgctaatactaaaaccaaggttacttaatatgatgtcgatagttgttatcgtaatcgtttagttatagataaaggggaagggagaagttcactttagttccctcaatttatcgtcgagtccgaaatttatctttgaaatgcaaaaccgggtacaacacatcccctagcttacaaaatcagtacaaatatggggtctctcggcaatattgtgcccagttttggttgacgtggcgtctacgtgggatcctttaactaggtgttcgttccacgtggtattgatgtgtcgcttacgtggaaattcgatccgagaaaaataataaaaaccgtaggacccacatgttagctacacacgaaacaaaaataatagagggtccgtgtggccccacacgtcatcctcactcctccctcctctctctatcccctctctctcctcccttcttccagcagcacgccgccgctgggggattggtcgccggcggtggaagtgttaggcggcgggcaggagcatcatgacagcttcggcgtcttcctgtacaaggtctcctgcggccggcgtccagcggtggtggtcatgaacggcggcgaggacgcgatccacctcgtgcagtgggtctgggacacgcacgggcggcgcgcggtggcgggggcgacatcctcgacgcggccgacacgcggctgaacggcgagttcgacggcgcagacatggagcgcgcgctgaccgcggcctgaggccgtcagcgtgctgcggttcgtggcgccgctgccgagcctcccggcgaagatgccggtggcgagtacgggccgccggtgtccacagcgccggcggccagcagcaacgatttccatggctgccggaccaggccggctcactgcttcagctactgtccaggtagctcgttcagattgatgaatgggtattgatgaaatggcaagccatggatgcaaatctcaatcgaattagcttattattcagttgtctcgaatctcgatgaatgcgtttgagtattagagattcagagttggtgcctgttcttggccgatgcgaaatttgaactcaaaggaatagttgaataaaaacgtctgaataggatgcactgaatatatgagtttattccaggtgattaataccatatcatgagttggcaatgccgaaaatcttgtcatgttctttggatattctgaattcagcatctgttcacctagttcgtgttacaaagcggcaaccatcgtgtaatcaacatgttttgtgtctgaatctgtcatcaagtttcgatcgagatggaacacgagctgctagtgtcgtcgttgccaccggtggactgaatcagccgccagcgccatacgtgcgtgggctcggaagacattcgcacggatcgggcgccggtggcctctagcgccagctggatctcctccatccgccgccccttctccccgccggtcaccatccttctccctgccgccattggtcgttgcgcctggagagaggagatttgaaatgtgtgatgattttatgattttggtgagattggtgtgaaatcaatatgcaaagaataatgaaaaaaaaaaaggataggaaccagagacgtggcgctagcctcaccaaccgggaccaaagattttcctctttactcccggttggtgttactaaccgaggatctttaatcccaggtatttgaaccgggactaaagatagcgatctttagtcttggattcttagtactggttggttaccaaccgggagtaaaagacatttccccaccagtagaacacagccatattgatagagtagagctaatggttgggcctcagaaaaaatatgtataggacatgatcaaatagagccaatgtcggcaaaagaaagctccagaaaaatcactctcccaaaggttgcaaccccgcgaggtcttgggttcctgcccttcgccacgatacatcgtcttcgattatctagatgattattattggcatcgactaataaacatttaaacaacatatggtaagtggtaagacatagaacactctgattacacactgttctttggaagaatttctgcagagtactactactactaaacaagcaaaacatcaccagaattcaaggccagtacaagatcaggacacggccggaaccataataccagaaataacgagcaactaattaattgatcgactcgaacaatgaaagaaattaagcgctaactaagagcacccacaatagttatctatggctctctatgagagattcatgtcggtatatttttctacttagaagagattaaataaagagagagagtaaagctatctactaaactgaagatagtctatagagaaaaacgaggcaatggattagagagctatagatacccatgtagacatactattgatcaggtggtttactgttaatctagtctattgctgagatgtacatgttttataaagaataccttactttaccattgcaattactgcgtgattgatgggtgagctatctggtgcctttaattttgtatccatgacttgagatatctgcagctacagatacaactttcgagacgtacgcaaaggtacaacgtcgactcctcctcgatgccgtaggaggccagcgtgcggtcgtccgcaagctccataccggagaaaaccagccgttgcttgcacggcatggtcttcttcttcttcctgtagtacagcttcaccttcacgcttcccaccgtgtccgacggctgcaccttcagcgccgtctccttctttcccccgagcactctcacgaagatctgcatctcatccgtagcagcaggtcgagtcgttagggtttgatgatgctcttggatcagtttctgcgcctccatgtgcgtgcggatgcagtcgcagctggcgaggcggccgcagaggttcaagtacgagtgcttgcggatgccgcaggaggccaccgtgtcgccgtcgtcgagctgcctcccctcgaagatcagccgctgctggcacggcggcagcccgtccttctcctggagctgtagcttgacgctctccaccgtgtccgacggctccacccacagcgtccaggtgttccccctgagcccgctcactaagatctgcatctccgtagcggggtcgcggatgccgtagtcggccagcgtgcgatgaccgtcggcctcatccatctgctttccgtcgtacgccaacccgaagtcctcagtgatccccgacatggccttgatcttcgccttcacgctctccaccgtgtccgacggctccacttccagcgtcaacgtggcccccgtgatcaggtccacggggatctgcatcctcttccccctggaattaatcgtcgccgccggccaccacagtttcgtccaggtcacgatcgagctggtgttgctctggttgttgcgcggctgcgtgacttgccggaacgacgtgtatataaataatataaagggcagggcaggcttaggtcagaacggttctggtgttggagttcgaaccagtcacgacggcaaaagtaggttcggatatgaatctcaaaatatatttgggatatattctgcggcgatgaatcccaacatacatatatacgagtccagaggcgctggacacgttggagttgccaagaaattttcttttcatattccctttttgtttatgtttttcttcccttttaaatatgtgatttgaattttgggttcacaatatatttggattatagtattctaatagaacctgactattagattagttttctagtataactcttagtctttattcacgacgactcctagttttctcctgtgtatatccctcgtaagccgcactaggagggtacgatagcccaatgtatctctgcgtttgtatccaactcctcaatagtaattattgttggttggcgcccgtggttttttcccaaaagggttttccacgtaaaaattcgtgtctccgctgcacatctatttccataacacactttattttgggttcgttactacctgcttagtgcttagtgctacgtgacaggtggtacaagccggatcgaagcaatgtggcttggtaggggtgggcaaaataagaccgaaccgaagaactggaccgaaaagaccgagaccgagaccgagaaattcggttagtgattcgatatcagccatcaaaagaccgaatttttttcgggtaattcggtcataggcttccgttaaccgaattaccccaaaaaactgaaatttggcctaacaggtgtacgaggcctaataagcccactaaatagaacaaaccctagagggagcaaccgagtaaagtcgctctcaggtctctcagcggctcagcccctcactgcctcgcatccatcgcgtagcctccacgcctccgccttcgcctgcatcgcgccgcctccgccctccgcctccagcaccggcgccgcctccgcctcgacgtcgcctctgcccttcgcctccagcgccagcaccgccgccgccgcctccgccctccgcctccatcccacctctgcgcctccatcccgcctccgccttgtaccgtgggtctgtggctgttgtgacttgtgaggttcagacttgagatctatcctgtgataatttggtgcttgatgttgcctattgtttggtatttttgtgatatatatgtctgtgaaaaatttctaaaaagagggaagtgctgtcaaaatttttcattctcctgaaatttcggttagaccgagtccaagaccgaatttgccagtcctgagttttttttatgaaattcggtcctgactttccaaagactgaattacccgagaaaccaaagggaattttttagtctgaccgaacgcccacccctatggctcggtcgaatccagatttgtcctagcatctctgcaaccctctgttttgttttgtttttcttcacggcaactttagttgggaaaagctacgactttagcaaacgatttaactgtgacctttaactcaccatgcatgtgacatgtgggtccgacacgtaacgacgtgagttttgcgcgtgccagagttgactaacgggcctaaaattcatcaagtgtatgaagttgcacttttgtgataaaaaccatttactattgttgcggtttcatgaaatgtttcactaaagacatcaacttatggaatagtcacccgaccgatccaccgtgtccaacggctccattcttagcttcactctcagtgtcactgtactcctcatcaacacactttcacgtagatctgcatctcagtagcaggctgcgtggaatgtaattgagctagggtttgatgcttttgaattagtctttgtgtctcgatgtgtgcgcagatgcaatcacaactgtcagcgaagtgatagcagaggttcatgttcgagtatttccaaatgccgcaggaggccagcgtgtcaccgtccttcagctgccacccctggaagatcaaccgttgctagcacggcaacatcttttccttctcctagagcttcaccttcacgctcttaaccgtgtccgacggcttcacccacagcgtcctagtattccccatcagccccctcacgaagatctccatctctgtagcaggatcatggatgccgtaatcggccagcgtgcgactgccgacctcatccatctgcttcccatcgtatctcaaccagaagtcctccgtgatccccgacatatccttgatctttgctttcacgctctccaccgtgtccgacggctcctgatgtgaccatggctattatagatacaaccgttgctcacatcatgaattaacaagaagacatcaagatcaagtcctccatgtgttgcaatctgattcggccacgtgctacattgctgacttaaacggccgccaaatctacatacgtgctccgttttgggcccgtgagtacttgatggaaagctctcgaagtcttctttccaacggatccaacctcatctcggaattccatctcgtttggccataatcacagaagcaaagtgttgcgtcacctgtaatgggcctatgggcttgtaacctcgtctgggatcccggcccaagtgaggcccatgtgggatgcatcccaatctggtgaagcacgacccttggacaatcttggtcgtcctcctacctctataaatagttaggtaccccttcagggtttttcgggttttgtttagatgaaagtttagctattgctacttccttgcagcgcgcatgtgggctagaccgtccgtctgcttgtaatcggaaccccaacttatcatttatgctcaattcctatttgtaattcagattgcttttatcttgtccttgcttgtttcttcgatttgcttgcaggaacaaggttgatctgcatcggcaagatcaacaaccaacggagaggtgtatcgatcgctaaggcgcaacacaacgtcttgtacggttgtagtcgggtcgtcaacgtttctctcaaatcgtagttatctcaactcactgaaagatcgggccaacaacagccttgagtgtcgagtggaactcagggttcatcagctccacttccagtgtcaacgtacccccctcccacctccccccctgatcagctccacgaggagctgcatcctcttcccctggaattggcggctgccaccgcagtttcgtcgagatcgaccgagttggtgttgcacggctgcgccgggaacgacgtataaaaagggtatgacacgacggcaaaagcacaacccggatacaaattcatacgaatcccaaaatagtttgggatacattctgtggcgattccggcgatgaatccaaaaatacatctacttgtttcaggaatgctttgactcgagcgttcgatacgcgataaaaaatcggacgccaccaccgagtgggtcccacctaaccactcttctacgtacctttttctcatcaaacttatccctatctcaaattctcagccacttgttctctctctcccccatcaacaccgtagcggcaaggtaggaggacaccaacgacaacgtgaaaagggaggaggatgacggtgaccacgctggcggtgatggggcggcgcaacatggagaaggaggcggacgctctgcacctcgttgacggcgcgacgtgtagaggggggaggacgccggcgaccttgctgacggtgcagcgtgaagagggaggaggacaccggcggaggcagagcaggccgacccgaaagggaggaccaaatgaggcaccactggtggagcagccacgagcccacgatgcgaaggaggcgttggaccggatgccgatgcgactggccttggcgaggtcgccctttcgacatggctgcttgcttgtcctcgtctacaccatcaccacacctcacttgtctcgccgtgttggccgcttgatttcggtgaccggaatagaagacagaggtgggttttgttaggaattttagtgatgttacagtttatttgtttttttggttgcactttgttctatcaagttgtttcattctattttgactcaattttgcgtacattgtattaaggtgttgcaatcagtatgttttactattgcatttggttgaaacaattttactcaagtgttgaaacatttttatctggtagtgaaacatctgagacaatttttatcgagaggtgaaacatgtgaaacattcttcaacaatacggtacaacaccgtccaataatttgcatcaaatcggacgtccgatccgtagcagtctccatttgtttcgggctagtgcgaacaagtccaaaagcgctggacacgctggagttgcgaagaaattttcttgttcttccctttttcttttcttttttttctttttaccttttttttctctggggtgattacaacttgctgctagtgctatgtgacaggtggtacaagcctgagcagtgtgttgctcggtcgaattcagagatttgcaccaacgtctctggaaccctctgttttcttgttttgtttttcataaatttcaataaaatgattcgaactattagtatactaaaagacaggtatttcacaaagctacaattttaataaacgattttatcaataagatgcaacctgtaagttatcatgtgtgtgcgatatatgggtctgacgcataactatgtaaattttgtacgtgtacctactagcgaacccaaaattcggtttgcttttatatttatttttattgcaatgtacgagcattatgctactaaaataaagctcttcattatctaaaagatttatatggtaaaccgatagtaaaatgttttccatgctatgaattcaaccatggcacatcctaattcttacttgcactgcagcagcacaacaacggtacgcaccttctgtacagtagacttggatatatgcatataattaactagatgatacctcgcactttgttgtgagatttatagatgagtatatattaaatattatcgaaatgatgaaagttaaaatgttaaaaaaataatatgaggaagatggtttgacacatacttgttgatgatgtgtcatgcttgtatggggatttaaaataggctataatagtaattactcgtgagtgaagatgtgacatgcttttatgggattttaaatgagctagaatagtaattgttagtgggtgatgatgtggtatgtttgcatgttgagctttggcttctaataattaataattgttagtggataccaactatatagaaagtatagatttattgtggtagtatttttatttcatatatatactcctcgtatgcgtcttaatctacgtatgtatactgttgtgtaaaatcttgtgttgaggatagtgctctctatccatttgcaggctgaaaacgtgtcctaggtaaactaggaataactggaatatctggaaacttgattagcgtaactaattaataagtatagtagtaagcacaccttaaagacggtaaaaagaataaaatgtcaatagtcagatattttcaaccaaaataattatatgtatagaagtatagaaattcaaatagccataacactaattcatgggagaattttccagtgcagtgctaagaccaacacagttcaagacaagcaaagatcaagacgcgaccaaattaaaatatcagcaactaattaaccaattcaaacgataaaagaaaacgttaaataatatccgtctctcacacgatcttttgaagtactaattttatttcatatcctctggctaaaattcaattaaattaaaattgaggatttatcatttctaggtatcaacttttaaaacatctcctctccacttttcagttcatcaggtaagtccacacttgccgcaggtgagtcagtcgtggtgcttcgccataagtgcgccaacgtctttgcactctgggttaggacacatcagtcgtagcctctccaccttccccatcacgtcatcgacacgatagtgacggagcaccgcaagctcttccttgcggtgctcatgctttcccttcttaggtgtcgcgtacgccttcttctttcgcttcttgttgccgccgccgccaccacagatgcgaccgaggaggtgcagcgtcgactcctcctgaataccatagtagattagcgtgtggccgtcgtccagctgatgcccctggaagatgagcggctgctggtctggcggaagcccctccttgtccacgagcttcaccttcacgctctccaccgtatccgacggctccatcctcagagccgtcgtcttccctgtcagccctttcacaaatatctgcgtcatcaccgttgacatcgccggccgccggggttccgcgagatcgtgtggcgtgtgccctaggttgtgttggtctcaactgcgtggcggactctttgggaacgacaagtataggcgaggctcgtccacgtgggaaggggtggtccgtccgatctgaataatcggacggtggtgatcgagtagagtccgggtcgaaaccgacccgaagccacaaggcccggcccaatttggttcgagccttcgaggccgcacgcgtcgcggttgcgaacacaaggcgaggaggggagagaaggggagtcggcgcgccggcgagaaggggagagtagaggagncggcgatggcggcgatcggctcctccaacgtcgggttccaggtgcgcgaagctctccatcccacctgggcttccgtccgttcgaatcccatggccatgggagtgggtgggtgggtggggctagggtttgatgctttgttcgatttggtcctctgcatctcggtgcgtgcgtctcgtgtcgtgtcctgaatccggagctaatcttaagtgatcttgttgctgctgcagctgctgaagaaatcgggctggaaggagggcaccggcctcggcgcgcaagagcaggtttgcgcctctgttcttgcgtcaccggaaatcttttgtgtgtgtgtgtgtgtgtgtgtccatttaccccaattgtagttatattttggggttttgcactttgatgcttaattctgttcatcgtgcatgtgattttgttttccctcggcttgtttggtaactcgagggaaggggattgggagtttacacgagagaatttacgatgagattaagatgggaatttgatttttaatcccaatgtcttgtttggtagatgtgatggaaattgatagggagtttagttggagattagctcattaataaaaacggatggctgagatttgcttagaccaagtaaacgaggaattccctcccaattacctgcccctacccaggtattgaaaaggagggagtttcttcctcaattctccatcccaatcccaccaaaattcccatgtctcccaaccaaacaaaacacttaatagcctcatccctctaaactctcaatccctctttaaaactccctccaaccaaacgggccgtagttgttaatggtgcgtagagttaaatgttgagacaaggctactgcaagttgaactgttgaaagctcaaaaaaatgtgtagatcaacgtaagatatatgtttagtttctggataatggttagtggtctctggaggaatggtaaagccaaaatttgtttccgaaccaagtaggcaggtagcttaccttagttggctgttaactccaaatgtttagtaggatctgaaattatatatcattttgaccggaatgattatctcgcatgttcataggtattaattaagagctgatgtttagtagtcatatatgtgttacatactatgtttgcatgtcacttggatgaagccagtttatgggttagatttgccttttatgctgtgtttttgttttcatactcacttagcccaatttaatcctggaacagggaagattggagcctgtagaaagtcgtgtgaagaataacaagcgtggtttgggttccaaggaaccaaagctaaagccaaaggttgacgaggatggtgaaaaagaccctaaaaaacccaaggtgagcaaaggatatccagtttattcatgatacccgcatacaatacctaattactttctttggcttccttgtaattctcattccgagcattgtattaatagttcactattatcattagttctacttaatagccttttttattgaaaaatactgatgactgctctatagtgtagttcagtaaaaaggtttcagactttacagataaacgtggttacttgcatcgttactaattgtattggtaccagttattctttatgcattataatacttgtctcatttggtagctaatactgctgctttgatatgtatttgttcatcttcaacaagctacttttagtaaatcacacttactgatgggattctaactaactgattcaaacgtgttgcccttgtcagctggaagcaccgaagaagaaggccaagttggccgcgaagaggatacggaagatgcaagaagaagagaagcggttacaagagagggaatttgaaatggctttcttcagggaattttggcccgataatgtgtagaacaggaggttaaccctgctgggcggttcgacctgctggcttcagcttattaggctcccttgtacagaacaacagctttgactcccttgttgtatgtggctaaaatgtttacattgattcaatggatgtttctggagagaatgctggtcttgtatcatgattttgttgtatagaactgtttgcaatgctgttacatgctggccgaataccttttttttttgttaccaaactggcagagtacattcactttacagtcataaaaggaaaaattttcatccataatcgcccacccccaccccgttttttttttcccaaagtggccgcgtttatttttgaagtcataaaaggagaaagttccatccataacctgaggaattggaatttgaaatcccatcgcatagcatttggtgtgtggtgtacacactcagtttgataatgtaaactgaaagaaaaattgctgaaacatattggctacaatgacccatacaaagggacacatatcatatgctgcagttgagctacaacaaaatcggattttatgactgaggtagcagtggcgactgtgatacataatgaaaaggggaagaaaaaaaatacaaaaaaaaaagctctcgctatggtctgaaaatgaaaaatgcagcaaaagagatttgtcaccaaattcggtgccaatttctgtctatacaaacagttaacgcacgtcaggattatgcgttgcttctcaaaaccatatgccagcgcctagctacaatagcagcggttggcgccacagcaccaagtatggtaggtcctcaactctgctggctacctaacaaaaaaagaccttcacatctccctccctagaataccaattcatcctcctcttcagttgcaacggatagtgtgcctgccgatgcggcatccagaatctggccggccttctcgtcgcttatgccaagcagatactgcatccttgccagcttttcaggcttcggaatgctcttcatgttaaatgccgtacagatcatccagctctcctgatgtaggccatgataggggcttcgaagcaggcacagccgcgtcgcatgcaagcaagtcgttcaaggatgcgacctgcattggcaatatattccaagtaaaaattagaacgctgagtaattctaacagtgcagttattgtaactttcctatttatactctagttgaatttcttttgtcattatgacgtgccagttatcaagaataggttaatcctgatatacaccaagatcaaagtcaacgctaaatcagtactttgataactgtagtcagtgttttaatctttcagattcttggagaaactaagttccaacataaaacaaataagtaggagatatgcagggatattccttacgtaccacttcatctttcttcttctgccgaagcagagcaacagcttggacaagggcgttatccaacctaatcttcgcaatgtcctggacaatcgacttggccttctcagcattaatgatgagatcagctgggatctttacatacacttcctcttcatcaaattcacctgtgcctgacgaaaagatctcctcaacggattttttgtaaatgttttctcgaagtggttctgcaatcaagctgtccaattgaaaatttgcttctttcaatcctcggacctgctgtataccaatctgtcctcgagaaatagaggcttcaattgcagaagacaactttgttgttgtgatattcttgattattttctgtgcatactcagtaggaagaccaacttgcttctgtatctttgcaagctggtcagccttggcctctgttaacttcccatcagcaagaatcacttcagcctgttgcacaaatgccttttctgccatcttaatgtgaacattctgagcttccttgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25566 - DNA, 853 bp, Oryza sativa
  unsure (1)..(853): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttgccttcatcaaatcagccgatgcttcagcagcctcaattccagctaagccagtgcagtagctatttcggatagtctgcttgcagcatttgtagccccactgatgatctttccaccatgagccccatacggttgtatggttattaatgaaaacatcctcttcatatttgctcttgggaagggctacatcctgtatgaaatgaactttgagaatccatgaactaatacatgcaaaagacaatagataatgtgaacaactgaaaagtattaaagtaatgacccagaaatggatagagctaataggaaaaactggtataagagctccacaaaacctacactcgtgtggagagttctacattcatgtgctgttccacatttcttaagtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25567 - DNA, 187 bp, Oryza sativa
aagtgctttctgatttttagttctcagatatttatattatctgctatcacagatatgatgaactgtataatatatctgaaacatgtctagtatatctctgataatcttaagtatttaacaggtactatcacaatattacatcgaacaccttattgattttggaggctatggcgtctcatggagtcaa

SEQ ID NO: 25568 - DNA, 14790 bp, Oryza sativa
tatagagaccattcattacaactgcaagaaacttaagaaatgtggaacagcacatgaatgtagaactctccacacgagtgtaggttttgtggagctcttataccagtttttcctattagctctatccatttctgggtcattactttaatacttttcagttgttcacattatctattgtcttttgcatgtattagttcatggattctcaaagttcatttcatacaggatgtagcccttcccaagagcaaatatgaagaggatgttttcattaataaccatacaaccgtatggggctcatggtggaaagatcatcagtggggctacaaatgctgcaagcagactatccgaaatagctactgcactggcttagctggaattgaggctgctgaagcatcggctgatttgatgaaggcaaatatggcccgcaaggaagctgcagaaggtaagctgttgagagatattttggctttctgtgtatgtcttgtcagtttacactacacatgatttaatattcatattgccagtttagtttatgtgggataaaaacatgtcttcgtgggttgcatagctatcatatcaatgtgttttcagaaaagtattcccctcaaagttgtcttatttatgatagcgggaggcctcagatgtcagttgcttcatgcttatcttgttcaatgatgttttgtgtggataattggaaacgtgcagctgaaattctttccatataaactagcttaagtggtctattttacattaagccatgtgtgagtactgttagtccatgatgatgaacttcagttaacctgaaattgccaatgcagatgagcctgtacgacatgaagaaaagcgactggccacctggggaactgatgtgcctaatgatattgttcttgacaagaagctgcttgatgaagccctaaagaaggttagcacctttcatcttatattatctgtttcgttctgtcaatatatttatttatgtagatgctgacactgagttccattttttttgcaggagggtgcgaggaggaaagaggagatggatgaaaggaagaggaagtacaatgtgaaatggaatgatgaggtcaccgcggaagacatggaggcttaccgcatgaagagaattcaccatgatgatcctatgagggatttcctccattaggccttgtatgctccatagttgctcatatatgagcacaacactctgccttgcagtgtcacttgtgtaatgtattagctgtggctatgtcttcctctaactggagtgataatttagagctaagagctctctacttctcttccagatgttaccatcctcttgtccggatggttgtgtttgtattgctgatctttctataaatgatatggaaaaaaggagttgcatacttgcatatgcttatttgagatgccgaagttatggatacgtaatgtacaaagcaggatggagaagtgctaatttttgtgtgtaagtgactcgattgtatttaccatgattcagactctttttatactttctcctgcgacggatgatcaccgttacccatgcaagattttttttcccctggagagtatgcaaactgatgatctaaacaagccggaaatccctgtttctttttttccttgtgaattgtgataaacacccagcaatatacatccatgcaaccaatgaatgcaacaatcctacataaaactaatatttacacgaaaagactccaaattcaaactatagcaatcttaagaacacgacataatctcctcctacctaagcccctaaaaatcttccaaactccaaaccatagctacctatcaataactcttaataatcatgcttagattatgattattatacaaatgactaataataaactaagatgatgatgtgtcataggcctctcgcgagcatggcttggaattcctcggcggatttctggttctgcagcctcatctcctccctgaactttctgatgaacaccttcgccctcacattcaccttccccatcccacacgctcctcctcctctcagcgggctcatcagcaagctcctcacgccgccgcgcgccgccttggcgccgccgccgttggtcgccgcgccagcggcagcagctttcttgccgccgcccacccgccccttgcctctggccccggcagcggcgttggtcgcagcatcagcggcagcgttcttggcggcgaacatggcgctagcgttggtcgcggctacagcgttgttgttgttgttggcggcggcggcggcgacggcgcgcgccttgccgctggcggcgccggcgttggtcttggcagcggtggtgttcggctgctgcgcctgcgcctcgtggacggcgacgtggtgggtcttgggatggctgtagagctcgtcgacgtagaccggcgcgaagctccggtgatggcaccacccctcccgctcccgcgtcgacgccgtggcggcctcgcggcgccggcgcccaccaccatgcccgcccggccaccgcacggcgcggcgatggatcttggactggatcaccggcgcaacttcagcgcaccttcgccaccacaaccgccacggcttcacactcaccctcctcctcccccttgtcgacgacggcgacggcgacagcggccacccggcgctgctcccgctcgccatgccaaagcaagacatgctagctagctctcagagagttgaaagcagcgtgtagatcgaagtaggagacgccgccatgggaggagaggagctttatagcggcgatggcgaaagggggtggcgtgaggagaaggcgggggatggctttcggcggttttggcgggtaagactcacgctatgtggttgactgcgcattccttctttggttggttggtgtgggaatggcagttggctagcagctgcctagctccaacctgtctggctggctgcttctctttttttttcgccttaaatggtattcttttcctcggtctctatatctaactggatatatacaatcttttatattagaaacttagcatattaaatatgaaacttagccctcaaataacccaatctaaaatgtgcttatatagagatttgaatttaaaactttagggtgctactcaggtcactgcaagtctgcaacctataggttgtttctctttgcttagcttagcttgccaatgcctttactgctactgcttttttcaggctttctcacctgctgggcttgtgagatctggattagtgtcaactgtcgactgtcactgtactccagtaatgtgatgggtgttttttctaatgtgatgtttttttttgtttgtattgaggatttgagggatattctcctgttcttaaaattcagtcttttggggttcttttaggggtaacaatccataatcttcttatgttcttatcacatattcaggaaatttaatatatgttattttctaaatcttattgtctaatagccttatcttttctcttatgcttatgcttatcattcaaaatttgaattttcaaccttagtgatttggggattttttttcatcgaagtttatttttcagtatttgcttttagatcgttaagaacacgtatatagaagttttattcacaaattatttttcatttgtaaatatgctgtttgacttgttccccaaataagacaaacgatgaggccgtaagacttcatctggatatgaaaggaaggactttatatcaatggttttaagcacggagtgagtcccaaacccaggctgatcaacccactaatttgtggtgctagccactaaaaaccaatgggactttctctttatcacatatttagaaaaagaaataaacttaattatatggaagtgtttatttaatatatgacaaatccactaatatcagttttactcatcagtgtgatgtgttctattaattttccaaatgattaggctgttgggtcaaggtgatcagatggtcttaattagcatttggctgagaatcaaaatgactgaactttggtatctgattcttttttggggtgtggaagtaccccacttgagcaccgaaaactatctgaaaccaaaatgaacattctcttgacttgactaatattgcagcaagtgagacttgaccaacattaactcactgatgtgctataaatcactagaacctgagattaatgattgtttaatcagaaaagataaccatgctaacagcatgcatgcttaataattcttgcccttttggatcgcttgaaagtgtggatacacaaggccccatcttctgggtagctgtctcaagtcacagggacaagcaccaaaggccaaagcaaacaatccagtagagcacacatgaaggaagatatatacacatcttcacaggtcacaactcacaaacagctaattacaagttgctttttttttaccaaatacaagttgctttgagcaagcacaccgaccacttatgggacttgtgcttgcctgcctaagaaaagaattcttaaaactcctcccaaactaagtttctctaagtacaattagctttagaatcttgtgtgatcaaggggaaacttctcttgagatgcatacgtcttcttcatcggcaaaagggcggcagggcagattccatcatgtttgccgagattttcttctcatagatctcgtgaattcgtgatcgatcgagctagctgaagctgatgcccaacttgcagcaaaaagaaataaaaaaagggaagaaaaaggaagattctatcctcgtcttgtttgcgtgtacgttgctagcttaaaagctacgagaatgggaagaggaatatgcacatctttatcagatgaaaaattaactagttaatcagctcgttaactacatggtaattaatttaatcctacatgctagtggtactggagaggagactcatatgtgcaggcacacgagggtcaattttaatataattgtggtagattcagcgattttaatattcaggaactgtgtctttcactctttttgcatcaaggactttaatttgctggcttgctgagcatgcatgtgcttgaggagtggatattctactaccctggacacatacgtatatatggtcatgggcagctggatttatttgactaattgactgtagtattgatatcagggtttacaatcccaatatagaaaataaaccgctcatgagatttcgtggaatccatttacaaaaccaatgaatcccaacaaatattgtcaaaaaactaacattcagtttgttttgttttcatctttgacttaaaatacccgagcgttttctgctttcgacccgatcagaagactggttttctttgggattgtaaacagagagctttaattaatttttcggaattgctatatttttgtcagacagttttctagtgctgatctgacgaaaatgtttagttcacttttctgcatggatgatcagcataattgggctgggctgctacacgggaacaagtggaagaataagttcatgttaggtcccttcttttttacgttaagttttaaatcacatccctaaaccgcaaaatggggatgaacacatcctttattattcaaaattcagtcctaaaacagtattaaaggctattttgagtgacatagaacaataagcaaaaaaacaaaaaaaaacacatgagacctatatgtaagtgaaacatatccgatgcctaaaacagcccaaggagttaatctcataaggctcacatatttgtcttgctgcctggccttctaggcctgttccaagtgcagcggcgaccggcggcccaacccaacccgtgagcccaccagaccgatggataaaaacggtatgaaaatttcacgacgagcgacagaaaaaataatataataataataatttttaccacggttaccgtttctaaataaggtatagtttttttcctatttctatcaatgtggagtcaaagttgacactaaataattaaatctataaatataaaatttttctgtttttatttgtttctataaaataataaaataatgacaccgttttcgactatttccccctcgtccctacgtggatcgatccgtccgataccaatgtttccatggtggtaactgagctcgggactcccgccgcttaggttgattaattgcgtcgtcgtcgtcgcctgcatgcccccgccgcgctggagcgcaccgtctgacatgcttcgccacgcatggccgccgcgcgctgggtttggcatggcgcgcttgtgcgtcgccgtggcgccacggccgtctccggcgcgcgcgtggcatccatggcatggcatgcaacctctcgcgttctcccgtccgtccatgccctgcacctcacctaccgctactgtccaatgcacgtacgctgttacagacttacagttcgtgtaaagtttaacaaaattgttcagatatggtcatatggatagactcgtaggaccttttcactgtgtttagagagcttgtagtttcttttaaatcttaagaagtttgttgcagttttttattacaatctcaagctttctggctttctaaacagagtagattctcgcttatattatttttaaaaagagactacaccacggaatttcgtctggacgggatacttaatactcccacggaatttcgcttatattattgctgaggttatcccacaccccactttttagctcttactctataagggcacgtacaatggtgtttatcagtggtctctttctattgccatgcaagtaaatttgatgacatggaagaaagagaaatgagtatggttgttatgcatgacaacagcttagagtcaactcttagcatttattagagcaaattttgttgtatggtggtgaaagaaaggaaagaaaagtaagaaaaagtattttgatacattaatgattagagaccatattgtctctaactgttgtaggatgctagtctctagataacgtagagctcatatctgactctacctttgtacatgccctaatgctacgtactctcttcatccaaaaataacttaatctgaggaccgagcgtagctcggttggcacattcgcagtggagcgaacagccggtcgcgagttcgactcacgggacctcacctcgacgggatttttccccgtctttcttcgggactgtccttcggggcagtctcgactagaaataaggtacatacgtgtgcgtgtttagtgggactgcacatttcccgtgcactgagacctagtggtctccaatctcattcctagtgtgtgttaaggacgcgcacgcgtgtgtgcgcgtgtgttgtggtgtgagtgtagtgtgtgtgtgcgtcctgagttgtaccattctcaaaaaaaactcaatctagacggatatgtgactctttcttcttgttcaatgaatctggataattaactctttatccagatctattataatagaagatgtcatatccttgtttacattaagtgtattttctcaaaaaaaaaagactgagtgcattttctgagacgaatagagtagtactgtaactctaatctaagatgcatcacttatctcactttatctgtggtgttacccatcctacacctccaattgctgtgagagtgacaagattgacaaggcaagattgagagaagatttctcttgttcggcagctttagagaagatctctctagttctccacacacacacgttttccaaactattaaatggtacgttttgcaaaaagtttctataggaaaatttctttataaaattatattaattcttttttttcaaatttaaataattaatactcaactaatcagtatggttcatctcgtttcacgtatcttcttaatcttctttttttctctaaacacaaacgcggccaaattactagagaaaaattacaatttgtttcattggaaaaagaaagtgtgcgacgatagaaaccagacctaaccaggcatggtacacgcatgtggcaagaatggtagtacttacttttagatcaattggtaaaataaaatatgatacccgatacttttagggtaaattggaaccatgccattataattttacaaagtttgagatatgccatcggtatctcaatgacatgtaggacccacatgagtcaatgacatgtgggtcaggatgatatatcttaaattttgcaaaattataatggtatggttctaattttcccatacttttatgatacataataactccacaatacttaataattgatactatcttcattctaattgaaaaagagtttattttttttataaggatctgaaaaaaaacttgtccatatttatatataagtgaatttttgagatggaggtatcacacccataatattcataggtactataaaatttggtaccaaaaggttcaagtatcatgatattgatctccatgacaccaagataccaagatacttgtactatgacatttggtacctaatggttcaattatcattatacctaatatcaccatgatatcttaagatatcatgatatatatttgatacatttatgatatttaggtatcatccatatctatatctatatactactcgtacctgtttaatggtaccatcatacatgataccttcatgatacccaaagaaatcatggtatttaggtatcatccgatatttttatatttattgaagttatcataatacctgaaactttcataatatctgatgatactacctctatattttaatagataacgccattaatttttaggcagacgttggacccttcatcttattcaaaaattttagggctaattggatccataccattaaaaatatgttggttttgaaatatgacactagtattcacgtatcgggaaccatgccattataattttacacgtattcaagatatgccactaccctttggatgcatttacaaaaatctggaccaaactacccttttccccttattccttctcccttcttcccctttcttcttccgcctctcctccatggcgtgacctgactggcgatggtggccaccacagtcacacctcctcctttctctagcactctttcgttcgtgtctccctccaccttagcccgccgccggcctcctcatgcgcgtcatctccctccacctcgacccgccgccggtctcctcttgtgcatcagcgcgtcctagatccagtcgcctctcctcgccgtgtgaggagctctgggcaatggcgatgaccaaagaattaaagagcggccacttctctctggcaagctcctgcacctccctccctccctccctcaccgcacccgcagcttctccggttcagcagctgcctccaccacctcgacgcccgatgcagcgaggacggccttcgtgaagagcctcggcagatggcggacctgcggtgttctgtccggcgctccgagctcccgcgacggatgtcgcaggcgaagagaggtagaagatgagtgaagagagagagatagaagatgaggggatttttcgtccaatacatgcaaaatacgtatcttagtggcaccattgagattacgaacaagcagcagtggcattgttacaaatacacaaatagtaatggtatattttaaaaccggcaattttttagtggcacgtatctaattaacccaaaatttttaatatgtgagtgtgtacgttctatgaatctgtcacaagtcatgacgccgcgagccgcgtccagctacaaaccactcaacccaaacgcatccaaaacccctcgctgagctgccatgcatgcactccccctcctcccactataaattatcaccacctcattcccgccatgtctcaccaccaccaccaccaacactgcaacacaacacaccaccatgaagacggcatcaatggcggcgtcgctgctcatcccgctctgcctctgcatcctcctcctgcgcggcgcctccgccgtgagcgaccagcaagaagccggccgtcgcgatagctgcgaccgcatcgaccgccgcatccgcgcgctggagccgacgcgccgcgtcgactccgaggccggccacaccgagctctacgacgaccgcgacggccagctcccctgcgccggcgtcgccgccgcgcgcatcaccatccagcgcaacggcctcctcctcccttcctattccaactccccccgcctcgcctacatcgtccacggccgtggcatcgtcggcgtcgtcatccccggctgccccgagacgtaccaggagacctcgtcgtcgtcgtcgcaggagcaggaggacgacgagcgccgccgccgtggccgccgtggtgatgaggagagacggcgatcgagcgagggagaggaggaggaggaagaggagaccagccgccgcagcttcgagcagtccatccgcgacgagcaccagaggatcaccaccgtccgccagggcgacgtcgtggccatccccgccggcgcgccgttctgggtccacaacgacggcgactccccgctcgtcgccatctccgttcacgacgtcagcaacaacgccaaccagctcgaccaaacctccagggtacgtacgtgcgtaatcaatctcgagattaattaattgatggactccatcggtcgaacacctaacgtgcaatgtttcttctgcagcgtttccggctagccggcgggcaggcgaggagcgaggggaggcagaggtacggtgagggcgagtcgtcggagtcggagacggaacgcggcggcgaggagtcgtacaacatcctgagcggcttcgacaccgagctgctcgccgagtcgatgcgcgtcagcccggacatcgcgcgcaagctgcagggccgcagcgacaagcgcggcaacatcgtgcgcgtccgccgcggcggcctccgcatgctccgcccggcgacggagcgggtgaccgacgaggagatgatgaggggcgccaacgccgccgccgccgccgggaacgggatcgacgaggccgtctgcttgatgaagctccgcgagaacgtcgccgacccgatgaaggccgacctctacacccccaatggcggccgcatcaccgtcctcaacagccagaagctccccgtcctcaagctcatcaagatgagcgtcaaccgcggcgtcatgcgccgggtgagacgacgaacgatcactgttttaaacagttggtggacgtccacccgtttttttcatggcatctaaatccttaaaaaaaattttcaaaaaaattaacatgataagttaaaatataatatatcacttcagaaatatgtaaattgaaatttaacttatacaagttgtaacaaaaataacaacttgtaaaagtcgaatttgaacctgcatatttgtaaaatgatatattactaacttgtaattttttaaaatttttttttataattatttaggtggtatataagaaactagtagacgttcacctgagagtttagaatccaacttctatgattaattaacagacacgaattaatcgatggtgtttgatttgatttgcagaacgcgatcctggcgccgcactggaacatcaacgcgcacgcggcggtgtacgcgacgagcgggagcgcgaggctgcaggtggtgagcagcgaggggcggcgggtgttcgacggcgagctccggcgcgggcagatggtggtggtgccgcagagcttcgcggtggcggggcgcgccggcgacgaggggttcgcgtgggtgtcgttccagacgagcgacggcgccatgaacgcgccggtggttggcaagtcgtcggcgctgcgcgggatgccggcggacgtgctggacaacgcgttcggcgtgtcgagggaggaggcgcgcatggtcaagttcgggagggggcaggagctcgccatcttctcccccaagtccggcgccgccgcccgccgccgccgctctcccggccacagggacgacggcgtgctcgccgccccggcctgaggcgtacgtagataccagcgtgagcgcacgtgcgcatgtacatgtagtactaataatgtgcacgttttccgttaagggtgccacgcactgcatgcaccgtatgttggcccgtacatgtacggtgtacccgatctagaataaatgaagtcgctgctgctaccaaagtgcagtgtgttaattaagagctcgtttcgctttatcaattaaaatttggcttaaactgtgaattaactgtggaacaatccgaaattttgtcggtcgatcagcgcatgaatctatccatggctgtgttcttaagagcaagttcctaacactcatctctctcattttccacgcgcacgttttttaaattgttaaacggtgtattttttttaaaaaaaagttttctatgcgaaagttgtttagaaaaatcatattgatctatttttgaaaaaaaagttaatatttaattaatcatgcgctaataaactactccgttttccgcgcccattatgcaggttcccatcctcccctagcgaacacagccataatattagttttacatgagctcgagggaggagtcgtcaaccatcgtgtgtagttgctggaagtagggacgtaggcgggtgaccgtgaacttgtttataggtcaaacaagtagtaaacctgcgggttcatgtgtcgtggtctaacttactgtatttatggatgtaattgagtcaacccatgaatctacttatatgtcaaaaatactagtaggcaatacacaaatcaatctgtggcttactcactaattttatctataaatggattctccgggtcggcccacttatacatccctagctggaaggtgagcgaggaggaagagaggagaggggggagggggtaaggaagaaggcaagatgaggtggaaatcacatgctaactcaacaagttaaccacgatcaaactgccacatcagtagaagccattttcaaaaccatgaaaggagttgatttgcaccggttttcaaagatgaaaaaggtatactctttttagttttgcggttgaaggagacaattcaactggggagcaagataggggaggaaagacagacttattcccaatgcgtacagaatactggcccaagtccactaaactgcccaagattgcaggctcacagcacagcaccaggattgctaactcaacaagtcaacacgatcaaactcccacatcagcagaaaaccatgaaatgagttgatttgtaccggttttcaaagatgaagtaggtgctacactcattttgcacttttgcggttcaaggaggcgattcgcgagcatgcctgcagggcgacacaacaggatccccatttacaatgcgtacagcccaagattgcaggctcacagcacagcacagcaccaggattcctccatttccaccggcgccggcggccgccgaaaccgcccgctgcactccggcggccgccaccgtttccccccaccaaaaaaggtaccaccgcctcgctccttaacccccctacccccgaccatgtcgccgcgttctcctccctccaatccgccatggcggcgcccaagccactgtccccgcgcctcgccgtcccgctcgccattgctctcctcctcgccctcggcctcgtcgccgacttcctctggtcatcatcttcctcctctggcacctccggccgcggccagctcgcctccgcttccaggacggtaagcgcttgattccgcccaatgcggcctgccccgccgccgtgatgcagcttactctaccagcctatgcaggcaacggcgaagaagagcggtagggcgcgcgggaagaagccggcggcggagggctacctcaatgcgacgtacgccgacataccggcgccgcggtgggactgggaggagatgccggcggcgcccgtgccccgcctcgacggctactccgtccagatcggcgacctgctctacgtcttcgcagggtacgagaacctcgaccatgtgagaatccccccctcttacaattccacacgggctttgcaaaaatgcattctctcatttactaattttctgctttctgttcacctcaatttcaggggcattctcatgttgatgtgtacaatttcacttccaacacatggccggggaggtttgatatgcccaaggagatggcaaattcacatctaggaatagcaacagatgggaggtacatttacgcgctgaccgggcaattcggtccccagtgccgatcacctataaaccgcaacttcgttgtagacacagtgacaaaagagtggcatgaactgccccctttgccagttcctaggtatgctctatggagtctgtcatcacttaccattggtgcttatgttatgtgttgttgtgtatcatctttaattcttaggctgctatcacttaagcaattgatgcacttatgttgattttagtattgaattatcgatcaaccttagcctagtaatgattactgagcaaatatcaggccaatagaatttgttgatctgaaaaaggctgctatttctgctatgattttaagatgttctaaagctatgtaatgatcttattgctataccatataaacaatcaggtagacaaaacaaacttatgttgtaacaccccttaggtatgcacccgctactcaactttggcgtggacggctccatgtgatgggtggtggaaaagaagatcgccatgaacctggattagagcactggagcttagctgtcaaggatggcaaagcattggagaatgagtggcgaactgagatagccataccccgtggtggacctcataggtttgtacgagtgtacttgttgtcagttgtgccgtttatgcagtttgctaattgatgtgcagattttattagtgagaacacatgcaactgattagaatattgacagtacttcatttttgtcttaactttttacagggcatgcattgttgctaatgataaactctttgtcattggcggtcaagaggg

SEQ ID NO: 25569 - DNA, 4173 bp, Oryza sativa
ataccccgtggtggacctcataggtttgtacgagtgtacttgttgtcagttgtgccgtttatgcagtttgctaattgatgtgcagattttattagtgagaacacatgcaactgattagaatattgacagtacttcatttttgtcttaactttttacagggcatgcattgttgctaatgataaactctttgtcattggcggtcaagagggagacttcatggcaaaaccaggctcgccgatatttaaatgtgtacggaggcatgaggtatgtatgcttatgtaactccttgatgttacaaattgaagattacttacctgcacctgatgtttattcccttattatcaaaatacaagatataacgctacagtttgcattggccacttagtgatattaacacttgatgtttttaactattctaaacaaaaataacagtagttacacccagtgagtacttatcattgttaaaaaaaaaagtgacatgaacttccatataagaattctagttagtagtctctgtttacattttgatttttatgttctagccgtttatggctatagcttgattctgccataaacacaatttgcacttttgcaggttgtgtacggtgatgtgtatatgctagatgatggaaataaatggaagcaactatctccactgccaaagccaaattcccacatagagtgtgcatgggttatagttaataactctgtaataattgttggtggaactacggaaaagcatcctattaccaaaaagatgattcttgtcggtgaagttttccggttcgatttggatacactggtatgtcagttatatgcacctttcatggttatattctcccaagcatagtcaaatgatttgacagataaacatctggaatgctcctttttcagacatggtcagtcattggccgcatgcctttccgaatcaagacggccctagctggttactgggatggttggctctatttcacttctgggcagcgagatagggggcctgataatcctgctccaaagaaagttgttggttgcacgtggagaacaaaactacacctttgatgtggaaagttttagctgttgttactgtagattataggtcagtatctgtttcccttttctaactgctaggctctccagaagctatttttgtcctgtattttgtatgatagattgacttctgattcatagtgtccttgttgtctatattgttgtgcatccacatttcctagatgaatttcttgccatgttcttctaaatggccagaatataatatattaacacaatcattttgccacttcttgctgccttatgtaagatagtcaccttgttggtcgtaccatggactgtatctgcagagttcgaactgaagtttctgttgcgtgttctgaatgttgacgttcctcctgattttgatgctgtctacttgtgttctgaatgataacttgtgtcctgattttaatgctgtttacctgcttgtcttcattctcacgtttggaatcggaataccagaatctaggcatatctccaaacaacccaaatgaacttctgtaacagtattttatagatccaatccatttccaaccttttttgagggtagcagcagtcaaggaatcaatatagatctactgtatcgaaattggattgtcgtcctctgctttgtcattctgttaagctatataagtatatggtttacttatgcagcaaccatttttgtcatgttgcatggctgtttgcacctttgacaatttggtatgttaactggcttcaattcaaggggctaattgactgtgaaacgtgaaccattctgcgctaatattcttttcttcctacgttgcttgtgacgaatattctgctagattgagttgcggctgatttagctactatgtttctttcaagtttcattgcacgtagcagctttagcagataagctttaatatattttatgactatgcttcaatctattttttgcctaccttttcttcttctaccatatataattttcatgtacaaaagggctccacgtcgagttacaattattttatttatttaactaatcatgatagcattggtgcaattatttgcatatttattagagatagaaatagacttcatcaatttaattccaagatataccaactatttcctcccccattttcttctcatttgccttgatgtcaagaaagaatcatttctcctgcaagaattattgaaccccattataatatagttcatgatacattttctcctcttctggtgcagatcatgaccagctgttgggtgattactgatgacactctctgctggatgattgtgactcagtcatttcttcttcttcctttgtgtagcttaaactttgccggcattgacaggggacctgtcacaattaacaatggctaatcatcaccgcatggaactgacttggtcttatcgtcttatttagtaggatttaattaggcccaacttctccgtggacgcccggtctggcggtggcggatgggcggccggcgatgagctcgccgtcgttgtcgccgctgaggcgagctgctcgcccggtcaccgactaccacctcaaatccatgcatgccgatatatattttctgaaagctcacatcatcgtatgatactaagtagggtcaaaaattaaatttggttcgagttaaaaaatgtagctgttcttgttactgaaaattagatatcatagaactgttgtgttgtatatgaaaactttttagtaatcatggcttctaagctacatcataatcatgtagcctcattatttttactaatgaattcctggtctcctggactattttcttttgcctgggtgtgttgctccttttttgccacaaagtcacaggagaaaaaacagccaatcatgggatttgtgttgatggtgatgtgctaattcgattccatttgtgtatggacatatggtgatcggcatggggccaatgattcagtggctctaacacatgtcaagaaaaaaggtgatgactaggatcaatcaaaacacatacacacacaaaatggtttcagaagtagtcgcgagttgcagtagttgctagctacatctagtggttaaccaacttttatctagaggttacgtctaattgcaacagctgctagttactagtagctacatctaactaatctaaggttaactacatgtaactaatctaaaggtgtttacccttttttggtctagagttttcttactgtccccaattcccatgatcacctttttagcacaaaaatcatgtcaacaggggttaaattatgagctgaggttgtttatggcctaacatatatccagcatatgacaaaatgcaaccacacgttttcctttctttttataatagaacaaatttctcagcctctggatttcatttataattaattgtccacacaaatacagtcgcatatttaaaggccctgtttagtttccaaaaacttttttccaaaaacatcacatcgaatctttggttacactcatagagtattaaatatagataaattcaaaaactaattgcacagttagaggagaaatcgcgagatgaatcttttgaggctaattagtccatgattagctataagtgctacagtaacccacatgtgctaatgacagattaattagtctcaaaagattcatctcgcggttttcaagcgagttatgaaattagttttttcatttgtgtctaaaaaccctttccaacattcggtcaaacgtcctatgtgacacctaaaaatttacttttcacgaactaaacaaaatgatcaactactggatatacatctatagaaatacgaacatacacttttcccctaatttgaaaacgatattgatccaaattttataaaatttagaattcgactttgctttcactttgccagtcatgcggatctttctggcatccctcacacgtaattactccacgagccttccactcgaatctgccacgtcaccgacgaacggatgggatcacgccacgtgtcccctacccctccccggacggcgcgggcaacacgcgatcctggccgtggagtggagagatccctttgctcgctgagcactctaccccgggtccactgacatgtgggtcccaccactcgtgtgggcccgggaagtcgctagaataaataggccccacacctctcgtctccggctactcaccc

SEQ ID NO: 25570 - DNA, 11331 bp, Oryza sativa
tcgcgctgccggcgctggcggtggcgctctccccgtaccgcgggcgcgggaggggttgcgacgagttcgaggtgcaggtgttccaggtgtgcgtgcttctgtcgcaggcggcggccgcggccgtcgcgctcgcgtgcgtgtcgagaaagatggccatgtacggcctccgcaagttcctcttcgtcgacccggagctcggcatgcggatccgcttccaaaaggagtacgtcgctaagatcaaggtgatgtctcgccgccttcaaatcgatgtaattttggattacactgaaattcacctagtcattgacttcaattgatagggattagcgagtttttttagataatgatagtgattagtgaggagtagttgctaaattgttttatatttagttaagacattttctcgatgaattactactccactactagattatggcatgaaagtaggtgtcattttactgcaacttgtgcatttgaaggagaaatttgtggactcaggtggaatgtgatgttcagattgtttagcattgaggaaacctggaggattttgaggctgtggttgtaagcttgtgcttgcatctaggttgtaatttagtacgagatcttttgtatggagttacattttttattatggtagcaccttggattcatgggattgtcttcagtgaagggtgaactgcggtgattgattctctcagttatatatgcatttgcatgttgctacttctacttatgcccccatgtgagttgatgtcatgtgcatgggaggtcactttttttgtctgtgccgacaaacctgtttgtgtttttttacatgaagacgcgtcattaggggctgaacaaagaatcgtgctctggaagactcacatttcttcagatatgtctttagcagttctaatgggaggaatcaattgaagcataaagccatacttgatttgttatcaatagacaatgtttggttaggaaatgggcacactctgatttctgtacttttttctttttggaacagaagacaaattaaaaataaaaatgagctgtgtcctgctaggtctatggtctggctgaaactgctatcaccctttgcgtgatgcttcatgctttatttttctagtggatgttttaattgcaaaatttaatgtttaggatggtaataaccatgcatttgttatttgatatgccagagttttgtttgccatattgacatgtgttttcaatctctatggcaggatttcttcagcacaattttgtggtggatattgccatgctttgttgtgaaggtcacacgagaaatgttccgtttctcccatatcttccaagagtcgacttggagatcatgtgctgtactgtttgcttccatcatgtcatggatgtatctgaccacaattatattaacctcctgcatgcttttcaacttggtttgcaacctacaagttattcatttcgatgactatggaaaacttctagaacaagattcagatcctttggtctatttaaaagagcacctgcagcttcgtcataatctctccaaaatcagtcacaggttccgcatgttccttttgctgctcttcttttctgttacagcaagccagtttgccattctgttcaagacaacagcatatactggaccaatcaatttcactaatggtggtgatatagctgtgagtacaatattaaaaatcacataatgttcccttctggttatgtttaaaaacaaaacagatcataaatagatttctcttatgatgcaggtctcttccgttgttcaagttgtcggtcttgtcctttgtttgcatgcagctgctaaaatttctcacagagctcaaaacattgcttcactggctagtcgatggcatgccttagtaacatgctctagtgattctacttatgtaagcacaccaaacagttctgggaaccttgtgccttttccagcacatatgttcttgagagacttttcagaaagtgatttggagtctctggagagtggctcagtacaaggcaattctcatggcacagctcaattggcttcatacatgtcttcataccacaagagggaatcacttggttagtaaatctaaagcttccatttgaagtttgcattgcttaatcttttttcattgtgataacttggaattaatgcataccttactttacaagacattcttttcttttatattgttaagtgttaaagctaacatttcatatacagattttttttttgggtgtcctgtttgattcttatgttttttttattcttctgtgtttcactgcagtgctgtatcttctgggcaacccaggtggcatcacgatatttggctggatcgttgatcggacattcctaaatacaattctgatgctcgaattaacacttgtgctcttcgtgcttagcaagaccgttgtggttccggccaaaacattagttcttgattacatcaggtttccatgatgggggctatcacatctcaaacatctgaatttggtccggatcgctagatatggtgaattgaggatacacatcaggctcctattgccaccatgccagaatccgatctggtggacagaaaatctgatcttctgaggattaaaatcatctgctggatctgagaactacaaggttggtctctcttgaggatttcctgatgaacaccctgttttgccgctaatccacgtcatgccaattttccatgagaaacagagagaacatcatgtaattttgaacagttgatcactgaaactccactctaggctgtgcgctgtgcatagagccagcttcatccatgtaaattgctgtaggcttctcctgtcttttttgttgtgcatattaagatttaaaatttaggggtatagaccacatgatcgatactacaactgaatctaaagttttcgtttatggttgagtggattgttcagatgcaaattttatgcacatctgcatttctgatagaatcgtctctcggtaattattggctcgttgcaaccgtaacatacatgcacttggttgattgatcagaaagggtattttgtcatacggttcaaagtcttcaatatcatcaacgaacaattacctcagcttaacaacagtccaatgcataacctgaattcttattagcaaaaacttcttcatcatgaatatatatctggaaaaaaagatgtgtagaaaaaaaatgttgtgaaataggagtatgtagaaagtgggaaaaggcctcgctgcccaaggttttggctacaaacatgcacctcgaacagaaacagaggaacagcagctgctggctatacacagcatgaacacagagagagctaacaacaacctgagctaccaatctaatcaggatggccccggcgatgctttggatgggccaaaaagaatcaattttgactacatatttctatctggtgaaacctaaacgaactcctactgagagatttggacaggtggaaaaaattcagtacatccctttgaaaacggtgctggtccggcagatgcttgctccatgctcctcgtattcttcctttgtgtggcaactctgaaagagaacatacaaacactttagattccatcttatcactttattcacgtgtgcagtgcatatggtttgcattgacctgaagcatattattgacttattaacaaagttatatggcagaatatgtcatattattaaatttgcagaatgaggtgtcaagactcaaagagtgtaaagtggaaggcacctcataaaattcagggttagaagcagctactgaacccccgaaccaagctgcataactctgtataggatgggcgaccacattgacttcaacaggctggaaccaaaacattagacgaacgaaacactcaattaattgtcaacaaagactcctgagacaacaggttgagacaaaacacaaatggaatagttcaagtattgccgtatgaactcaaaaccaatcatcgttgtacttactttcacctccacatggtgacgggcattagttgcggcaacacgctcatctactatcttctttatgtcattctgaagtctcttgtggaagtccttaaacattgtagatccaccagacaatactatattctgcaaatagtcaaatatcacataatcaatatatgtcacattcttagatgtgtcccagagttcaaacaaagcaccttatacagatctctccttgtgtcaattggcgcagattgaacacagctatcaattagttcaggtagaggagtggagaagtcggcagagtaaatctcgggatggaagaagatctgcatttgcgctagtagaaggttagtaaattacatcaaattcatgtttttctccttttaatgtcatttcaaggtgaagagtccaaatgtcaataaaatgacttctggaggaagcatttatcagatcaacacaaaatttacatttgacccatagttcttattagtcctttttgtgttgaagcccctggactttcactaatactgaatgccctagagaacagaattactcttccaactaatcatacatgttcaatcataacatgggctttcagttcattccaacaatgcacatgatttcatggagtagcacattagacaaacaaacaggacacaatcaattataacatcaaaagctgtaaaaatgttatcacgtcagtagggtagcacgcctgttcaaagcatgattggtatcatgtcaattgtagcaacactactaaaagaacatggaaactagatgatagaaatgggaacaaacctctggtccaagaaaacgctcatatccaatatcaattgtgtatgggactccagtcttgggcttaatagcagaccagtgtttgatatacttatcaggctttttgtcatgcttcttgaactcctgaaattgtaacggaaacacataataacctatctgttcaagataagtctaaactacagttcaatcttgctggtagaaccagaataataatatcatatgtagtatatattagccagcagataaatccatgacaaaagtaacatcacaaaaaatttaatctctgccatccgaatcatgctgcaacttgcccatgggctattctccaggcattaactaatccgtgataatcataacaaaacaaattacaattcacaacaaagttggcattttttttgtttcttcaaacataattgtttcgcatttaaaattcaaaggatgatacagcacgccattatctcctgcgtattctgaaaaaaaaatacagcacaccattcctttcatggaatttgttgtgttgactcgatagtcgatatacagatacttcaacagaaacatcactttcaactatttcatcaaagaatgtatttatgtacaccgttggaaaattacaacaaggtaccctaaaaaacataaggtattattgagtaagtagctccgaaaccaagcagcataataccttgacaatgtctgaagaagtgtagcaatacatttctttcaccctacgagctatatccaaagaatcctcaggtgcaataagttcacctctttcctgcacaacaaaagatgccattaatcactaaaaacattatgtgacaggccacaactaattatagaggcaataaagatctgggagcagcataactcaaattacagatgaaaactgagtagaacattgagaatagtatcaattgttctaatttagtactgtaaaaactactcgatgctcctttcaatgtatttgcactatatgaatgctagatacacacacacatcctgtttatgaacaacatgacttatgaggagaagatgaaatacctgtaaaagctgcaaaacaaactgtgtaacgtcacttcctgaaaatggaaaagacttgatgctactcccaattacgtagccgtttacaaccggcaccacatgtggagctccatccccaatatcaactactacacctgtcatatcagactgacaaaatatactggtcaaacttaacaataataagtagcatggtgtaccagaaattttaagggcatgtaattaaaagggagcatgaatagacccaacagatatgaattatgggtgttcaaacttttgcaaggttggtactggcttgctaggaactacagatctttatcctcaaccaaactggcaactaaaagactaaatttacacagtcatattgtattaatgttgatttctcatagtgcttcaatcagtattatctgtctttcatattgcttaaatatatacttctcttcgcatataacacaatatgcagaacatgtttatttgcataccagtatacaagggaatagcaaaacaaaactgcatacaagaataggaattctaggaacaacacaggcaacaaatatctatggataatatggcaggaacagactggatttttttttttgaaatgtggctatttaaatatcttaaagaaagggagcaaaaacagagtttgtcatagcagggctacatgtcattaaaacaagtttacaataattttgtaatacagaaaattcttttcagtcaaggagatgcagtccatgtggaaacaaatgtctcactggagcaaataaaaagcatgaaaagcagatgtttacagaacctaccacagaaaccgagtcctcatcagaaatacttttcagaaaggcatatccagcagaaagactgaggacagattgaacagaaatatatagtccaggaacattgaaagtctcaaacataatttcccctgcacattcacgactttcaggtgtactgacaggactatcggtaagaaggaagtagtgctcttcaggattgcaccgtagatagttgaaaatgcactgttgccaaaatctttccattgtatcccagtcatcaacctgcaaaagggtaaaagggacatactatagtcgtataacatagaaatataaacaattgttgttattacaaacagaaaacacataaacatacctgaccatgattaattgggtgttttctagtgtacagcccactagatttaaatagtgatagagcctcatcaccaataaaaaaatccaggtcagccatgacacctgcattgtactgtgctatccaatttgcactactgcacatctctgactggtccagaaaagactcattcacagctactacagtagggatggtgaaacatggctcagagttaccagagaatccaagtttgctatacctaaacataagatcatgcaagatggtgtaagaaaacaatcaaacataaccttactggggtgacaatgtgcggccttcaagcaattgcagataaatcaagacacagcttcaggggaaacatctttatcctacaaactatttatatatgttttactctatttcagtatcttcaggtattgcccgattctggtatctaccatttttagcttttcaggaatcaggatgcttcaagtaagacatattttcagacactaaatcaaacccgtcagtcatgagagctgcatcatgtcctggctaattagggagttaaccttaaatgttccatccccacaccccaaacatgaacccaatcctattccatttgcaactaatgcaactaaacaaaaaaggcactccaatccaacacagcatcactcggaaatccaatgatccgaagttctgaactatatgaagtggagttcctactgattgactagaacctcaaggacgcgaaatgggaaacctctgaacgactgaataatccaagccacagatacacgcaacggtacaggcaatccatcgccataacacacaagggacatacgctcgcctcgccgaatccacagcacagccaatcccatcgcggaaaaaccctagctaggcgcacgccgcgcacggatcacgcagcgaagctaacaaccggaggagagcacaacgcgagagggggcaaacaaacaaacaaacgaaccaaccaacaaccgccttaccctgtgccgttgtcgatgacgacggcggggcgcgtggcggcatccatctcgctcgagctccagttccccctcggctcacgcctcctcctccgccaccgccgccgccgcgggagcaggagacgccgccctgtgaaccatcccggggggtgggggtgggcggcgcgcggcgggcgatcgagcggtcagggccggcccggggcgatccgcgacggcaaggtggggagggggggaggagaggggagagctcgtcggcggcgaggaatggaaggcggaggcgttgattcggttgacgagggaagcgggaaggggggagagaaaaggggtgggtggcgtgggcgtgggaatgtgttggggttggggttgggtggtggcgcaccactgcggcgtggggatttgtcgtgttgggtgcgtgcgtgcgtgcgtgggatcggggtcggtcaatacaatccggtgcggtcgtacgcttccgttccagccgtgtggaccaggcacacttttaaggttacacacaaagggggcacttttggggcgcttttctttttataaggtttacacagaggatgcatatagacacaaaaccacattcacaccgtgtacccacgcacgtgtacgtcctgtataggatagagattagaggtctctacggattagtttggtaactcgggagaagaggaatgagagtttacacgaggattggcatggagtataaagactagatcttaagggtgtgtttgcttgtttgcacgtatctgagtcaagcacaaccgatgaaaaaaaagccccatggctaagctaagcaagaaggaccgaatcgaacttcattacttgtcctggatcgacgtgtgtaggcgcgcaacccatgtgtggggttactattggggcactttatttttctaagattacacaaatgatgcatatatagggtagatagtagaggcttctaccgcttagtttggcaggagtataaaagaggaacaggtaacgatattaatatgaaaaaaataattataatatcttgtttggtagagttagtgggaattgacatggagtacaaaactagagactagatcttaagggcataatcggttgcttgtatcaacctggcttgtatcttccaggtgcaactggctccttgtttggttacctacacatgtcccagatctaggcctagctgatgaaagaatccctcgcatcctgcttgagcaggaatgaccgaatcaagattggatacttgttctggctcgatgcgtgcagttgcgcaactcacgttacactcgtgtgggcaaggggttgcgatgggtcaccggtcaccaccctgtcttcctcctcatttctcccccaaaccaaaaactagggtttgttggtgccctccttccacctttgttaactccgatgagctggatctgaggtcacgagcaccgccacgtggcaaatctggcacccaagagctcaagctcgaccaaatcaggtaggaaggaggacaagaggagggagggctcgatcagattccggatctggaagctcaaggggcatctgttgtcgttgttgacctcaccttgtcgtcaccctccatccgatgaactaaacagatattaaaaagcaagtagttcattggttcaaccctcaatttcttatcttcatccctaaaaatccaatgccccaccaaatataacagttgatccaggcaacattactttttcttatcaaaaataagtcagagagagaggagggagagggggggggtagaagttaatgtctgttgttttcgaatgaaaagcttacccgcgtgagtctaggatttggataattgatcaaatatataaaagttcggctatagtataaaatgaatcattatctaagaaaaatagtatgaaatgaattagttttgcttagggaaacatgttctgtgtggtgatcctctaatctgggtttaaaatctagtgtctacaatcatgtacacgagtgaacttttagtgaggattcatcaaggttcatatatttattcatagcctttgcttatgtgagcgtctggcacagactaggagtagtgtatgcttagatgtgtatacaggtctcgtgatgtgtatcaattagggtctattttgcaccattcccatgtgtggtgcctagctgcgctggtccatttccgattacgtataaatataatcatgtagaaattatgtattacacttttaagcagagtgcatattatgtacatgaggatatattatatttaaattatgtattagacacttttaagtatagtgtatattacacatgaatttgatggaacacaattggtcggttggttattggagacgtcaagcactccgatgagttgttcatttggatgcttgttacttatacaaatggacacgcaacactaacgaggaaaggtttttcaaaaagtaaaaaatcagtgttattttatgaaaaactttcaaaacgccgcgccgaaaaaatcaggcgctgtgcctaccatgcgcgctcccgcacccccgcgctgtccccactacacgtgccgttggcctgttacaacaaatcacccatatattacggaaacgttctattgagtgaatctgtttcatttgttgttccaccaataatgtttcagcaagtatactcgtgttgtttcattatgtatagatcaaatgttgcagtgaattgaaacatattttcgctatttgctgaaacattgtttttatatacggtgaaacaactttaaaaaccgttgtttcatacgttgtagtaaaatgtttcatgaggtgatttggttgtgttttagttttttaaatgattgaaacattttctatctacttagtgaaataattctgatctacttggtggaacatcgcccggtttttgcaaaaaaaaaaaaaaaaatcgggcgcccgatttgtaggcgtctcgcactatgtgaaatcctcctcggggataataatattattatctctcggcagacctacctaaactggctttacgtgtagcttacctttgatcattgttcgtgttttttttgtataaagtgtgcaataatctgactgcagctcgagttgatcgtaccttttaatagccggccgtcatggtggcgacgactcaacaatcacatggtccctaagattaaccaaaaattctttaaatcggggtgcccgatgcgggcgcgcatgcatcgggcgcccgtgcctacaccgcgcctccacgccgaaaaaatcgggcaacagtcctcctgtgcgcgctcccgcgcccccgcgtcgtccccaccacgcgccccaccacatgtgccgttgcaacaaatcaccccacatatcacggaaacgctatattaagtgaatccgtttcattttttgttccaccagtaatgtttcagaaagtatactcatgttgtttcattatgtatagatcaagtgttgcggtgaattgaaacatcctttcgctatttgctgaaa

SEQ ID NO: 25571 - DNA, 13627 bp, Oryza sativa
ccgttgcaacaaatcaccccacatatcacggaaacgctatattaagtgaatccgtttcattttttgttccaccagtaatgtttcagaaagtatactcatgttgtttcattatgtatagatcaagtgttgcggtgaattgaaacatcctttcgctatttgctgaaacattgtgttttatatacggtgaaacagcttcaaaaaccgttgtttcatatgttgtagcaaaatatttcgtgaggtgatttggttgtatttcagctttttaaacgatttaaacattttctatctacttagtgaaataattccgatctacttggtggagccgtgcatgatttttgaaaaaaaatgggtgcccgatttgtaggcgtctcggttattttagccgccccctaccttagatcattgttcgtgtttccggcataaagtgtccaataatccgacactgcagctctgtcgacgggggatacccgtagaccggatatagagagtattggggtatgttggaacgaggatctacgtaatacgacatcaagcaaatgaaagacaagattatactggtttaggccccttgataggtaatagccctaatccagttggtatgggattatatgatggaaatcacaaattacaaagggaataatggaactcgatgataccgacgagaccgtaatcgagttggttcgactagatcacccggcgacttggctcctgtaggcttcggcttcgtaggctgtggtagatgtgttggcggtgagatttgatgccctcagtcctgcccagggggtcccttttatatcgcggatcagttggtctccaagtataactcggagatatcggacccctcacgatatggcaacgacccagttctgtccgagtaggactccttccatctgtgaactccgtttctatcacgtgatagatttccttaacgtacgcagaaaatatccgtatacgcgcgggtataccgtatcagtatacaacgtatatctaaggatagagggtataccttatccgtaactctgacaagctcgagttgctcgtatattttaatagccgaccgtcgccgtggcgacgactcaacaatcgcaaggtctgtaagattaaccgaaaattcttaatattggaataatacattattgaaccgtaataccggatataacatatctttcaatttacatgttcacgttaaaagaaacagaaaaggagataaggtattacaaactgagggacacattatatctggtgctgtggttaagggaagagattcaaactcaacgtcaaacatgagggatgtaaagtaaacatatttctattacgcgcggtacgatttggacttacgtgcggcccaatcgattgcgtttgttctgaacggcccatggaagcccactattgctgctcccttgctccctataaatagctagggttttacgccacggcgcacgcctccaccgccgccgccgcagccgccccattctccaaccctagccgagaggagcagatcaagcaatggtaaacctcgcagccgccgccgccgccgcggcctcctcatggcttctccatagctctaacgtggtgatcttgttgtggctcgcagggtaagggtacgggcagcttcggcaagcgccggaacaagacgcacacgctctgcgtccgctgcggccgccgcagcttccacctccagaagagcacctgctcctcctgcggttaccccgccgcccgcatccgcaagtgtaagcctcctcctcatgattcggtttccccactagatcttgtatttgcttttgggttgccatgtagatttgatgatgattatactgcgcctagatgagccaattaatgggtagaaatcggggcttctcaagctgagatgcgttctcctacctgaaccctctttgtagagcgtggcatttccggcattttgatggaaatgaagaaaactttggtctcatttttatttttattgtatgtattgggcattatccatcctcttttgatctgtggtcctgacaagtgatttacctgctcggctgcgttgatcttaactgaacaaaatttaatgtgttgtttgtacacatgttttttttcacaaatgattataagctaaaattcttgcttggaaaacataaggatgaccattttcgtatgaaaacttaattctgtttatgagggtcaggtgatgaggttttaactgcaacaatatgatgggagcttagctcctgtgattcctatgtatttaagtctctgatgatccttcaaacatattttccttttgaaaggctcttgaaaacggtcagtattaacgtacaaaattcaagcactgatatatctcatatgtcgtaattgatcacaaatactatgttttttctttgcatttgatttcccaaatgattttgctgtcttacaaaaaaaatgctatgaggaatcatgaaaactttcgcatgtcagacttcagagatgccatggcatcaatgagaagatggttttcattttctgagcttatattttattcaggctatcacatttgattaaatgatttgtgcagtggttatttagacttttggaaatttgtaacactttgaagttttgtaccttcactgtgtttatgtatttccatgttgcctgcttctgtcatgaggcaggctcaagtgatgagagaaaaactgcaacaatatgatgggagatatgctcctgtgattcctaagtatttaagtctctgatgtacccaatgcacatagttttttctataagtactcaattttccctttcttatgttttctttcgacatatcctctaaccttatattttatttattctgttttctttttcttttctgagatcaggcaattttattatatttgctctttttcaaccttcagttcaaacatatggcaattctatttgtcattctgttcaccattatgtcaacttgctcctgctgctgccttgtttaatgtatggtagccagtacttggttgagttgtttggtttgtaatgtaaccatttaaattcgtatcattgcatatatgtttccttgcatcgttcatttaataccaaatacacattaaatgaaaacatacttagtttgagttgtattgtttgtggttagcctctaaatctctagttagattctgtggttgaatttcttttgtctttttggatttgcttagttttaatttctgcgatgtcatttcagacaactggagcgtgaaggccattaggcgcaagaccacaggaaccggaaggatgaggtacatgcgacatgtgcctaggaggttcaagagcaacttcagagaaggtgtctgaaacttttctgatgttttaaatatcatgggaaatgttaattgcgttaaaaatagcaaagttgtttggattcattatgttccttttgttctatcgattcaggtactgaggctaccccaaggaagagagctgccgtggccaactagatccgttttgctatgaaagcagctatgaaactagaatttaagaacttttgcctggattgtgccatctctcctataatatgatgtactgatctgattttatttgttacggtgcttgaaaacttgacatctgaaatatcagtcagttgaacctctcgtatttttgtttcataccatgttcgttgatgtctgcaagtgtccatgttagcggtgtattttattttgttccatggtgtctccgcttgttttctgctgccattcaactaattttagggcatgtttggcacaactccaactccggcaccaccttatctagagctggagcttaaccaaacaatttcaactccacctaaaatgggagtggagttgggtggagcactgtcacaaaatgaaccagagggggagctgggtttaggctgctccataactccaccctaacctaactcctagagctaaatttaagagttggagctctaacaaataggcccttaggaaatctcctgttgtccctcttgggaactgacaccaggattcacaatttcgatcggttttgaaagccattttgttttagttaaaagcagaatgggactggttttcatctcgaaacggtatgtaaaacctgactaccatcctcaatttccagtttaactggaccaattttactaatttcttaaatgtaattttactaacaaagttgcttcgggaagtgttgcgttcattagcaaaaactaaatttgaaagtatattagctaggatgtaactacatctagcatgtgaaatacagttatcagctaaaactgacttggagtaaaatgtaccccaagaaatacagtttggcggaagctaaaaattacagtgcaagtcatgcgataaactgttatcacggatgtggaatgttgttcagcgtgacaacatttcggaatcttcgagcaaacaaatgcatatgtttgttacaaccaggttagtcgaaagaaacatgaaacagagaacgaaggcgcgtaaaatgcagcttcagccaggcaatgcttcaccttcactgctcagtcgaatgatatattcagattttcatacggatggatgcctgcctggacggcggatcccttggtggcggtcgccgcgttctgtgccgcctgcgccacctgctcaccagtctacattctcacgagaaaagattagagaagtttagaatagtcacctattagctccaaattatatatagtcaatctaatagcttatccataaaatatagttacttataagtgtatattacactattataatatatgattacatctttcatacacacacaacacaacggcgttctctcgtggcaagggatggcaccagtcatacctatgccatgcccaaagtaggtagagtattcgagcatatggccatctcagccttgatttcagatgctaattatgtgattagttagttgtatttcatttggtacaagcttattcgtttaattaacaggagataaagacctatagtgggactgccttgtgtctgcacaaatgaatgaacaaatctagctaacaacaaaatgttaatcggtaaaaattgaatgttaaagaatatatgtgtaacttcaatgaatgtctacttattatgaataaacacacctagaaaacaaaacagagaaacactcgtggaaatgtagtttagttgtagaagttatacgacgaatttataaggcttcagttgtaaaaactgcatgacaaatttaggattataatcatccttaatggcatatattctaataagtgctgacatattatagtttgtgtataataaaatgttgcttcatttttaaaataccatgcagttagttctggtgtgatgatccaccatagctaaattttagtgctagatctgccattgacacaacatattaaagtccatgctacaaatctgtagtcctctcatcttttattttttttccgcatgtgtttatatttgacttatttttttccgcatatatttataagtgacttgcagcctactatgatacttgctctaatacacttccctgattgatggttacaactagcacttgcatacggcccacggccctaggctgtcactgccaagaaattcgagtcaccaatgggccgtattgcagtgtaatatctccgtctcaaattatttactccctccatccacaaaagttacacctatttcacatttgatttttttcaaataagttgttcctatttgtagtctttatgcattcaagacttaaatgaagagataaattaaatgttttattagaacccaaggagtcatctaaatactcattggttgcatgcttgtattcactccttgattttacaacatccgaggtgatttaatttctccttggtcttggtgttaaaagtaatatgtataactattgtggatggagggagtattttttaaggttgtttggcatatcctaaagtttaaaacaaatgactataatacccttataaaataatttatggttaagaacaaattactataaactttataaaataatttatggttgatgatagaaaggtggttgagaggtataacagtgaaaattttgaatggaatgtggatggcgccggcggcgtccgtcaccgcctccaccgcacgtcgcgcctggtactgcgcatccacaaacctcacaccaccaccatcactagctcaacaacaataaaaaaaaagtgcagtaatcaatcaaaacgatgatatataattcacctcgccctcggcgtgtgccttcccggactcgaaggatcgctggatgttgctccacacgcctgctgccgatagatgatttgttgattgattactttctttctgctagcagtgtaaatctagacgaaaaacaatcttcttgcctgctttgttatatcctgattcgatttgtcaggattttgggtggcgatccgtgaatcaatctccgctagctagctcattcttaagttagatggcccataaataggagctgtaatcttttcctttacatcccatggttttaatcttataatttttcttctgctctatcaataaaatttcgcaccgtcttatgcgagtcgttaaaaaaataagaaaaaagtacgaattatccctccccctgaacaattgcggtagtacgatttaccccctaaactacaataccggacatttgacaccccaaactcttaaaaccggataaattataaccctaacttgattcaaagcggttttaagcctacgtggcacacacgtggcgatacacacagcaaaaaccgctgggacccacctgtcagtgttttttttcctctccttctctgcctttctctctcggtgaacagaggaggcggccgcgggcggcgggcgaggagctgaggccggcgcggagcgagtgcgcggaggcggccgcgaccagcaggcgaggagtcgaggccggcggcaggcgggtgtggaggcggctgcgggtggcgggtgaggagccgatgatggcagccggtcaaggcggaggcgggtgcgggtggcgggtgaggagccgaggacggcagccggagggggcgaaggcagggtgacgggcaaggaaccgaggacggcggtgggacgtggagtgaggcggtggcgggatcctccttcccctctatcgcagcggcgcgggctcctccttcctcctcgtctcgtgccgccgcccactgaccgcctgctgtggacagttcgtccgtctcggcttcctctctgcggtgtgggcgcgaacggcaacgactcggtggtggcgacggtagtgggggaaaggcccatgggggcggcgagggtcgtcgctgccctgtacgacggtggcgctcgcgctgtggctgggtggcatccgaggagaggggggggggtatgataggtgggcccaagaagggttttttttggctgactggattgctatgttggcgccacgtgtgcaagctcaattcaaaaccgctcaaaacagtattgaggagggtaattcgtccggtattaaaagtttagagtgagtaatatctggttttcggatttagaggggtaattcggtcgaccgcaatagttcagggggggcgataattcgtactttttccaaaaaataaataaataggagctgcaatattggattggagaatatgaatattcacatggccctttcgaaagcttggttttaatcctgttcatctttttcattcttaattttcctactcggataaataaataagagtaattaaccgagtgggctgtttattcacatgctttcaaattgcttacattaatctacattatctatgtctaatccttacagaaaatggttggttggttggtttgttacaagctcaaaattcttacattttttagaataatctacatacatgaacaaatcattaacatgcagcagggccgggtcctcaggctcaggcctagcccaatacggaaggccgtaggcccgaaggcgaacagatgcgccaccagaacgcgcaccggcgcacgcgccatgccgcgattgccaccgcctgccgcccacgtcttctgatctcctcctcctcacggcgccgaaatcgcgtgcaatccccaggtccagaggccacgcatcggcgccgactccgcggctcacggcttcccgttttccgctgctccgcgcgacggcagtagccagtaggccacgaggtgctggtgcagccgctgccggttgcctgccgccggctcccggctgccccctcgagattggacaaggaggattctattcaggtgagtgcaacaccaatacatcaatacatcatcactaattttgtaacattgtgattatatctgttaacatgtaaatagctatatatgtgcccgtgtactgatgtatagtcctatattagggcaattcagttgtcccgatagttggacaaactgacgaaggcactagttgtgtttccggctcatttgcggtgcgcatctggacgctcgcgataaactatttggtaagattctaaatttagatttgtaattttgtagtgtaatttatatgagttaaagtactataataacttttgaggtaacatatgttttttatataaatattatttctaaatgcaatttaaatgttaacattaataattcagtatatgtatctattgattattattatatagtatgaaagggcctctatatttactttcgcgctagggccctgaaaagttaggaccggccgtgttaacatgcaccgcagaaaaaaagaaagaagaaagaaaattaaaagaaagaagaaagaaaatggacacagctagcttgctctttttttttaatggaaccaacacgagagtgtgccttttcattgaatatagtgggagaaaaatacagcccctaggggcaaagaaaaggcaaaaaccaaaaactgtacactatacaaggtgcgggataagctcgcgcaatctcttagcacccgctaacgcccacatgccagcttattcttttatttttgcaatgaggtacattaatgttgtggcctctttgtgctcaaagattcgccggttgcgcacattccatatttcccaaacaatgtggaggatcagggtgcgtaaccccttcttggggatgcccgccgaagcggctagcatttcccaccaatctttgattgtctgggtcatctcccaatgccagagattgagctgaacccagtccgctaccagtctccaaatccttttggaatatcgacattccgcaacgaggtgaaacgccgtttcatcctctcccctatagagggggcgctgcccgttgttctgccatcccctgtttgtgagccggtcagaggtccatactctattctagatgatgagcatgcatgaagcttacattttccagacacccaagctctccaaattaatgggtcaaaggtcgtgtcaagcgtgccaatgcactgtgctttgtaggctgacgaagccgagtactacccgtgagttgtgaacttccatgtgatttggtctggttctccttcatccagatgcatgccatggactgcgatccatagtgccacgagctattccacaaaagtcgccgtgatttgcgggtttgtctccgagaccaaatctccgatccagtcatcgtttttcttcttggagattgcatagaggcatgacgtcttttgggcctgcggccgtccagctagcttgctcctagctaagcgtacgtagtcggagactcggagtccggcgtcgtgctgaacaccggcttgtccttgtccacaaccaccgccgccgccggagtgggggcttgggcggcggctggtcgccatagcttcttcacggcgatcacggcgcgcgtgcgggggagctgatcggcctttttagactacaccggtggcgcccatgcccaccatggagcacaacccgaagcacggcgggagcacgccgccgcacagcccggcattgccgtcgagctcgtcggggttgatcgacagtgggcagtagctgctgctgttactgctcccttctgacaaggggattattggttctttgtttggcacatgtccccagtagaatgtcactgctattaccacatcagattgaagacaacaaaagcaagtaattaaatgggttaatacaactaaggctgccaaaactgtcaagaggataaactgctagtggttagcgattagaagtaaatttggactgctgggttgccatatgtctacaagctacaacaggcgcacaagggaaaggagcactttattctatatttcatcaagcaaaaaacccttgcatgttcaatattctaaaaatcggcgcagtcatcacctcggtggtttttaggtgcctgatggtgagtccctgctgccctaatttttctcaccgtcgagcacctagctaacagccaccgatgcagcaagggctctcaacggcgagagatatgtaaggagaaaaattaggccctaatcggcgtgctaggcagggtagccgcatttacctctaaccactactacaaaatcctaataggggacgtgtgcagatttctaaaaaaccatcacatttaacctcttcacaatcttcacatgagtctaagattaaaaaacgatactgacatgcctttataggtgcaagtttaattaaaaaaaccagcacatataaatacatgtgctattttttttaaaaaaaatcagcacctagaagaatatatgagtaccggttttctaaaaaccgacacgtttgtgaaagccgagccgatgaaaaccgagctgacctaatttttcttctcgccctcctcacatatctctcaccattctcactgctctccgatccccttttctgtcctcgttgcctccgccactcctccccctctcttttgctacctccttgcctccgccgaccctccccctctcctccacctcccttcccctgtcttccgtcgccccttctcctctcctcctctctgctcggggacggccagatccgccgccgcgtgcttagggacagccagatccgccgccgcacgctcgggggtatccggatccgccaccacaagcacggggcagcccatttaacgactactgtggctccctcaactccctcaaccaccgtgtgcttgggggcggccgaatctaccaccgtgcacacgaggacggcctactcacaacagcggcttcctcaactccctcaatcgccacaggcacaggggtggctgctcaacgacgacggtggctccctcaactccctctttgtgttctcctctgtgttgttaattttgctcttgaatgttgattttataattgtgttcttggatgttgatcgattttagggatgatggagagttgcttgatgcatcggctcgaatcgagcaacctttgttttggattcgggactctcaaagatgtcggttcctaaactggcacctaagattcctcctcatcagtgccacctatgaggtgccggttggaaaatctggcacctacgtaggattcccaactggcacccattagggtttatgtagtagtgaatgtttaattattagtatatatcttggtttgaaagtaaataattgtatgtaaattatgtttatgcaaaagttttcaaaattgaatttgttgaaactcctacctttctcaccaacgaacaataggttggcacttccaaatgatgttttgcatggacaagattggttgtgaatgattgatctacgaatgctaaaaggaaattgtgcctaattaggagtttgtaaggctgttttagcaagagataaattcttataatcgcaagaaaaaatctgcacctgatttcttactcttcttgccatatagtacctttacatgtttgactgattccaaattaattcccaagacgcataagctttccaattaatctatactactactacaaagataaaatatatataaaaaatgtcctccgtcccataatatatgtgcttttgggtggatgtgacacattctaagacacattctaaagaggatgtgtcacatccaccaaaaaatccctgagtactttcttagtgtttctatattatctaaaaaaaatatgctatttgttaatctgcactatatattaactgcagggtcatcgatcatcattggacaccaattaagcaacagcaatggcgtcgaggagcatatcaagctgcacaactgagacggcaaaaggcatccacaggttcgagatcttcagttacagcatgatgaacaccgaagccgaagacgactccatccggtccggcgtcttcaacgtaggaggattcgattgggcgttgctttactaccctgacggcatcgacgacgacagcaagggctacatcggcgtctacctcgagctgatcagcaagaacggcgagccatgggcactcgtcgacgtgaatctgatcaaccagctgcaacccgggcaacctcgtcagctgttcaccaagaccgatgtgcctaccccgttcagatcttcaagctttcaggagtctaccttggggtctctcaagtgcatgaagaggagcgatattgagagcactccagggttcatcgtcaatgactgcatcgtgatcgaatgcaatgttactgtcatctatgagccaaaagtgtctaaaaccagggcattgtgtgacgctgaaactagttcggcattgcgcgagatcgaggtgcctcctatggagatatcgtcggatttcgccaagatgttgaaggacggtgtaggagcagatgtgacattcagagttggagaagacacattccgtgcccacagggcggtgctagctgcgaggtctccagtatttcatgctcagctctgtggaccgatgaaggagaagaaggagacacaaatgcaggagataaccatccaagacatgcagccatctgtcttcgaggctttcctctatttcatctacaccgattgtgttccaagaatggatgatcttggcaatggtgagaagatgcatttgatgatgcatttgcttaaggccggtgaccggtatggattggagaggctcaggatcatgtgcgagagatttctagctacgaacctcgacacggagcatgtatctgcgatactgggtctagctgacttgctagatctcaagaagctcaaggaagcttgcatggagttcatggtcccatctgagagaatggatgccgtggctgcaagtcaagggtaccagcagctgaagagagcatttccctctctggcgtttgaagtgtgggagaggaggagccgtgttcgcaggaattaattaacatcttcttgattcagaagatatatgtgcgcgatgtctggagatttcctttttggttatgtttgttttggtacatttgatgatctgacgaatgttctctcaacaatgtgatgactgatacggtgcacgcgtggttgcaccttaatgtaatgtggctatctggatcatgcaaatggttttacctttagatcgagttgttttttaaaccttactctcttaccaactctcttaagtttttatgctagaaatttgccccatcactcctttttatcttaaattgcccatgagttgctactcgtgttttgatatcttgtgtgttcactttgatactatttttaaccttgctaaattttgtcattattaaaattcggcaatgtagcaaaccaaacacactatcaccaacatattcctcccaaactgtagtagttttattaattttcgctataaaaactctaaataaatttggtaatgtgcctcaaacatttttt

SEQ ID NO: 25572 - DNA, 3958 bp, Oryza sativa
  unsure (1)..(3958): unsure at all n locations
nnnnnnnnnnnnnnnnnnnnnnnnnnnnnnnnnnnnnnnnnnnnnnnnnnnnnnnnnatcatgcaaatggttttacctttagatcgagttgttttttaaaccttactctcttaccaactctcttaagtttttatgctagaaatttgccccatcactcctttttatcttaaattgcccatgagttgctactcgtgttttgatatcttgtgtgttcactttgatactatttttaaccttgctaaattttgtcattattaaaattcggcaatgtagcaaaccaaacacactatcaccaacatattcctcccaaactgtagtagttttattaattttcgctataaaaactctaaataaatttggtaatgtgcctcaaacatttttttttaaaaaaaatgtgtctcagaaaatgtgctcaaacatttagtttgtctttagcactaccagagtgagacacacacacacacacattttggttttccatcgaattattatccaattccatatgaatatcgatctgatcgaacttgtttgattaatctattgcaaaatacttggagtcctccgtgtcgaatggaccaaatctccatatatatagccgcatctacaaaccacttttttatgagaaaatgtgacacacacacacactttgctttcccgtcaaattcttatccaattccatctgaatatcgatctgatcgaacttttttgattaatctgttgcaaaatacttggagtcctccatgtcgaatgtgacacacacactttgctttcccatcaaattcttatccaattccatctgaatatcgatctgattaaacttgttcgattaatctgttgaaaaatacttggagtcctccatgctgaatggaccaaaactctccatatatagccacatctacaaaccacttttttacgagaaaatgtgacaaacacactttgctttcccgtcaaattcttatccagatccatctgaatatcgatctgatcgaacttgtttgattaatctattgaaaaatacttaggagtcctcagtgtcgaatggaccaaatctccatatatatagccacatctacaaaccactttttcttatccaattccatgatcgaacttgttcggttaatctgttgcaagatacatggagccctccgtgtcgaatggaccaaatctctttatatataaccacatctacaaaccacacgtagattgaattggtaacaatggagacggcgccgtcatcgtccatgtcaccggccagcggcacgtacgtcttggacgtccacggcttcagcggcctgaggaggcagcactgcggcggcggcggctgcatcgtctcgccgacgttcaccgtcgccggcctcgagtgggccatccggtaccacccggagggcgacgccgacgaggtgaccgacgacgtggccgtgttcgtcgtgctggtcaccaaggacgccacggcgtgggcgcacgtgaattccggctgctcgaccaggccgccggcgagatggtcaccttcttcggggagaaggatccgatcttgttcgactccggcagcgaggacctgtccacctggggcaccggcgagttcgccgccaggagcttcctggcggctcgccctacgtcgccggcgactgcctcaagatcgagtgcgccgtcgacgtctgccgcgaccgcctcacgttccaccacgacacgccgccctccggcgagccgttccgccagtaccccgccgacgacgagccggccgacgtcaccttcaagatcgccggtgagaccttccccgcccatgtctccgtgctcgccgcccgtgctcccggcctgctcaacaacacgacgtcgcaggcggcaaccatcaccatcgacgacgacgacgacgacacgccggcggcggcggcggcattcggagcgctcctccacttcgcctacaccgacacgctccccgtggcgagcggcctcgacggcgccggccacacggcgctgctggggcgcctcctcgtcgcggcggggcggtacggcatggcgaggctgggggcgatctgcgagcgcgccatgtgcaggagcctcgacgcggggacggcggcggacacgctggccatggccgacggcacggcttcgacgcgctgaggcggcggtgcgccgagttcatggcgtcgccggacaactactacttcgtggcgggaagcgtcagccatgggcgcctctccccttcactccggcgagaggtttggaacaagtactatgacacgtgttgcagcagatacgaggagggggcccacattctgacagcaacaaagattaagctaagcaaaaaaaataatacagcagacaatgtggttgatatatgattcagaaattgtaaatatgtagaaagtagtagaatttcttatttacgatatagcgttattaggacaaccaaaatattgtttttattggtcaaggacttttttatccaccactttcaatggtgagttactaataggcaatgcttaatgtgttttttttttttgctttagtacaccatgctagtatatttctatttagtagagtatacattgtttgcttagagggtgtttagatcgcgcggggggggggggtggtgttaaagttttgagcgtgtcacatcggtcatcgagtattatttagggtgttgcatagggtgtttgggcactaataaaaaacaaacaaatttattaatcctaattaatccgtcattagcaaatttttactgtcgcgtaccacattgtcaaatcatagagcaattaggcttaaaaaattcatctcacaaattagtcataatttgtgtaattagttaccccctccatttcacaatgtaaggcattctagcatttcccacattcatattaattttaatgaatctaacatatatatctatctagattcattaatatcaatatgaatgtagtaaatgctagaatgacttacattatgaaacggaggaagtatttttttagcctatatttaatactacatgcaggtgttaatcttacttaagatgaatttggccgattacagaactacctaagatgaattttactgtcttggttttttttccctttgaaatgtggctattgagtaatactaatcaatataagtttggcaattaccgcttgcaaagtctgctttgtttttgtagctgacttgtaaaaattatgggcagtagtatttttttttccttgatgaattgcaccgcacaatctatagactcttcgtgcacctcaatgtcgtgtaaaaatgatggccaaactagaagaaagagagggaaaaaaaagagagaaaagaatggacgcttcggcttcgatgtctgacaaatacagttaaattctctcgacccctcttgttcttcaattttaaaaaaattcaaaaaatcttcacatcttgagattccaaacttgctactagtatataaattcctccatggtcatcagctcgatcggtcactctcagcaagctcgatcagattcagagatggcatcgtctcgccccatctcggagagcaccatcacgaggtcgacgtgcgcgacgcggacggcgcgcgccacgcaccagttcgagatcgtcgggtacagcctcaagaggtgcctcgccgccggcgagttcgtccggtcctccgccttcgccgcctgcggctacaggtggtccgtccgcgtctaccccggcgggttcgggccggcgcaccgggagttcgtgtcggtgttcgtcaagatgatgaccaacaggggcaaggcggcggcgcggttcgacctccggctgatcgaccgcgccaccgggctgccccgctcggtgttccgggcggcgcagccagtggtgttcgactactccgtcaagcacaagaagtgcaagggcaagcggggcacccgcgcgttcatgcggcggcgcgacctcgagtcgtcggcgttcgtccgcgacgaccgcctcatcgtcgagtgcgtcatcgacgtcgtcg

SEQ ID NO: 25573 - DNA, 20484 bp, Oryza sativa
  unsure (1)..(20484): unsure at all n locations
atcgtgctcgccatgcgctcgccggtgttcatggcatcgctgtacgggtcgatgagggagcaccgcgcgccgcggatcgccggcgacgacatggagccggaggtgttcgacgcgctcctccgcttcgtctacagcgacacgctggcgctccccggcgacctcggggaaggcgagtacaaggagatggtgcggcagctgctggaggcggccgaccggtacgccatggacaggctcagggtgatctgcgagctcatcctctccaggagcctcgacgccaagaccgtcgcggcgacgctcgccatggctgaccagcacagcactactgcgacgcgctcaaggatgtttgtgttcagttcatggccgttgggttggatgaccacaattaatgattgatatttgaatatgatactagttgagtgcccgtgccttgctacggggcaaaaagtatgcatccattttaagttacattgaataaaataatgttaagtaatcattaagtgtaaattataacaaaaccttaatatagccccacattcaaagagaccactcaatctccacacgcttaacctacaaaattcatgtttatgtaacgttgcaaaattgataagaaatgtatacattaccaaattggatcatctagccataaatgacaaaaacaatgtatacctttcatattgcccttccattatatcgatcacaataccttttaagaactatcaaccatctgaaaccaatgaaaatttaaagctcctcgcaacactaagaacctctatccaaaatagtgctacaaggggatagaacggcatataaccttataggtttcccttattggaaggaagtgtattttttgcaactcaaggtgatggttatttgcaagtgcttcaaattactgcgcctaagttgatctagatcggctatggcactcgagcttgtcaatgaagaaacctttaggctgagttcgtttcaaagggttcccaacccctgtccctcctccgcgcgcacgctttttaaactgctcaacggtgtgttttttttaaaaaagcttttatacgaaagttgtttaaaaaatcatattgatccatttgtttaaaaaaatagctaatacttaattaatcatgtgctaatggaccactccgtttttcgtgcacaggagatttgttcccaacccaccccaacgaacacagccttagaatggtatcgaccaactatgggcttctcaatgatttgtataactgctagacaactcactcataccagggtctttattctagatgctcagcaagaaattattagaacaaagcttaatattacagtccaaaaaggtacttacctgtgtaccataatgatatgaaaatccttgcgctgcaaacataatacagaggaacattgttaaaatctacaataatgcatccattgttaagatatacaaacacaggatgtatcggtgttaaaactaagggactcaaataattgtttaccagataacatatttgtttgaatcatgtacagatgacatcgccagttctcaacaaattaaagtaaagattctagccctagcacttggggaaagcatacacagaacagatcactcctaattaagtctcaactttaagaaagccaatgtttatgtaaatacataatgtattaaagacattttccctgggttacatctagcattctggcaaaagggctataatattcagttgaatgactaataaaaacaaatattttcagtgctgtaagcagaaatcctttggtagtaatatagatatgctggcacgatatcttacttttcaaaaaagtgacaaaagattcaatgtttatgtaaatacataatgtattaaagacattttccctgggttacatctagcattctggcaaaagggctaaaacattcagttggatgactaataaaaacaaacattttcagtgctgtaagcagaaatcctttggtagtaatatagatatgctggcacgatatcttacttctcaaaaaagtgacaaaagatttaatccgagataaggatatactgatatacagagctctaaaacaatcaaagagaaaaaaaaggagatcactcagctaacacctcatttttgccttcaaagaggtggagaaatcaagcaataaaacactgcaggaaaacaagccactacactcttactaccttttttgttcatgtgaagaagggattaggccattagggaaagtcagaaagagataaattggtggcaaataaacttactcagattttaacatgaaaataaaccaaagaaacaattttgccaaaccatatgctattagcaaaattgctctaacatatcagcattacacacgtacgtctcagatgtttaggtaaatatccaaacttatcccctataacatgcagtgatacaggcaaacatgcaggagcaaaatatttccaagccattgacttacagaaaatcagccaaccggtttgcaagcaaatctctgctgctctactgtcactccaatgcatcagttatcaattcaatctgaaatacgtgcagcatgagcataacttgatgaacaatatataggatagataatctgcagcctatcagttgctttccattgtttatttcatatgtagcagatgtagaaaaaggaggtaggggtgacaacagcgcaagaaaattttggagcagtagaacaccatcgaacacaacagcaatgactaataagatggactcacattcatggtgctgactctcttcctgctctatcctctggaactgcctaatttacctgaacaaaagaagaggaattaacaaagagaagtctattaagcataaaagataccgaactgtggtggaggggatggcgaggaacgacacaccggccagcagcccattttcaggcagaggattcagatcgagcgtcagcggtcggacttggagatggatgatttgcctgaatgccaggacacattgcagcctttcaatctagccgcgtgcgcaaaccctagggtcctctccagccgccgcagtggtgcatggacctccgcgtgccagtgtgccacggtgctctagcgaccatactaaaatggtaaaacctcaccgctgcccactcaaggccgcctcctccatcgttaccgaccagatgaatggagcaacggtggcgacggtcagggagatgcggcatggatgccacgagcggtgggttgtggcgtcggcgacgaactccactcgtgagcgtagggcacagcaaaaatggcgacgatgccctgttgcggtggcggcggcggtcgagggcggcgaggagggagcacggggcggcgatgaggcggcgcggtcaagggacgcgtgggagggggcgcgggtcgcgggggcatcgaccctttttacgcttttttccttccggatcgcatgtacccttttttttatttttgtcgctccaaaacgtgtggatgtacgtttctatgttggatcgtgtgtctattttagcttcaccatcatcaatccgaatttttttagtagtagatatttgaatttacttttctactataaagattttgttgctataaatatgatctatgagaaaataatagtttagaagatggtatcaaattaaactgtggccttctatactgtgaaacagcgtaactactcaggaattagagtttgaccgggtcttataatgtctgacaaaggtcctacttagtactccgtatatgaataaaactctagtatatgtttgtcataccgaataaaagtaattagtttctatctatatctctaaacttacttaaaatctaagtcacatatatgctcttatatataccggcctctaagattcaatacaacaagtcaataagtccaatattttcggtataactctctcgatctccctatattattcaacactctttatagtactcacggcgctgctaaaatcaaattgtgataggttgatctagggtttccttaataattaattaattaatctctcccacacctgcatcgcaacgcgtgaatcgatcgatctcacagcagcaagtgatctgattagcaatgcccatggagacgacgacgacgacggcgacggagtcgatgagcaagatggagacagtaagaggaacgcaccggtttacatttcacggctacagcttgtgcaagggcggcggcgccggccggtgcattcgctccggcaccttcaccgtcggcggctacgactggtgcatctgcttctacccggagggccagggcggcggcggcggcgaccgggaacacgtctcggtcaagctcaggctggtcacccgctgcgccacggccaccgcgttctacgagctccgcctgctcgaccaggacaccggccgcgccgccgccgtcgcccgggcctccggcgcgcccagggtgttcgcgtcgagcaatcccggcacagcgtgcttcggccgccgcgcgttcatggagcggagcaagctggaggcgtcgcccgcgtgcctgcgcggcgacagcgtcgtcatcgactgcgccgtccgagtcgtcgtccacgaccccgtcgtcgccgccgtgcggcgccgcgaggcgccggacgacgtcccgccgtcgaacatactccggcagctggtggcgcaggtggagtccgagggcgccgacgtgacgttcgccgtgcagggggagacgttcacggcgcaccgcctgatgctcgccgcgcggtcgccggtgttcaaggcggagctctacggcgccatgaaggagaaggacgccgaccacgtcatcgccatcgtcgacgtgcagccggccgtgttcaaggccctcctccatttcatctacaccgacgacatgccacccgacctcggcctcgccgccgctgacgacgacgacaccgacagaatcgacatggcacgccacctgctcgtcgccgccgaccgatacgccgtcgagaggctgcgggtgatctgcgagcgcgtgctccggcgaagcctcggagtcgagacggtgatcgacacgatggcattggccgaacagcatagctgcggcgagctcaaggaagcttgcctcgagttcatcgattctcatagcaagcgaatcgtggagagtgatggttacaagaacctcaagagggcgtgccctttgctcgtcgcagacatgtgggagaggatcgtcctatcacgtctagagtaaggctgtgtttagatctaggggtgaaaagttttgggtgtcacatcggatatacagacacacatttaaagtattaaacgtaaactaataacaaaacaaattacagatttcgcctataaactgcgatacgaatttattaaatctaattaatccatcattagcaaatgtttactgtagcaccacattgttagatcatggagcaattaatctcaagagggcgtgtccgttggtcgtcgcagacatgtgggaaaggatcgtccgatcacgtcgagagtaaatattaaaacattgctcatgcaatgttgagggtgatatagccatgaacattaattagcgagatttggttcggtccaacaaaaagtatctttaaggtaccggtacctcacggtaccaaatcgtttttgatctttggatctaacaatgcacatcttgcctagctagatctaatgatcggaaacgatttagtaccgtgactccgtgaggtaacagtacctcgagaaactttttgttggactgaagcaaatctcttaattagcgatgggtttatcaagctcttttgatttaattcattttttttctaaaatggattaatttgttcaactgagttagagtaaagtatatatgatggcaaatctgctgcaaattttaagttggtatttgttgtttacttcgtagttcatacggcacactagagtgtgtcgggatggaatcggaactacttgacaaggtgtgacaagctcgataacaataactctcgaatgttctcatcttggtaatgtggcgatgatgacttctatagagttgggaatgatgacttgtgttgactcacatcgcatgcttttttaattttcgcctttctacagagtttatcggttttccctatggttttaatttggtcagctttcctcgttaactgatcgccctttttttctctttagtgggtttttagttctttgggtgtaaaatttttgaagtatatggacgcacatttaaagtattaaacgtagactaataacaaaacaaattacagattccgcctgtaaactgcgaaacgaatttattaagcctaattaatccatcattagctaatatttactatagcatcacactgtcaaatcatggcgtaattaggctcaaaagattcgtctcgcaatttacatgcaaactgtgcaattggttgttttgtttcccacatttaatgctccatacatatatccaaacatttgatatgatgtttttggctaaaattttttgtgatctaaacaaggccttaatacaaaacagaaactctctaagctcctaagtttaacaaatcctcatatggaaccattgttaggatgaaaataagttaaatacacaatgtacttcgattataattgggataaatatacggggacacatttattgaaattccatcagccaaattcaacccaaatcagactaaatgaatcatatccgtgctgaggagaaactattactctcaaggggacatccactcgtttgcatgtcatccaaatagttatgaaaaaaaataataaaatttaacaagatagattaatatgtgataaatctgatcaaatttaacttccacgagttgcaaaaaaatcatacattaactagccaaaaatcattgtttgctagacactccctatacattaactagccgagactaattgggcccaaaacttccgtactcagttcggcccagcccagtaaccaatgcctccaaagtccgatccggcctccctcatcgtgatttgtgacgtgcagggtaccaagacactattccaaattccgttccgacacgtacttaccgtgcgcgaccaatacatacacacatctccgccacacgtgcacccgcacagatcgccgccgccgcaaacctcgccgccggcagcgtcgtagctacgcatcacgtaattaatgatgatgatgtcctccgcggcgccggctggccatcacgccggagaagagccgccgccgccgtcgacgacgaggagcaccatgtcgacgtgcacgatggggacggtggagggccaccaccggttcgcgatccgcgggtacagccgcctgagggcgctcctcgccgccggcgagtacgtccggtcggccgccttcaccgtcggcggctacgactgggccgtcgtcttctacccgcgcggcgccacgcacgccgaccgcgaccacgccggcgtctacgtccagctcctgaccgaccgcgccgccgccgccgccaccttcgacctccgcttcgtccgcgccgactccggccggccgctgtccgtgcacccgccgctcgccgcgccgaggacgttcagcaccgtactccgctcctcctccgccgccatgtacggcgtcaaggtggaggcgatacaggcgctccaggccaactacgtccgccgcgaccgcctcaccatcgactgcgccgtgcgcgtcgtcgggaagccgcgggtgtccgccgccgcgccgctgacggcggccgacgtcccgccgccggacctcgcggcgcacctcggccggctcctcgacctcaagtcccacgccgacgtcacgttcgacgtgcggggagtgcagttcgccgcgcaccgggtggtgctcgccatgcgctccgccgtcttcgccgccgagctgttcggcccgatgcgcaacaacgccggcggcgccatcaaggtcggcgacatgcagcccgccgtgttcaaggtccttctcggcttcatctacaccgacacgctcgccgccatggacgacctcgacgccgacgaggacgacaggcgagagctcgcccgccacctgctcgtcgccgccgaccggtacgacatgggcaggctgaagctcatctgcgcggacatgctcgcgaggagcctgacggcgcagacggtggcgagcacattggcattggccgaccgccatggctgccgcgggctcagggaagcctgcgtcgagttcgtcatcgccatgggtatgaacgatgaggtggtgataagccggcatcctgaccagctcagctgtatctcgctcttcaaatacttcttctaccagatcggcagcttactcaaaatccactaaactgtgtttaattagtgaaagattcagagtgattgtgttatttcaacttctactactgtcgatagactcttaatcttttcttaattagtttgtccactaaactgtgttactagttagactcaagagtgtttgattgttccaacttctgatagagtcaatagacgcttaatcttcttaattactacagtttgtggctaatcttcttaattagtagtttgtggttgtttactgaccaggtagcttttttgcagttttgttgatgttctgatatacctttatcaaaatcctctaaaaactactcctcacgagtagtttgtctccccagtagcttgttgagtatattaattagtcagtgagcttgatttttctaacttctgatgctgccaatggacatttatatattctgaattagtttgtggttttttactaaccagtttagttcatgttctgatatgcctgagtttgtaaataatttatcctacaagaaaaggacgatttttcatacaagagtttctatgtggttttaccagtgaaacaaattaacagcgtgcttattatttttacttctggtactatcaatgaacgcttaatcttcgtaatcagtttttgtttgtttactcaccacttaattattcatagtttgtgaaggtttactgacttgtaggtactcctagctcagttgtagtttagttgatgttcagatacgagtgagtttgtagatattttttcctgcaggaaaagaaataaagctaatgcagttcaggtccaactattcactctgtaattttactagtgaaacagaacaagatttgctctgaaaattctggatgaacaacaggcacttgtcccctctgataattctgaatgaaacaacagacaaacatgcactaaagttctgaatgaacatcataacaaacagactaaaatttctgaatgaacagcagaacaagcagattctgcacaacaagcagaacaaacagactcagaaattctggatgaacaacacaacaaacaagttgtgaacaaaacaacaatcagattctctgaatgaacaagagaaacaacacaacagcaggctctgcacaaaacaacaatcagattgtctgaatgaacaacagaacagacaagagtactctgaacaagagaacaattagacacaacccttcaagtctgatcaacaaaaaacaatcaggtaccactaccacatgatgaaatacagtatatcgcccctggtttgtgtaatcagtacaccaagtagtaactgattacttgattagccatctgcaacacaagaataaaactgcatacttgaaaacttcagcaacaagcataaaactgcatacttgattagccatctgaaacacaagcataaaacttcagcaacacaagcataaaactgcatacttgattagccatctgaaacacaagcataaaacttcataaaccatacaggaataccactctacaagtacagcaaaggacataatcaatttctcaggtcaaacaggtgattagtaatctgcaacccaagctgcataaaccatacaggaataccaccctgcaagtacagcagagtacaagaggcatcagatttgaatcaggagacagagacaaaatttcagatcagatctggccaagaaacattcacacaaagtactcatccaaatgctgatgaatattttcttctcggttcataatagatagattcatagatagatcagacagtgcaaatccatggcttgtctctcaaaccgacccaacgaaacaaaaagattaaaccactccaagactcccatcccattacatagaacgacgacgacgacgaaccgatagatccatagctttcctaacgagatctacgactactaataagatagaactgatcacccgctgctcggtgattcagtgagggagggggagcaaaacgcatcatgggagggagctggatctgacgccgcgagcagcgcctagtaggtcttgctggggcactcgcgagcgatgtggccggtctcgccgcagttgtagcacccgccgccgccgccgccaccaccaccgccgcggtagccgccgccaccaccaccgtagccaccaccgccgcctcctccctgggagcagtccctggccatgtggccctcctcgccgcacttgtagcacgcgcggctgcctccgccgccgccgccgccgtacccgccgccgcctccgtagccgcggtcgcccccgccgtagccgccgccaccgccgccgtagccgcggtcaccgccgtagcggccgccgcctccgcccccgccgtagccgcggtccccgccgccgctgggacgggatccgccggtgagcgccccgccccccggcgcggtgacgtccacggccttggtgcggccgtcgttgccggatccgacggagaactcaacgacgtcgccgtcgttaaggctccggtagccgtcggacttgatcgaggattggtggacgaagagatcctcgccnnnnnnnnnnnnnnnnnnnnnnnnnnnnnnnnnnnnnnnnnnnnnnnncttcaccgtccccttcaccctctccgacgccatctcgacctcgccctcgccctctcgccgccgccgccgccgcaacccaaaaccctagaaaccctagatcggtgtgggagtggaagcgaatgggaggagaagccgccgccgggtgggctatttaacggcccaaaaaaaatctttgcattaaattactacctcgaaaaaaaatcttttcattaattgcctctttattttggaatatttaccgagatattccccgcggcatcggcccatcaaactcttcctctcccgactgacatctcggcccacttaggcggcccaacttcatagtttcggtccgacacgttcaagggaagggaacagagatggattttgtttcggacttgatttgtaaatttgcacgaaatttatacaaaattagcggtggattcggattagtgcgcgtaacaaagatcacacgatggcgacggagtgcacgacgtcgacgagcacgacggcgacggtggaggggcggcacaggttccgcgtcgccgggtacggcgccaccaagggcgccgcgcccggccaccgcgtggcgtcggggaccttcaccgtcggcgggttcgactgggccgtcgtgttctacccggagggcgtcacggccgccgacatggacttcgtctcggtctacctcgagctcaagaacgccgccgccgccgctggcggcggcggaggcggcgcggtggcgcgcgcgttctacgacctcaggctgatccacccggccaccggcgagccgcggtccgtgcgctggcccatggacggctcgacgtcgcgcgtgttctcccaggcgttcccggcgtgggggcacctgaggttcatgcggcggcgcgagctggaggagatggggttcgtccgcgacgaccgcctcaccatcgagtgcgtcgtcatcgtcgtcctggaccccgtcgtcaccgccggcgacgcgccggagctcgaccatccgccgtcgaacatcctcggccacctcgccgggctcctcggcgacaagggcaccgccgacgtgacgctcgtcgtgcggggcgaggagttcgccgcgcaccgggcggtgctcgccatgcgttcgccggtgttcaaggcggcgctctacgggccaatgaaggagtccacggacgcgaacgccggccgcgtcgccatcgacagcgtcgagccggcggtgttccgggctctcctccacttcatctacaccgacacgaccgccgccatggacgacctcgacgacgacgacgacgacaaggcgcagatgatcatgcaccttctcgaggccgccgaccggtacgacgtcgagaggctgaagctgatctgcgagctcatgctctgcaagagcatcgccgtggacaccgtcgcggcgacgctggcaatggcggatcagcaccattgccagaagctcaaggaggcgtgcatcgagttcttggccacctccaagaagatggaaggcgtcatggaaagccaagggtacgagaagatgaagctatcttgcccttctttcatggtggatttgtgggagataataggcaggaagatgacctcttattctgttattcccaatatctatgcaagagacaaggactaattttcttgaatttccttgcaaattcgcatcaaaatgccagcatgtaaccataaaccattgactgattctagtttggagataatgatcacagtcttgctacttcccgcgatcctcaacatcttggcaaaaatctgaaatgtttgaagttaaggataagatttgatcaaaaatttaaaatttcgaccatcaagtttatcagtttatcaaatttaataagtttatgatataatgatattgctttttgatgcaaatatatgtataccattttttttgtttttaagctaattaaccatttaaaaaatattgattagaattataaagttttatccgattcatgacataaacaacaagtatttataaccgaaggaagtattcagtattgacaactaggctagctgagcaacttgaagatacatagccgttcatatgatttgtgttccggagttggtcagccgcaatgttgtaactcatctgctcacatctcgtacgacatttcaagatatggaggcttcttcttgttttggttgacacatttctgttctacgctctgtaaacaacaggatgtacactgcatgcacaccagacgaatgtatatatacgtgagtggccgtgaacagacacgtatatctcatcaaaattttgattgatcactgccataaatccacaaccgatgtttgagtgaattcgacttgcaatctttctgtctgtcttttgtttctttcttgttttgttttgagtttatgtgtaatcattatctaaaaaaacaatctgtttatatttctgtttgtgtttcatgaaacggattagtaatgttctcagggcccaggtctaacccgaatccaggccttcgagagggcctatctaaaacactatattatcgtatgatccaatttcatggcgtacgtgctcgtgctggtcttcttcgtctccccaagttctcatctgctattgcgcaatgggcgcctgcgcctcagcttcgcggccgccgccgtcgccgcgccacggctgctctccgccgacgccgacgatgacatggacggcgtcgacgtgcacgacgccgatagcgcagggcgcgcacgcgttcaccgtctaccagcacggcctcgtcaagaggaccaccgccgccggcgagttcgtccggtcgggaaccttcgccgtcggcggctacgactgggccgtcaggtactaccccaacggcgacagcgccgccgaggcggcgtgccgccagccgtcggtggtcctcgagctcatgaccgccgacgccgcggcgtccgtggtctacgagctcaaggccgtcgaccaggtcaccggcgagcgcctcgtcctccgcgaggacaagacggcggcgttcgacaccaggaacggccagttcagctgctccggcgtgcagttcgtcgagacgccggcgttcctcgccggcgacttcctctcgatcgagtgtatagtcacgatcttcggcgagccacgcgtctcaaagacgaacaagatgccacagccgccgccgccgccgccgccggcggagacaagcgatgtctcatagacaataaagaaaaacaactatactactgtattgctctcatgtcatggtttaatacaaactggtcaaactactgtgttgctctcatggtttttgtctctgatgaaaacaattacaattgcttacattaaacgaacagtaggttaagcagaaaagaagctgtggttcaaccatgttcttctagtgtagacaagcattgggtctgaacagattaattccaggtttatagctgcattacctctgtcgaagacgaaaattcgccgttgatcttacacatcatggcatcatcaatctccaccctagtccagagctttggaaaagaataaggaatcgtaacagatgcaacagattcttggttgctcaattcattcttctttccaaacagctgcgccgcaataccagagcagatcttcagatcaacctcactctgtgctcttatcatcttagcaaggagctcagtcatctttgcacctctctccatttgctgcttgatggataacttgacaggctttggatggtcatctggattttggtcaggagggttgtcatcctcgtaggtgcttttgctttctagcaattcctttatcttctggtccaaaatagtagcaatcctgtcccggaagccatctgcatttgcagagtccgatttcagcctcacctttgcctcggaaaccaatgtttccatcctctcttctgaagaagttgcttcaggttcaggttcatcagcagcatcttctgtaagaccgaacgtttcctccagtaacccaacattctgtgtatacctttcatacgcttcattttcagcatcgatgtctccttggatatgttcttttagcttctcaaacctccacttgtttatgcccataacatcctgtaatataaatgcttaactccttaatcatggtctcatcatggaagaaaagaaacgaaactaaacaatgaacaatcgcaaacaatggaacagctagaacctttttggcaagggacttctttgttcggagggaattcaggaaatgatggggaagcctttgcagagaagccaaccttgatgaactgcagcagcaaatttcaagcaagcatcagaaataatgacagattttaccataagataaaactcctggttcagaaggttacccggttgaaggtatattagctgatggttgctctgacagaggagctgttgacagaggtggcttatctggcaatgtgttgttctgtttcagaactgtcatgattggtgataagaggtggttagtggctttttcaaaaatattagaaaaatacagagtccagacaaatcacagaaaatatgtagacaggcataacatcatagccataaatcaaaatttcttgtatgtaaccaaatgttgctaatcccttatacaccagagagaataaattttgacagcaacattcagtgccatataatgaagagtatagagagagatgaatataattcgaaagcagatttaagaggtacaatacaacaaataagagcccttcaaggtacacccatgaggccattatccctccaaaacacatttctgaaggtccatttgattttagagaccaaggcaataataatgctatggcaagggtcaatttaattttagaaaccaaggttgtcatgggctcatggcactcaagtgagtcattaccacagtcactagatcatgatacaatactgtcgttcctgaacctgtcccagtttgctggtcacagttgatgcaggtcacctccaggccgtgtttggttattagaggcatccaaatcaggtacagaaacctacctgattttgattggggcaacagtggccaggttcctcgccattcaggtggtgctggcatgtgtgaaggtgtgtggtggcacactgcaggggataatccagcagtagaagatggggaccaagttgctacaccctgtgatctcgtggccctcaaggttctctgtcgccgatgcaagacaagtcagcagaagaggggaggaggtttggagaagactagggcatttgcttataaaagatggtggcaagggtgtctgctgaaagcctgaaactgcatcgatggcgaggatatgagattatgttagaactgaggagatagagcaacagaattgtgtggctggatgggtcacatgtctgatgtctctacaacccaaatatttatttgtctcatttcgtgttcccttccttgtagtgtaaaactgattatcttccttgggtgtttgtgtatgacataccataaagtagtagtaatttattttataccatataatttattttgacagaccaagtagcttgttcatcgacctagattcattggttcaggttcagggtcacatcccacatcctaaactacagtcctgaagaaaactgccgctgtttgatccaacctgacaaacatactgaaattcttctctacaccctttccctcatttccttccctaaaccctacaaaatatgaagatcaaacattctgttgaccaacatcatcccactatttgagcagcctgatggagaagcattaattggttgttaatgttgttcaattgcacgcgacaacattgtcagtactgagaaaaataaaaatccaaaatggaacaaaacgttataataatgcatttctatacctgtagtttcccttttagatgttgaaatgagcatgttcaaatcttatcattataagtttgatcaacggtccataagaaagtgaccgtaccttaaaattcctccataattgaagtatcccactaccccacttacaagcaattgtcctagctttgatgctaagtagctaaacgtgataagcattcccagaataaattgtaaacaataaaacaggtaaatctccaactgccaaacaatgagtaatagtccacagaaaggtaaaactgcaagaccaaatcacgcctgtcaaaaaaattggttggatcaaatgatcgaataagtggatgtacaggtattcagtcagcggcttaatacaactaattacaagcacaattcgttgcacaggagcagatatatactcaaatggtactagcattacacatacataccatgaatgtggcaaggattctgagccttgtagcagcagctcttacaacactggaacgggcacctgaaaggccaagcattacattacacagaatgaattaaaaaaaatatccaggagcgacatgccgatacagcgcatcgatttctcttagaaaaccatcactacaaatccccaaaacaaaaaaaaaaaaatcttcccgcgagcgcgcaacgttgccgcactggatgcacttgggcttgttgagnccgcgcaggttgggcttgggcatgtcgaaggcgcacgccgggggcagcttctgcggcgtcgtcccattgccgttggcgaccgcgaccgcgggtgccgacgagtcgctggccgccttcccgctggatgccggcgacgacgcggccatagcgaacccgccgtgaaccaccccgcaactccgcacaggaccagcggttgggattccggggaaccggaggcctcgacggcggcggtgctccggcgagctagggtttcttcttttttttttcttttgtgtctctcctgcttttcttttcttgagtcgagtcgaatccaatccaatcgtgcggtggcttcccgagacgaacggtttgatgtgggctgacaaggtgggcccggtggtgtaattgggctgggcccaattgaccaagtctattctaccaaggcgatgacgccggcgagttcgtccgtatcgacgccttctcacttcgcagccgccgccgccgccggcgccaccgaattcaaccccaacggcgacggcggaagaagaggattttcgccggcgacggaggtgacggaagtgtgccctttttttaagtaaatttttcatctacacaaaccgttggccccattatttcgcttatcttgtgcttattgtccagcttactagtagcaaacaaaaaataatttgtacgtaaaatttttatatgtgtgtgtctttactgatataaaggccaatgttgtaaaataaatcacgatgaaaaaatccacaaaatcaacttcataattaagtcttaaaattaacttgacttatggtataaacataagtgaaacaatggagacacattttttaaaaaataatggttaatgatttcatacagaaacagttccaaagtatctctgaaatctaagttcaaatgcttcgattataaagtggcttggctcatttttgagtcatcaacaagcatacagaaaagttccatgcattttttttcttttttcctcttttttcagtcatggtagctacaaaaatcataggcaaacaccagctggtgttcttcagcctagcacacactgaaacacatagatacagtcatacacacactaatcatcaatcacacaatcacataaaccaaaacaaagctctctgctatgcttactgagagagtaagctagaattatccccttctccacatttttttaacttcctactgggtgctgtttctgacatgcacaagattcctcagctcttcaaatgcatccatggtctctggatcgaatcccccagcaaactgcaaaaatgagcggcaatttagaatatgcagctgacattaaggtttaaataacacatcttaatatgtcataacaagagttaacagcagaaaatagcacaaacgtaatgcagaaataaccataatgtttctgaaggacataaaacatatacaagcacctgtggaaaataaatatgtgcaattatatacggaatgggaatcaggaggcagatgaaacaattatgagatgtggtataacataattgcccaagtatacatctaatcagaatggagtatgcagtatgcacaggggaattttctttttgtggagttcctgctagaaatgtgttacctgatgcattctgaaggcaaatctcacagcctgaagtagcatatactccaaagctggatctttgttcagaggtcccatgtattgaagttccatagcaactcttttcatgtacatctttgctaatttgacagaagaaaattttatctgcagttatcaaggaaatagaaagacaacgattactccagttaatagaaaggcaatgattaatccaacaggatgtaaacgatggtctaggtgatcgttgcaaactgcttctgttttacaacctttttgtggtatcaacataatctgcaaaatgttcacaagcaaacaacagtggtacctatgcaaagcgtaccacattcctaagtttcagtagatgaaaataaccttagatactatataacaagcacctcaagttaaccaataggtacttgaaaacttatcctggtagtctccatgctatctattctgaatactggtaaccaacaaattttactttttgcaggccaagcatcataattctgactaggtcatttcctgtatcatatgctgacaacaatgtagcactaagaaatcaaaccttcaaatacggaaaattatagaacatataccttgccaataagattgttgtcgagcatccagtcagtaggaatattaaactctttacactgtctcatcgtagcatcccttgtcctcagaagattgtagacactccgctcagtcctgaattaagaatgcaaatgaaaatatcagtattcccatttaagtttaccactatttctgttaaatgtatgtaatctgtatacttatagtaaatttagtcgtacttttctgatattgtaaccattttcttcagtgcaatgtcacatggaaggcgaggatcatctttatagtttgaaacttcagattccaattttttcaggtcttggtagccaaaagctgcctctcgtagagtatctgccttcctttctggccaatcaaaatgcttcagcactgctctctcatccaccttcaagtaatgcaattacatgagtgaaaaaacaaagtaaattgctcagagtatagtgctactgaacattcataccaggaaaccaagctcatcatcaagccatttcacaaatgcaaccacatcttctatatctttgtaagctgcattggtcacctccttgatcaatgatttcacaaattcaccttgagtctcaacatcagccttgatctgaaaatgaacaaagagtaaagtaaatagccatacatcagtgcgagaaccagctagcttttcattggtatctacaattctacatatgtccaataatctgagcagaatattctacttacagcctgcaaatgcgaagaacggttctcaatttcaccaatcatgctactccgcacatttgctgagttagcagtttcacagattccactcccagaagtatccttttttgagtcccttctcataagtgaatggtaaagctctgcaacttgtggtgccctcttcatgaccccagcgtttcttgtggagaactttggaggcggtggcggtggcggaggctttggtggattcgcagctgatccatttgatggaccagaatgtggcacagaaactgaaggtctaggaggagggtttggaatacgcaaggcacgcttttcaacatccatactttgagacatgcatacttctgacttgccaagaagaaatcttgagctttcagatcgaccaaaatcata

SEQ ID NO: 25574 - DNA, 2105 bp, Oryza sativa
  unsure (1)..(2105): unsure at all n locations
nnnnnnnnnnnnnnnnnnnnnnnnnnnnnnnnnnnnnnnnnnnnnnnnnnnnnnnnnnnnnnnttctcaatttcaccaatcatgctactccgcacatttgctgagttagcagtttcacagattccactcccagaagtatccttttttgagtcccttctcataagtgaatggtaaagctctgcaacttgtggtgccctcttcatgaccccagcgtttcttgtggagaactttggaggcggtggcggtggcggaggctttggtggattcgcagctgatccatttgatggaccagaatgtggcacagaaactgaaggtctaggaggagggtttggaatacgcaaggcacgcttttcaacatccatactttgagacttgcatacttctgacttgccaagaagaaatcttgagctttcagatcgaccaaaatcatacttatccacaagaagttcacgcttctccctgattgtctcatccttattacaggagattgcctcatctgttgcttcaggcaggcagataaaggtatcagattggcgcctcttcacaatgctaaactcctgagcacatccttttggtccacctagtgagtgcctgcgtgtcgggcttctgcattctgcagcttcaatccatgctctgtcaagaagggcctcctttttagatgcttcacaattcttatcattctgagaccattgtttgatacgctcagcaatgctgaacttcttgtgatcagaactgttctgatcaagtcttgcatcaccatcacaatcatcaacatgacaagcaatttcatcattataatctgcatctgtcattgctctagctgcttgatctgagttactgagctcatgacgtagacaagaattgatccaccgaagataggcaagctcctcaacttcagttagccgactcatttgcagaccctcaacctgcttgctcaagtttgcatttgtgtgccgcaataatgaagcctcagcttgaacctttgcaactatctcactctggtgacaataagcatggtatagaaaaggttagctggaaacaaactacgactcaacccacctgaaaaataatttagtttaagtaatgttacctcggcattcttttcaatgacagccaatttggactctgctgaagagagtttaattgcgaggtttcgtttctgaaattgaagctctttgtttaaacgtcgcagttcaacaacttcaatctccaagttttctgaagaagatgcattgcccccattcatactagaaacccgattgccatgcccatccaaccttgcattttcttcatgctgctctaccatacaagatagagctgatagctgttcagaaaggcttgttttctcaacttctagtgaagttttaagtcgcacaagcctgtcaatttcattcttccttgaatcaagatccttttcaagttccgaaactctaggattttctctgcattgccgcaactctgactgtaatgctagttccctttcctttgactcacgtagttgttccctgagatgatccaactcaagaaaaagatcatgagatgctggggacctgatgccatggcaatcaaagacatgggggtgaacctgagcaccagcaggtgaacaagggaaatctcccataagagatctcttaaccctagaatgatatggaatctgttggttgctggtgttaacattttccacacttgcaagaggtggcttcttgcttgcagcagctgctgtcttcttggtctttttgtcagctgtgaaccctttgacaatttgggaaccccaagaggatccaaattttggcttgagcacatttatattgcttttggagtcaacccttgatctgcatggctttgtttggttgtcaaacataatatcttctttcatcttgtagcgattttgcctgacccagaacactaaccatgcagaggtgactcgacttgattaaaatgttccagtacctgtactaacacctgcaaataagtgagaaaaacatgaattgagctagcaaccaaacatcaataacacagatgaaaacaagaataaagaaaaaaaatgaagaaccagatatgaatgccttttaaaatggatgccttcaaaaattgtccataaataa

SEQ ID NO: 25575 - DNA, 13690 bp, Oryza sativa
  unsure (1)..(13690): unsure at all n locations
nnnnnnnnnnnnnnnnnnnnnnnnnnnnnnnnnnnnnnnnnnnnnnnnnnnnnnncaagcatttgaacacagcgagtagactgaacccacattgggctcatcatcaagaaggacacaacaagtaaagcgcgactcttacctcccaccacccaccatcgatttgtacagatcgaggtgaaagcaaactcccccgtccacaaaagaacccagccgttctgcacaccgagcgagctcaagacgatcgccaatcctgaaatcccccactaatcaaagccttctccctccttttgacctcctcctgaccgcaagtccgcaacctatcatcccccgctccagcaagaacccccccaaatcagctcgatttcaacttaagaagacgaaaaagaaaaaaaaatcaaaaaccccgcagtgccgtgccactcccgacgacactaccaccactactcctactagtagtagagccaacatcagccagtggcagtaaacaaagaagaataggaggatgaagacaagtgcggtggagcttcggatgctttcaccttcggcctcgctcgccttcgatcgccgcgccccgcgcccacgcgcggatttttctacgagctcgtcgcggcgagttcgaggattcggttgctctctctctctcctctcctctctcttgcgctctgcttcttctcgggagaggagaagagtggagtggagagtggaggggggtgggtgtgtggtttgaattttgaaatggggataggggttttggacgagacgagtagccgtagcgcctagggggggacaagacattggcagagcaggtactgacaggtgggtcccactgagcagtttctcgcctttttctttttctctctccctggtttcttgtcgcttttgtgagaccgagcgtactgggccgccagcaggctactgggccgggtacttctctctaaaagtctgagtgttaggtgtgggctgtcttgttatgctggaaataaaaaatggaataagttcaattgaggtccctagatttgttgactgagtctgaaatttatccctaaactgaaatactagatataatggataccccaatttgcaaaactagatcactcgaggttctaggcagtttatgcccggttttggttgatgtggcaagctgggtcaacgtgggacccacgtgggcccccgtatgtcagtagctagcactttcttccttctcttctcctctcttcccaatcccctctagggcgacgaccaacgggaaggacggcgcgatgggtgagattttgttggcgctgtctcctctccccatcccctgatgctgaggagacgtcaccaacagagcgactgagggggtgattgatggtgacgagcagtttacacagctctcggatcaaccgcgagtagtgctctctgttgtcgttgttgtcgtcgctgctggccccaccatggcaatggaaactcgagcaacgaagtgaatcaaaggtcggaggtggaagatggtggtcgtcgacgtagaagatgatggtggccgttgacgtagaagatgacggtgccgtccacgtagaagatgacggtggcaggggtccaggtgatggcataggagtgggcggcgactatggggtcatcgaaggagaggaggtagcgctcctcattggcacgggtggtgctatcgttgcctccatcttcgccccttccccagccaacgatggggcatggaggaaatagatgggagatggggaatagatggagagagaggggaggctagaggtggagagaggccttacatgtgagccccactcgccacgtcagctaaaaccgtgtgtatactgcttgagacctctggcataccacttttccaagttgaggaacttgttatatttggtattatggtttgatgacgaaattcaaactcggccacaagttgagtgaacttattccataaaaatttaggaccatctgagtatatatcattggacggatttttttcccacgaaaatcagatgaatgtaactacagtacaattatgctcgtaactagcatgtaaagtgtcatatagatacacaaaaatgctcgtagcttagtgggataggcgtgtgttggggattgcgggatcgagtcctttgccttgtgattttaaatttgtgtgattttaactaatttcaactagtaaatttgatgacaggtgtatatattatgccttgaagaggactcgaacctccacactctttagcaggccgaatcgggccaccacttgggatgggaatggctctttcggataatgcaaatcgaagctattttgatgtgtgagcctatatgacatagaaaaaggttaaaaaaaaacgtttgattctcttttccctattcaattacacggaagacataactgtaagtgtatctcataacattagcttataagctgtagataaattcatattttggagcctaattttaagctgggttgagccaattaagagcatctattaaagcatggctaaattatgttcccaaaatgcccatacgtctagctagccaaaagattatattttttaaatttttatatttgaaacggactctccaattccaactctacatatggtacagcaaagagcaatacttcttccgtttcacaatgtaagtcattctattatttcccatattcatattgatattaatgaatctaaatagatatatatatctagattcattaacatcaatataaatatgagaaatgctagaatgacttacattgtaaaacggagggagtacatccttgatcgagaggcgaacttggaaaaaccaaacacaaaatccaaaaatcatgggtcagatttggggggcttttaactatttgcccctcttacgagtggtgcttaacgatttaccactagacctacatgtcatagacacatgagggcccatatgttatagacacggtgtggcaaatcgttaattgccatgtcacaagagtggcaaatagttaaatttccccagatttggcgtattcaattttctattctacaatgttttggagtgacaaacgatcacccaaaaaatcacaatcacaaatctctgaagagcaatcactgaaacaaccatagatgtgtgtatttgtgtttgtggttgaggagtggagcttcaggaggccaacaattgcgtcgccttcaggcttcttctccatgccacacatgacacacccatgccctcgttgcaatccagcgtcgctgcgccaggagacgaggcgaccacctgtgaagagacgcacttcagaaacgggaacatgttcaggaaacggatcaggtattcaggcctagacattcagcacatttttttatatatactccaacaggtttagaacagtttcaattcacaaaagcaaggagcagcaacaacaggagcatcaagtcatgtactccctctgttccataataggttcatttttagctcttatttgtcccaaaaatagtttattttattaagtaattattgcatcagaatttataaaagtagaagtatagtataaatgtattggaagtagataaagagaagaatcattgtattatgatttgataaagtggggatattatagtattttaggttttgtattgatatgtgttggatgagtgaaaaatgaacttattttaggacagagtgagtacttcttaatagatccactcttggatgaagattgatctgattatattagagtggagaggtaaaatgagccaaaataatttaggggcttaaagtgatccaataaaattgttcaggagagtaaaatattttgtattaataaaagcttttctgtgtaaaaacgtaagcatggattaaaaacattagaaatggccaaaataacatgttaaatgatctagatctatgaaaaagatattaaattggactaaatctctctgtccaaactccaaactaaacctagaaattgacatacatctaatactacccttaaggcatccataatgttcggcataagatagaccttaaactctaaaagcaactagggactatttagatcccaccctaaaattttacagcatgtcacattgaacgtttgaacacctgcatgaagtattaaatatagtctaaaaaataactaattgcatagattgtgactactttgtgagacgaatattttaagattaattgctccatgatttgacaatatgatgctacagtaaacatgtgctaatgacggtttaattaggcttaataaattcgtctcgcggtttactgacagatattgtaattagtttttctattagtgcccaaacaccccatgcgacaccatatataatacccgatatgacacgccaaaaccttttacccctggatctaaacacccccttatatattgtgatatattgtggaacagtttgcaagtgaccttaagggtgaaaagaaatcaataatatttgactctcttccctccaagtctctcaccagcaaaaagtagtactccaaggtgtgatgcatagtaagattttttttaattgtgtgggacccagtttagtgtttttctttgccacgtactctctctgtcccttaacatagggatgttgatattttgattatactgtttgaccattcgtcttattaaaaaaaaattagaattaatatttacttttttgacttactttattatccaaagtattttaagcacaacttttcattttttatatttgcacaatttttttgaataagacaaatgatcaaacagcacaagcaaaatgtcaaaatcccttatgttgacggagggagtactatagtacattgcaacaattaccatatagctaaagttagacccagcttatggctcaataagactttatacatctaaaataacaaatagccataaaggcatcatattcataattgaaggagcccctcctattattttcaacccagactcgtcatttgcctgttttacattatatgattcataatggtggcgtcatgttccaaagttgcaactattatcactttcactacagaggctaatcagtccttgaaccccgatgctacagtggcacgtactggagagtagtactttatattttctcttaatttgcttggaatatttttggatttcgtacatgtaagtctttgcaattattttaatatgcgtatccaagcacgatacattaataaactaattgactaattatacactagctgtaaagctagtgcattaacctggattggaagcttagacctagcttttcttaaggtctaaccgtccaacaacatacacatgcatgtggagacaaatatgtcaaatggattgtactagtacatgtatgacccctttaaccatttgaaaataggagttagcattttttttaaattatgaaatgtcacttatgttatactcctatactccataacacctcatgcagttagagctgcttggacatacaatgattaccttatagctatgattatttgtcgaattagttgatgcatgcatgtggtgtgcatgcacacatgaagtcatgaacaatttgtcaatcagatgcagggtactagtagaaaccaacatgtgtcgtgcgccctggtttttttgtttcttcttttttttaaagcttttcttttcttctttggtgccatcgaaatgatttttaaatatttccaacatcttgtaggagctcaaaaaaataatccaaatttataaaatttatatccttccaactgttttcaaaatcctgcatttcaatccttgcaaaagaaaccctgcatttcatcgctttctccgtgtataaatataaaatattttttgaacgactataaatttaaaagatgtttgtctataagttgaaatttgtggtttcaagacatgtttttaccattcctcatctaccaactttatactaccccttcccaaactaaagtttgtagtttattcctcacctgccaatttatgtgcaaatttatttttctaactacatgtcttatgttataacttgttgtgtcaataatttctcattttttttaaaaaataatactatgatttcctaggattcgttcttatagcaaagcaaagatagaaaatatgtcgttttgtacgcatatgcttccaaaacagctaaatgatatgttttttttggcaaaaatatccattaagaaagttgcttgaaaaaaccatattaatccattttaagttgaaagtaataaatacttaattaatcatgtattgatggctcaactcattttgcgcatcttcttaatcttatttttttatttcaaacacaaccttagggcccctttgatttggaggaaaaacatagaaattttgaaggatttcaattctataggaaaaattctatgaatgcctttgaaatagaggattgaatcctatccaatttttgaaattcatatggaatagaaaatcctatagagattttgaaagaaacttagcaatagcttaaagctcttagaaaatttcctttagtctatctctcgcatccgattcttgtgtttttttacggtcattcttgtattttttctatgttttgaatcatttgttttacactttcattcctgttagaaccatatgtttttcttatttctttgttttttttcattcctacgattccaggagcccttatactactccgtatttaaggaagaatagtagagtaagggcaagtgctataatgctagatgtattgcccctaaacatgccacataagattgaatgatgaggtggaagaaataagtgatcaaagagaaggtgagccacccctcatgcgaggggcaacctccacacaaacccgaaggaaaaggagatgaaaggaagagtagattagacaaacaaataaaataaaattatttgggttagtatgctagaggtagttgtagatgtgatgtattgtactccctctgtcccataatataagggattttggatggatgtgacacattatagtacaatgattatagagagacagtttgtccagattccctacaatctcttatattatgggacgaagagagtatatatcatctcttattttaaatagataaaatagatatggcagccaccccttctataagatttgccctaactctttggttaagttaaaaaggacatctactcataaacaactgttaatcaccatttgattgggatcatcaattacatctgtcaggagggtgtctcctcgtcagaaaatgcagattggattcgacgccgacctgccttccgctgctgcttttcgagattgtcgacatgaccacatgtaaacaaaggctgtggccttgtttagattcttcgggttattaaatagcccttcgaaatcttgctatttaagattattaaacgtagattatcgataaaactgattccataatcccttggctattttgtgagacgaatctaattatgtatattaattcatgattagcagctgattactgtagcaaatcatggattaatatatgtcgttagattcgtctcgcaacatagcctagtggttatggaataggttttgtcagtaatctacgtttaatactcttaaataacgagattccagagggctatttaataaccctccggatccaaatagggcctgtgtttagttggatccaaagtttagattttggttgaaattggagatggtgtgactaaaaaattgtgtgtgtatgacatgttgatgtgatggaaaaggactgaagtttggatccaaactttgaatctaaacacagctaaaatcgatgcttgtgcattatacaagctcataaatgcaagaaaaagaaagatgagagatgcaatgcaagatgctgcggacagcagcaagaaaaaaacaggtttttccggtgacgacagattcccacaaaactccgataatcaattcagaaaacatcggcccgtgtgggagaagctcaattaagtagttagaggttagggacttaaaaaaactggatttttctacttattattttatttttaaatgtagaaatcaatagttgaagttttttttaaaaaacctccacaagcaaaagttccccaaatatgcccgtccttccacggaaagagataattttaatttttaaaactaaatttgacatttattttagggtattgttataaacctttatttaccttattgtctttaaaagctaaggacatatttataaaagttttcctaacataaccaatatatctatatcttctatatatagttacagcttctaaacatctaaaactcaacatacaaatatagtaattattagtatcttaaaacttaacatgcaagaataccacgccaacccaccaaatatctaaagtttaatgtataaatatagcaattataaccataatttattatattataaaactcaacatacttacatgctaaatcatcattttgatgcttgataaaaaccgtctcatgtttgcttggtctctaaatttcttccaaatggaattattctaagttgaattcatattagttgtacttcacagcagtaagatatgcgttaaatattgatcatgcggttaagtagattttacatttatatgctcccacatatacattgatagaattcgtatgtacgagttctagaatcaaatccatcgattcatggtataccacaacaaaccgcagagtataactactgccaaacgatgtgatcagaaagcactgacggaggccgccaccgagcaggtaggggtagggcgaccatccaggctccgccgctgccaccgctaccctttttactaataaatattattaatatatagtataaaacttgatcgatcaccgtgaaacaccgtgctggctccaccaggaccatcactgccaagaagaagaggagagtgatagaaagagaaagcgagggaggagagagagagacatgaaggaagctcagagagagagaggccctgtttggcacagctccagagctcagccaaacagtttcagctccaccaaaactgggagtggagttgggtggagctctctcacaaaatgtactagagttgtggagctgggtttaggcagctccacaactccactccaaacttaactcctggagttatatttaggagttggagttataccaaactggcccagagagagagagagttttgcatttgcaactctctcctgtacttctctctctatacaacaactactcctcgactggactcggtccaagagaccacatacccccaacgaccctcctcccctcccccctcctctccccctcgccgagatatattttcccctcggcggcgactcctcctccacctcgtgagctcgccttcggccgccgcctctgcgcctcgcagatccccacccgcgaccgagcgagctggtgccgcatcggtatcgcatcccggtgagcagcgtccacctgacacgattttccttcagttttgctcgcgttaatttctcttctagaccttggatgggagccctttttctcttaatttgtgacagccttgttccacccccaaaaggcgcttggcatgttagatccgtcgtccctggctgactatatgattctttctgtgattcttgattggaactgtgattagtgtaaaatatgccattcttggcttgtttgaattgcctgttctttgcattgaatgatgattctaatcattgtgattgattgatgcatgatggttcattgattctgctgcagttcatcttctggctggacgaattcaattcacggacggtggtggtggtggtgttgactagggatttatttttttaccattggcggctcggctgcatccccaagtgaagaagagaattcgtacatgattccgctaaacaggagggcgagtcagactaggggtggtagatctcgatgccctttctttctctttggttatttactgttgctttagatatatgtatatgcgtctaaataatgttgttgcctttttgatcccctttggcccttgagcatgtgtaccaaccaatagtggcattttttttaatgtttagtttgtccatctaatctatgtgccccatgaaggaaactgttttttttttaagaattgctccacctgaaaaagctgtccttttttctttgccatgggattcacttggtgtacaagcacatgaacacctttcagaggtcatttcacatgcatatgtatgggctagatatttcatatggcaagcagtagtgtgtcttttgatggtatgcactattgccagcagtgaagaatttcttagcaaaaattccttttcagtagatgatcccagcccatttcttctgccttaagtaatgcttgttatgtgcacattaagatttcagtcactacacagataggcaagttgaactaaagctattaggtgcaatatttcaactgaagtcaactaagacatgcaaccatatcgatcttgtttttggtagataaatctttaagcaagcagttgccactttgctgatatcgcatttcaagtcaaagccagagtttgcttgctgtgtagtttcattatcaatgaggactggttcatttgtttgtgcggaacaggggatccatatatctgacattaattaggttgctcttttgtttgaccatgggtatgctttaatttattcaactgttgtaatggttaaatgtttggtcattccctttatgttgtaagttcatcatgttgatagggatggagtacttcgatgctaggcggaagcctcataatgttgggaaagttattgcagctctggtcctcacaacactatgtatatttattttgaagcaatctcctggttttggtggcagtagtgtggtaagatgtctatatttctttttttctcttcttcttctttcatccttattcctttaaatctgcttttaagatcagcctttcctcacgttttcatgttttgatttgtaagtcactttctgctacctataggtttaacttttggacttttctcaacttactttctcttatgtttttcttgttacacaaaaagcaattttaattttgagtatcacctgtattatagaatatgtccttgtataactagcataaaacaaaatgatgactgctattgtagttgtttcaatacacatatcttcatttctgctctcagtgctaacaagcaggtgaggaaagtgacatctctccatccaattgcctttgttattgcaatgtctattacattagttcatgttccaacttgatatttcaatacacatatcttcattagttgtttgccacttctcgttgcggcaagttgatgcctaaatggcatcctaacaaactgtagctttcagccacgagaccttctgacagctaatcaatctgcataataattttgacatgttcctgttcaagaaaactacgatatgatttgcagatgtaaatatatcacatctctaaaactacaggctaactatccagttctttagaataaaatgttaagagactgttgcagagtgaaggtcaaacatagcacattacttttgttgtctagaaacatgtataagctgcgatgcagacctagtatgtgtatggctaaacttggatatgttccatctgttttgacttctgttgcttaatctttcaactcttcatgcaaatccgcctgttatgtttcttatgctgcaattattattatgccattcttatatttcccctatttttaattcaactgtataactgattgtggggttatgtatcttgcagttttctcgccatgaacctggtgttactcatgtcttagtaacaggaggagctggctatattgggtcacatgcttcattacgcctgttaaaggacaattatcgagttaccattgtggtaattaagttttcctttgtactgaatttctgaactggtttgttcttcaaatgccacccttgatggttaattgtgatttttaggacaatctttctagaggaaacatgggagcagtaaaggttctccaagagttgttcccccagccaggaagacttcagtttatctatgctgatcttggagatcaaaaaactgtatcctcattttgtacttctaaattacctcctcgtaatttttaaaatgttcaaatgccagtttttcacttaactggctcccaggtcaacaagatctttgccgaaaatgcgtttgatgctgttatgcactttgctgctgttgcctatgtgggtgagagtacattggaaccccttaggtaagtcattaccttattgacagtttgtcagttccatgagcttgggggacctcttattctactaacccctacagacgttaccattgtacacacccttgtctaatggcctaattgtagtgctaggggaaaaggtccttatgataaaaaacagttttcactattaatccatggtacttggtatgctacaatgttaactccataatcaagtgctttctgatttttagttctcagatatttatattatctgctatcacagatatgatgaactgtataatatatctgaaacatgtctagtatatctctgataatcttaagtatttaacaggtactatcacaatattacatcgaacaccttattgattttggaggctatggcgtctcatggagtcaagacccttatttactctagtacatgtgccacctatggagaaccagagaagatgcctattgtagaaaccacacgtcaggtaattaatttatgatggcctcaaaactgcagtgtttggattgtgctgtgctatttcatcttgttgctggaaaggcaaactcaaggctgatgtgtaaatattatgtacctaattggttaataatttactctgttacagttaccaattaatccctatggaaaagctaagaaaatggcggaggacatcatactagatttcacgaaggggagaaaggacatggctgtgatgattttaaggtatgttgtttttccatggatataggcttgcaatttctgaacacaaaattggtatgtactaacatgtcaccttttgcattagatatttcaatgttattggatcagacccagagggaagactaggtgaagctcctagacctgaactacgagagcatggaaggatatccggggcatgctttgatgctgcgttaggaatcattccagggctgaaggtattttctcttatactttgactgtacagtacccctggtgtaaagcataatttagtgtattactaccatatatcagctttggatgttgataatagcaatatgatatacccatctagaagatacttgttttttgaagtattatacctgtatccagagactgaaactacagaagataatttagatttgaagctgatacttcatgaatcaattgcaggttaaaggaacagattatcctacaactgatggaacctgcataagagactacattgatgtcacagatcttgttgatgctcatgtgaaagcactcaacaaggcagagccaagtaaagttggcatttacaatgttggcactggaagaggtttgacaatatgagctttctttatttactttgattaaatgcagttcgctcatgctaggacagaatcagattttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25576 - DNA, 9054 bp, Oryza sativa
gtcatctattaaaaaacggagatagtacatgaatagtgatcgctgactcactcctgtcaaacatgttacacaagtcctgggaataacattcaagatcttgttatgaattttggagggagagatcccctaacaacaaatcagatgtttttcaattgaaacctgaaaatgttgccacctgtccatttttattcaataaaaaggtactaatccaaagtgcctaatcaaagtttaaatgaagatggctccacaaatcaacaatcccaaaaaggacccatcatttataagctgcctaatctcagctactaccatttgactaaaatgctcaattaggcctaccagattgcatcttttttgtcttggccatagtctccaatcaagctggagaaacagagaggccatcatagataggagtagcaccatgaactctccaatgctcatgcttaaattctgccggttcatgcgtctctttgcaggttggtgagcagtgcgttttgcctcctctctctttcagtttttggcagcagatcagttaatatggtatgctggggtttgcatgaagtggtagttagcaacttgcaaggctgcagcaacaggtgaccaaacctaacgcacatgcacaagcaaccaggatttcttttggagagagagtgatggatttggatcatattggtgtatgcaagtgcccacaacatgtctctttttttagttgccacgccaagtctcccccattggtttacacaaaagaaattcctcccattttgttcggcatggtgaattttgaatagatatgatttctcggtttatcagcagcatccacaattttagtgttgattttaccttttttattatagtctattttttagtattggtttttaaattgtgaataatatagatataaaagttttattaataaattatgtttagcttttcgttcatatttctataagcttatcagtcgcatcttaaccaatgctattataaagacgcaaatgttaggaaaggatctaatatcaaataattagaaggggcgaggtttcgaacccaggtcatctagcccaccaccttatggagctagccggaagacccccgggtatttctcaccaatgctattatacatctcgatgcagaggctggactgatttctattataaaaagaaatagatatagttatcatgtagatggtgaatgtttatggtactaccacatagaacggctaaaattgtcacatgataaggatgagatgagagtgtgcttctggtaggatgaaccgggagcaaattaagctttgttggtcatcggttagctgacaacatttatgtgaatagtatccagagtactaaccaaagtatggtactccaaaaagtacagactatcataacttttagtagtacgtcactattattattatttgtctggaattttagtagtatgcgagacaaatacggagtactatgatacatgcatgattcaggctgtaaatctcagtgtaaatctcttccattatcttaaaacggcaatgcttccatttatctaaaaaaataactatcattagttataatataatattgtgctaacaatttgcatgatgaatttacccacagctttcttttcatcacagaaagatccttcttttcccacaactaatttggctttttgctaaaatttatacagcctatagtaagcctctgttcgctagttctggttgggaaccgatgccccatgcacggaaaacggagcggtcaattagcatgtgattaattaagtattagtatttttttcaaaaatagattaatttgattttttaaagcaattttcatatagaatatttttttttaaaaaaaacgcaccgtttagcagtttgaaaaacgtgcgcgcggaaaacgagagagaagagttggtaacctgggggaagaacttagcctaagctgtactctctccatatgcatagagagtttcagcagtgaattcaacatttcacattggaggcttggatagcaggtcatatttagatttaaattttatgttatcccttggttaattgttctaattttatttccaggtttactgatccaaattccacaacagagcctaaaattgctgtggtaatgtctaatacaactggcacatattaaaaaaaacatgactaataactctatacaaagtgcttatggtaataaaattttgaccaaattttattacaactttcttataatctaactaacttgaatttccatgcaaaccagaatcactccaaattttgacaggaaaaaaagggaagagtttatacttctcggggttttggcccaagttatcgcagcctaggcccaacaacacgggctgttctcactgggccaagacgggccgaagcggcccaagcccacgttcccgaagcctctccaccatcctagggtttgcttcccccgaagcacctatatataccaccacgcgccggctcttttccactttctcccttttccaccgccgccgccgccgccgaaaaagaagaagaagccgacgaggaggcgaccatgagggccaaggtaaccaacctccccgccgtctcctcctcctccctaggctgtctacgcccatgtgttgttgcgtcgtcgccgtgcttgttcttggttggtcgggggctgtgattacaaagagagaggctcgagtggtgaattttcacgggaaaccctagcgaggcggcggatctcgccgtgtgcccccctcctccccacgagcaccccgtgtgttcacggcggtggagtggatggaacccgaggtgccgccccatcgcgatgttggcttgggtatctcggtagttgcatccatggctcaccatgctagtactactccctccccgtccaaaatgttattgctacttcctccgtttcataaggttataagttcatttctgggggaggaatggatggcgcgtggtggtgggttgctgtctcgtgagggggtttcctgccacgatgaaggcttcgtttttaacgcatacacttgatatgagccccctttatgatggtattttttatgatggtatttggttggcgagctgaattcctgttcttgcaacatctgatggatggtgcgtgatatttgcttggattacccgtttgtcagttagcataggaaattaggtttatccattagatgctgaagatgctcattaattttgtggtgctcactgtttaaataatactccgtagtactgtctgtaggaaattataactattatatactaatagtagctgttaagttgatcagtaattatgtgatgctcactgtctatatgctattcctgctgtagtttcagtaggaaattatgaatgctttcaattccctgtgaacatgaaattcagttacataactgcattatcggtgattacctaagttaccatttcatagtagttatttttgtggtgcaaagcttatccagggaagtacatcttaatcattcattcatgatttgatagactttgtaatatgaaattgtcattctgtattttgtcaatctgtattgccattttgccatccatgatgcccctacttcagttggtttgttcaacaatgtctatgctggcattcttgaatcacccaagcaatgaatttaaatcaactaaatttgctgtgatgctatgttgcttcttgcttctgcgttccagtttctgttcacccttgtgttctttgagagaaggctactgtgttgtgatcttttgcagtttcttagctatgctaccatgcttatcggctaattttcatcagttaactttctgtgatctgatacttctgtttgtattgtattcagtggaagaagaagcgcatgaggaggctgaagaggaagcgccgaaagatgaggcagagatctaagtaggcgaaggagatgggcgatcatggtgatggcgtgtcgcagtgatccatgtcttcggctgccaagctcgttgatatgtcaagctgcttggcgtggtgccaccattcgactgttgaatggcttatttacctgtgctgttatcatcttatatccctagttttaccaagagttttgcaccaagacatgtcggttcagttatgtgaacttgttatggagccgtatttgctgctaatgtttacctaccgttgagtaattgctttgttggctctgtggtaacatctattgattgctgctttatctgttagcattggtgtgttgatctctgcgttattgcttgcttgatggtttcagtgtaggaatttccctggagacgctgatgctcagcctggacaggccttactttttctttagaagcttaacattgttttgcatgtctgcagttcttcggctggttcttgcttcctgtggtagcttgtttgttgttctacttagggcctgttttgcagggtttaacttccaaatttaactcaagagttggctttggagagcagcctgaaccctgctctctagtctatggctgtgtttagtttcatgctaaaattggaagcttgactaaaaattggaagtttgaagaaaaaagttggaagtttattagccctatcgtttggcctaaacagctaaagaataaaccaaaatttgattttgaaatgcttttaacataatttttttttaatgttggcttttaagttttgaaatgcttatgtgtgcatgtgatggaaaagtaaagttaggaactaaacaaagcatatgatttgagagcataccagtctgttctgatcccttttaaggcgaagctgaaacatcttggttctctagtttattttctgagaggtgcagctcaaaacagtttgatttaaataagccctaggagtatgtagtttggagatattttgcaaattttgaatttgctgttcattgcggttaagtaattttgcgtttatttcatatcgtgagcaatggtgtgacattggataggttgtttaaatctgttttagatgtagcgtggaaagattagatggaagccgtctaaatcatgttcatgaacgtatatttttcgtttatttcgctgctttcacggtgtttcgacctctgtgttctggtagcttttcttggtacgctgcgttggaaggatcagttctagctactcattgcatactgttcaatgttaacgatgcatattattgtggttgattgatgaattttaaactcagcgataatttgagggatataaagtgaacttattcatagactgaattaggcccaaatataaccgcacagcccatttcacatccaaatgtgggcccattacatggaggcccatcaccgtctcgcactttctcgcttctagtccccaatctgaagcccccctcgatggcatcgccgctccaatggacggctccgatccacccgccgccgcctccccatccgccgcagctgccgccggcgacgacgacgacgagcgagccgccgcgcccgcggcccagccggagcggtgcgaggctctggccggggccatcgcgggggtgctgggcggcgcgctgcaggaacacgaggcgtgcgcggcggccaccgctcggagccagggcgagctcgccgccgccgtcgaccggctcaacggaggtgagtgcgtgcctgtctctccgagccttccccccgcgacttccgttgctttgcttcctactgctgctgtgtaggctcgtcgactcctagggttttgtgtgccttttatggtgtaggaatcgtcgttcgagttgcgttgacgattttctgctatgtgattgattcgtagaaatgttctgatgcactaaggcgttagcttgcggcatacgtgaaccaataattaacgaattatgcttatagttcacgcattttgtgaattgtgctagtatcgagtacaatcttctttacaagctatgcaatatggacaagtacgtctctaattgtctggatattttgatactgaattactgatatagtcttcttgtttccagcattaggtagatattttcgtgtccgttcccgctgaacttttatctgtttgctacatggatgattggatattcatgttagttcaagaggatttcttttttggtttagagttgtattcaagtggtttggatgagttgaaattagttctatatttatttcaaaatcgtaacattgctaaagatcgtctccatttttttccttattgcaaaacttgttatgattggcttattgaaatagctgttaaactgatgcagacatgcagtacgatttcttgtgtggagttgaactagttcacggaacatgccattcatcttttgttattaaaccttgtagtatactgtacaataaattagcgaaccaggagatttactgactgtacttgtatggttcttagttccaatcataaattgaatcctcatttggttgtttgatatgtttatgattgggacttagagaggttatttgtatttaatttcaccctaaacatgaatgtatgaacttgtaaatcctagtaagggaattgctattatgaagatcaacatagtcagaaacttttgggatatccatactgtccatgcatgacaaagtacgaattcaattttggttgacctgcctatttttttgatctgtctatattcctcgaggtagtttatctacattttctacatctgattcttcctccggtcctcccttaaaaaaatgttgatatttgctcagtttgcctcacatcaaatatgttatttcaaaatgcggtttctccatggccctttgtacatgcactaatgaattatatgaaattacctttattcttttgcagaactagacaagctattagagaatgcaccctccccggtcataatgcaacaagccacaaggatttgttctattcgcaagagagttttagctctgaacatgctcctgcgctccatacaaagacgtatagataacattgatagaattgtttctactggtgtaacaagtggtattgctcttctacgatgaataatgtattggtctgaatctttctgtcaacactttgatgagtcccttatgattaacatcttgcattttgttcgcagatcattcttctcatgtacagttgcacagacagaattgaagttggattgaggtacagcatatagtccccagatgttggccttaataaaatatgctgacaacagattagtcctgatgaatcgaatagagatgcagagttgtgattttccttatttgctagtataatctagtgctaaaaactcgaacaattttatatctgaaatgttataagcctcaccaagtatcacataagaaatcttctctaccttataattgcatcttttattgacttgcatgctgtatatgacacccctgctatgaattacagggtttagaagatagtttccactgttaccccgtgtacacccgtttctatctgggagagttgccatttgaagttctactgtaagcaacattttcgtacgaagttgtgcctaaaagtgagagtaacatttgcagtttgtcctccaaatgagtctcacttactccatttctttttgccatttaatggagtgggagtaatatattggaccaatcttttttttttgttcgtactgcagactgggaaatgtacttcagatgtatcatttgcatttgtgaactttctttttgtgggtgaggaatcgtcactgcatatatcagatgaatgttgctccatcgacacatcgaagttgccaacaacgtgaatcaatcgattgtgttgttatatgttttctgttgtacctttctggccaaccttgttcccacatttcaaacaaattgtctaaattttgtttaatcgatgaagccgacctgtgccggcttgcgtatattcattgatgcggcaacgttagtgaaaacaagaaaatttagaatagttgttaattgattcatctagtacgttactatgtactcactccctttcaaaatataaggagttttggttagacttgacagtattgagatgtgtctcgtctaattaaaactccttatattttgggacggatggagtattatgctctaaatgtactgccagacgaggaaaatattgtgcgcagcgaaacaatctttgatttatcgtttcaagaatgcttcacttacagcctcaatgaacaattaacaatgatttctccatagaatagatgccgtgctctgtaacattctggcgaggcgtattcccaaattccaaacatattcgatcgatgatttggtacacattctggcgagggctattcccaaattgcaaacaaattcgatcgacgactccaaccagtaaattttacagacattcttgccggcagattgcaacctgatgtacaatctggagggttttcttccatgctccaacatgaagtgaaactgactcacagttaatggcacttgcgctggcaaactctagcgccaaccatatatgaagtcactactcagtaaagcatatatgaagtcatgactcagtaaagaaaaacacaccgaattgctcatagtgaaggttgaaccacagggaatgaaaacaatgtgtcagttaacaacaatagatatgaagattgaaccacagggaatgaaaacaatgtgtacagtcatgactcatagaatgctgaagttaacagggaaacaaaccaccacattcacaagcttcccaagaaacaaaggaaagaactaagcaatgaaaaagatatgaccctccagtagaggctctgaatcaaaagctgtacatgtgcgaatgactatctaggatttcctcttgccaatgttacaatcacatcaataaacttatctttctgtcaactttgcttgctgacaacatgagcgcgttggattttctatctatggttccatattacaaaggcatccatgtgctggctaagtacatggagaacctgcatcaatatagagattgtaaggagattatcaatccatgggaagactgcaataatctcaactagtaactgataattatgattcctatggaaaaccatatattaccagttacctgcatttctgttctcagaggcgcatgtaaccatctttgtgacccttaaagagtttcagatgtctcttgttctgagaactgctccgggccagtgcacggcgggttctccatg

SEQ ID NO: 25577 - DNA, 677 bp, Oryza sativa
  unsure (1)..(677): unsure at all n locations
nnnnnnnnnnnnnnnnnnnnnnnnnnnnnnnnnnnnnnnnnnnnnnnnnnnntaacaaaattcagatctaacaggaagaaattaaaaaaatattaatgcatgattaaaacaattaacagtataatttaacataacaaatttggtacaaaattaccatcatcacattgtcttgaatcattaagttcaacagcagatttagaaacaaaagcatcttcatttccctataaaattttcaattcaagaactcaaaaaacaaataatataaataaaacttgcaaataaattatgcaatatatgacaaaaaaaacttacatgaaaagcattatgaataggagaatgaggtaacacattatcattaggcacatgaacttctgcatataaaacgaacgcattaacaaaataaactgaatacaaaataaaaaaatagaaacagcaagaggaaaaactcaaacaccaaaagtattataaaaatatgacttacgagcactaataccagcagaagaaataccaatgtcatcatcagctttagaagtgccaacattctcaattacattttcctcaattacaacattttgatctgattcattacagctagcttcaccaatcatagcaagaacagaaatcaaaagatctccacaagatgaatnnnnnnnnnnnnnnnnnnnnnnnnnnnnnnn

SEQ ID NO: 25578 - DNA, 446 bp, Oryza sativa
acttctggtttgattggaataaataaataaatattaggtatgacacgtatgtccacatcaaatcttcacgggccagcttccttccatcagatttgagaagaaacataaccaatctggactaattccaagtcaattgatttgactatagattaaaaatcatcagctagctgatcacacttatcctcgaaaacacatttctctaacctatataaaccctgccattgttatcgaatttgcaagtgcatccataagatttttattttttttttaaaaaaatgaagccttctcacgtggccgctctcgcggcgctcatggccgccgtggccgcgacggccggcgccgtgacgttcgacgcgacgaacacggcgtcgaacaccgccggcgggcagcggtcgaccgggaggtcggcgtggactacgcgaagcagatgctcgccgacgcgtcgt

SEQ ID NO: 25579 - DNA, 1049 bp, Oryza sativa
tttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcgggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaatagtgattattaaagtgaacagttcaaaggacaacatgaagtcatctagacacatcaagagaagactga

SEQ ID NO: 25580 - DNA, 758 bp, Oryza sativa
atttgggtgatctctagatactcatgaaaggcctggagtatgacttataagctccaacccgagggaatactaatggttgcctagtatcagttatggaattgagtgaaacttaactgcacaagactgacaattcaaggcatagtccattgttcagttgtggtcaggtatagctccttttctaggtgaaagttcaacttaacagtcttcaccgaaacactggtatataaaagctgctatggaatagagagcattctcatgagccttgaaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacatttagttgctctattcctcttcctattccattggtaacttacatcaattactcttaattgattgttggttgatggttgtgtagtgaaggatggttcatggctagttgatgacaattagttgctccattcctcttcctattccatgactcttactcttcatcttccattcctcttataaaatgggaatggatttgatctcccgcgagaaaaagaagacacactttcatccattttccaaagctg

SEQ ID NO: 25581 - DNA, 4848 bp, Oryza sativa
tatatatttgcgacaaattttctcttaaaaacttgacatatataattatagtacaatcatgatgtaattacactataacttgcatgtaactttcaaaaatctctccgtaacatgctatttcgatgaaacggaggttgttggaacaaatcctcttacatgtgtgcgcgtagtgacctttttccttcttcacttgcataaatcttgaaactaatataacggtggaaaattatgtgcaagttatagtgtaattacactacttcctccgtttcatattataagactttctagcattgcccacattcaaaaggagggagtacgattgtagtgtaattatatatgtcaaatttttgggagaaaatttgtcgataaatatatagcaaaattggaacaaaaatatgttgaaacacaatatgtatacatgcaacaccttttttttatccgactaattggtatacctccatctcagaataagttcacctatatcaatttccatatacaaaagtgaacttacagagtagacgaatagacgtacacacgcgcgtttaccatgcaccactcgtggacaagtttggcacggaagtcaatgttgtgagaaaactatttcatacttcatcaatcccaaaatgcaaccatttgtatgttaaatactaaggttaagggggtccctctcagtcatcttattggttaaattttaaattttgaaaatttctcagactcatcttctaagcatagtatggatttcattccactttcctatttcttttcttaacaacaacttatctcatcaaatactacctccattctaaaataattgtaattctaggttgtttggcatatattaagatttgaaaagaaaaactatgatatccctcgttaaatggtatatagataaaagtgagagggtggttgagggtaaaacagagagaaatttaaatgagaagtgattggtaagacaattagtactatattgtgacaactattttaagacaaaattgaatcctagaaatacaattattatgggacataggtagtatgtcgcattttcaaagtcattaatcgtcccataccctattttcttgaagcggattgtgtgagtgttgtcagatctatggtggcgcagacggataacaggtcatcttggtgccatgttttcaaggaagcaaaggcggcaatcacactactcccggcgtttcgtaccgagaaaattagaagataatgtaataaagtagctcctgaattagctcaattagcgatgcgtactaaacattgtgttgtgtggcgtatgcaagctcctccttgtatcacagagctgcttgatcatgattgtatccaacctcttgagtgatcaataaagcattttcttcctcgaaaaaaaaacttcatttattcagccttaaaagatcccaccacagtaggggatcggatgaccgattcaccatcaccattactagctaggtttttatatgtatatagtagagaaaccaagtcaatttaaactatagatggccaaatgagccgctcgggcaggcacgcccgtgcctaggccgaggtcactcgggccggcacggcccgacttatacatcgggccatgccgggccgtgccagcccacgggttgcacacacggcccaataatactcgggtcgtgccgggccggcccgaagacataacagtccattatgcttctccaaagaatatgtctatttttcctccctcaactttttgggctgtgtctatatggctggacaataagtctattttgtattcctcttctctttgggtcttgtcttatatggttgattaagtctattttggatccctctactatttttcttcaattgtgctaggccgtgccggcccaccgtgccgagggagtagctcaggcacggcacggctgtcgggccgggccggcacgggcacgaccctagtcaggccgtattgtgcttgggccgggccaaattgccgtgccttgggctgggccgtcgagccgtcgggccatatggccatctataatttgaactcatttttttttaaatgacggtcaaggctcagccatacttggtcaaaattaatccatctggctgcaaactttaactatattttatacatggtacacttgttttattgtatcatccgtaagcaatacaagtaataattgtataaaatccatagctatgagttccaacaatctatatatatatatatatatatcaatcaacgctggtaattgatctcatggcattcattctaattgcatgcattgatcgatcgatcgatcagttgccgtacttggccttgtaatcctgccacagctgctgcacggtcttcccggtgatctgcacgaagtagtcgacattgtacccgtccttcaacttggcattgatgtcggcgacgaaccctggcttgacgctgtcgcagtagtcgaagaacctcgccgtcacggagtagctgtcctcccagctgttcccttgccccggctgcacccagccggcggcgacgtagccggcgcgcagccgcacgaagtcggcgatcccctcgtacacccacgagtgcgccgcgtagtcctgcagcccccactgccacacgtgcgtcgcctcgtggtacagcacgccggtcacctccgtcctcacgtcgccggagctggagctgtagccgccgacgtaccgcgcgctcaggtggatgccgtcgccgctggtgaacgccacgccgtcgatgtcctccacggtcagggtcaccgcgtccaccggcttccggtcgccgccgtcgccgggctgctcgaaggcgtcccagatgaaggacgacgcgtcggcgagcacctgcttcgcgtagtccacgccgacctcccggtcgaaccgctgcccgccggcggtgctcgacgccgtgttcgtcgcatcgaacgtcacggcgccagcggccgtcgcggccgcggccgcggcggccatgagcgccgcgagagtggccatgtggaaaggcttcatttttctttttatgatcttgtataatcgatgtttgttacggaattttgctaaccatggtagggtttatataggttagagaaaaatgtgttttcgaaattcgaggataagtttgattagctaggtgattgtttttttaagtctatagtcaaatcgattgacttggaattagtcaaaattggttatatttcttctgaaatttgatgaaaggaagctggcccgtgaagatttgatatggacatctaatattttatttttgtttttattccaatcaaaccaggagttgtttattagtctcagataaaagaagtgcagtgacggcaaaggaaacgcctgaaaataatctggcttttagtatcatgacttctaactcttctggatgcatcaattaatgtatgtttgcagatccgctagcaatttcactatgggtgtgtttagttgggaaaaagaaaatttttgggtgtcatatcagaagtttgaccggatgtcggaaggggttttcggacacgaatgaaaaaactaatttcagaactcgccgggaaaccgcgagacgaatcttttgagcctaattaagccgtcattagcacatgtgggttactatagcacttatggctaatcatggactaattaggctcaaaagattcgtctcgctatttccccataactgtacaattagttttttctttttatttatatttaatactctatgcatgtgtctaaagatttgatgtgatgttttttggaaaaaattttggaaactaaacgggccctctcttctctatctgaacataatataaatatgcgtgtcctaattaatatcaagcatatacatctgaaattatttttgccattgcgtgtcggcattacatttcgtgttggagacggtgcagcttgacttaatttgccaagagattaatttccatgttgccaataattagatacaattcagatcctcttcagtactacgcatgcagcactgcagactaacatgtaggcccgaggatttgtggggcccacatgttagtgagcagtactgcagagaacctcagtggagatgggacatgtgtgaccagccaatttccaccaataatatttcaaatctttcctgttgcaaaaatgaatatgtactctaaaatgagaagtttttttaggacaaactttaaatcctaaaatggcatcgaggaagtagtagcatttaggagtaaccatttatggagtcatgatagattgacaggacagtacttgaagctttgacagtgagcacaaattgattacagatggagtataacaagatcaggcagtagtatttcgttgaattttcagtaaagtttcaggcctgcttagattatagttaaaataaatattattaaattttattaatgctaaaattttagcaatttaacaatattgttaagttttgacaggatttcttatgtatttatcagagtttaataatgaactaaatggatgcatatatttaacaactttacctaaatttggtaagatttattttagctacaatctaaacagtccctcggacatcaaacatggctttatttattgccttattatccacatatctgatactaactacagtactactatagtactatatatatatatggccacctcgccggagctgacgtcacgtcagctagccgccgtacttggccttgtaatcttgccagagctggtcgatggtcttgccggagatctggacgaagaagtcgtcgctgtatccgtccttcatcttgccgttgagctgcgccacgaacccctgcaccaccgccggcgagtcgcagtagtcgaggaacctcgccgtcacgtcgtacccctggtcccaccggtcgccctgcccgggctgcacccaatgcg

SEQ ID NO: 25582 - DNA, 3159 bp, Oryza sativa
aaacgctggaaataatccaagcttaatctgacttatagtagtgtcatgacttctaactcttctggatgcatcatttaatgtatgtttgcagatctgctcgcaatttcactttcttctctacgactgaatagaccctatctgaacataaaacatacgtgtcccaactcccaagtcctaatataaaccatatctgaaatcattttctagcatttgcgtgtcaacattacatttcgtgttgcagacggtgcatcttgacttaatttgccaggagattaatttcaccagatgacccaatataatcttggagatgggggcatgtacgagatctttgctgtttcataaatgttgatctctgtttggtgtcctgcagcgtacgaaattcagatagaccggcctaccacaagctagaaacatctggagaagcagctagctgaattatatcttttctgaacttgtgacggctgggagattcagagtttcgtttgatggtggcactgacaaaacctgaattctggttaattacaggtaacgcctaaaccagaatcgctggctcaccacctgtacacatttgtgcagcatatggtctaaactctgaagataatggagcgatttgtttgatttgcaagccggcaggcagctgatcggaatcagacgatacagacaaggcagtctgcagtccgaccaaccagtttagctggagcagttcggcgttttgcagaagctgcaggagaaattcgagaccttggatgtctcaatccgaactcactgttgaaaaccattttctaaattttgccacaaatcacggattaaatctacgtacgtggcgtgcaaatcctgtgcagaaaaaacggtgttccctgttcagttgcataccggcgactgagcagactcgctcctgattgggggaaaaaaataataataatctgcagccagctgcagtgcactcgcagtcgattttccgaccgaaaccgtacgtggcgttcacttcaccgtgggatcgaatcatccaaaaacatcaattcgatatttcgagagaaagcctggaaaatttaggttgacagctctgctgcccagagaaaaactcgtaacgaactctgctgaaatccaaaagcggaagtccaagtcaagaaatttatcatttagtacaccaaataggtcaggctgctttctttctctcttttttcccttttttttgtgagaataggtcaggatgctttgactaattggcttggtgataccgagtactgctcccttcgttgtaaattgtaagaaatatattttttatataatttttaatgatatattttaaccattaacgtattccatattatgtttttaataaaatataaaattagcatcacacgaaagtacttttaaatatgaatctagtcatataacttgtataataattagcatatatatggttagtttgattattagagcttttcttagaaaagaggtcgtcgtttaatttggaacgagggagtactaacaaatacgtatacgtacttagcattgctgatgttcttttcgaagaaattcagacatcccgatgttggctataaatacttcctctcaccaattgcccacataactcaccaagaccaccagacatgaagcttcacgtcgtggcagccatcctgctggccgtggccgcgtcgtcgtcgccgccgcccgccgccgccgtcacctacgaggtgagcaacgaggcggcgagcaccgccggcggccagcggttcgaccgggagtacggcgccgggtacgccaagcaggtgctcgccgccgcctcctccttcacctggagcatcttcagccagccgagcgccgccgaccggaggcccgtcgacgccgtcgtcctcgccgtccgcgacgtcgacggcatcgcctccaccagcggcaacaccatcacgctcggcgccggctacgtcgccggcgtcaccggcaacgacttcaagacgcaggtaattaatagactccggctcatccatgttgactgactaaaattttgaccatccaaactatacacctagactgtgtttagactgtgtttagtttacgtcaaaattaaaagtttggttaaaattagaacgatgtgatgaaaaagtttaaagtttatgtgtgtagaaaagttttaatgtgatggaaaaattggaagtttgaagaaaaacttcggatctaaacatggtgacaatcaacgataatatttacggtgttcctactaagacttcgttcggcaatggctaaattaaagagagtaaaactatttcgttttctgcacgcacgtcccaaacattgtgtttatttttaaaaagttctagaaaagttatttttaaaaatatatcaattcgttttttaatttaaaataattaatgcttaattaaatcatacactaattgctcatcttgttttatatatcttctcaatttttctctttcccatcatcttaaacacacccactttaataaatgtgaccatagatgactagaattccaaccccgatcgatgtccccaaacaaaattaaatctaatcaaccacaacttttacgacaatctctagtttttccaaataatcaagttattttttctcataggtgaccggagtgttgtaccatgaggtggtgcacgtgtggcagtgggggctgcaggattacggggcgcattcgtgggtgtacgaggggatcgccgactttgtgcggctgcgcgccggctacccagcggctggttgggtgcagccggggcaagggaacagctgggaggacagctactccgtgacggcgaggttcttcgactactgcgacagcgtcaagccagggttcgttgccgacctgaacgctaagctgaagaatgggtacaacgtcgactacttcgtgcagatcaccgggaagaccgtgcagcagctgtggcaggattacaaggccaagtatggaaactgatgatcgatcgacgcagagaatgaataagacaagagattaccatcattgattgatatagattgttgtaactcatagctatggagttacacaattattgtattgcttacggatgatagaataaagggacgctgtctagttttcaatcacatgaaaaatacttgcaaattttagtcctttttcaacggtctagattgcctcaagatttatgcgctacagtaatcataac

SEQ ID NO: 25583 - DNA, 1511 bp, Oryza sativa
  unsure (1)..(1511): unsure at all n locations
ttcctcgcgcgatccgccgccgcttctctctcgcgcggagtctcttctctcgcgcgcaaccaatgttgggcgccgccgcgcctcctcctccggcgagacgcgccaccgccgggactcctccggcgagacaccaccagcactgccaccgtactagggtaagccttcttctctttcccctcctctcctcctcctcctagggtttctgctcttctcctctagggtttcccctcagatctttggctcagtggctcaatcctctcttctcatcttcccccaacagcttctctagaacagccaccgtcaatcttgctcccacctgaagcaacacgacgcgctctctccagtggcagtgcgccagtgccccatcccccaggtcaacctcgatagccaccaagagcggttctccagtggccgtcactaagcatcgccagcaccgtgactcagttcgactggttcgtgtcctttatcccaaatctgtgctgtgattgtttatggttcagtttggtttgactggaaatttaatttttgcatcttgtgaatgtggaactaatgagagaaaccacggtttgtgtgaatgatctttgcaaagacttgttaagttcttgttttttggtagacatgttcaggctcagaaaagagttgatctaacgaaccgcaggagaaaccaatgctttgctttcttctggagtgtgaaatttgcatgcaaaaactgattagtaatgtctttgcacaggaaatttgggaccatcagtagagcccaggtctcatcattgcaagttttaacagacaacatattattcttattttgggaatctatccatcactagtacatgtccaaaagaggatagcattagtcagtgcttagagcttacagtcaagatggacagtaggttatcgtgcatgtgtgatgacaatttacaattgtgcaggttcatatgctttaacacataagctacgtggtaaattaaacaacattgattaagaagggaacacacgcgttcactgcttcgacagatcaactacaagaattgtcaagtatgcctccttgtacttcctctcttgccataatttaatttaaatttaatacgcaatttgcaaagggttattgtactttagcatgcactggtatgtaaacctcaacttcttcactcaagattactatttagttttttttctctgctccgtttggtttcccttttctcatctctagctctagttttaccatgattctgtgaaatgaatatttttagatctaacagagaatctttttttactggacagagaatcatttttgctggagttattaggaacattttatgtttagcaatagtatatgttctgatatcttcatgaaattcattattaaactgacaacaacccttcaaagctgaacactatatcgctcatccattagaccagctaatgctactactatttttttttctgaggnnnnnnnnnnnnnnnnnnnnnnnnnnnnnnnnnnnnnnnnnnnnnnnnnnnnnnnnnnnnnn

SEQ ID NO: 25584 - DNA, 5982 bp, Oryza sativa
aatttcagttacaaagcagactgtttgtgacatttttggtttaccttctggtggcttggagtttggaaaggattttgaagctggaaaggaatacattctttcgatgtatgggcttagttgtttgccttcagtgaggttctttggagaccagttcattaaaaaggaacctttgacaaatgagaaagtgattacttcatttcttattgttgctttggcttgttttctttgcccgaattcttctatattgccaagcaccaagtacctcaccatttttcaagatgttaataatctgaggaattatgattggtccaaattcatatatgattggtcaatgaactacatgaagaagtttgtgaagactaacagcttgggaggatgtttgtacatgtgggctgtaagtatttgacatatttgttatttttaatttttttctcttttcagtattaacttattattaatttgttctttttatatttttttggtaggtggtgtaccttgacaatgttgaatttggtgataacaatgtttcaaatgaaattccacgtatttgtgtttggaaaagtgacatgatccatgcttattctgagtttgataaaattgatgatgacacttttggtcttaggcctctaagggattttaaatctacttgctatttccaggttaatactatttttaaaaataaaaatgaatttctttattatttttccttataatgcatattgtattaatgttcttttttttcattgtagcctcaaccttgtgatgaaagaaggatttcttttcagcagaaacttgactgtgctcttcagaatatgttgccagtttacatgaaagagaaaatatgttctatgtttgatagtcattgcacttcacttcatactattgatgattcatcttgtggagatcttttgatttctgttcttgctatgattggtgaagctagctgtaatgaatcagatcaaaatgttgtaattgaggaaaatgtaattgagaatgttggcacttctaaagctgatgatgacattggtatttcttctgctggtattagtgctcgtaagtcatatttttataatacttttggtgttttgagtttttcctcttgctgtttctatttttttattttgtattcagtttattttgttaatgcgttcgttttatatgcagaagttcatgtgcctaatgataatgtgttacctcattctcctattcataatgcttttcatgtaagttttttttgtcatatattgcataatttatttgcaagttttatttatattatttgttttttgagttcttgaattgaaaattttatagggaaatgaagatgcttttgtttctaaatctgctgttgaacttaatgattcaagacaatgtgatgatggtaattttgtaccaaatttgttatgttaaattatactgttaattgttttaatcatgcattaatatttttttaatttcttcctgttagatctgaattttgttacccctcaagttggtaatgctaatcattccaaacagtctgttgatgatcttttggatggtcagttaccttaagctttttttcttttcggttactgatttttttacttgtgaaaagttttttcaaatttatctgtttcaacttattcacttcggaatgttttctcaaatttagctttctataaatttttgtaggttctggaattgctgctgcagctgctgctattcatcgtgttgcaaaaaaatttagatcaagatttaatgattatgggaatgtggaaaatatctttaatcagtcaaggcccttatttagtttgctagattctgaagatgatgttagtgattatgaacatgttttctcagttcagaatgaagatgaaggctctgaaaatgtttccccttcttcaacccaagtaagaatttttatgttctttttttgcattgtactgttttgtgaagcaagttttatataaacatatatgttttcaggcagcatttgtattttcattggatatttttacattatttaatctttcttctctgttatatttgaaattgcagccttttatttcttttcaatcactccctgaaactccagacaatgatacttgcaacactgtcattaatgaaaaccctggaactagtgcagcacataattctcagaattcgaacaagaggctttttaaagatgttacagtaagttatacttttttttaatgttcttacttatgtttctcgtaacttcaaaattttctttattatgttttttgatctgatttttttttcaatttttcatttctttcacagaattctcctgatgttgtttgtttgggtgaaaataaaatttgtgattcatcaaaaagaatgtgtgttaaagctgaacagttatataattcaacaaatcaactgaacaagtacattcgtggaatgagttcttctggcggaaagcttcctatacatggtccaagaagggttttagttcctgctaggcatgcttctgatccttttgtcttttctccaaggcgtcgttttacagtttctgatcaagagaatagatattatattgcaatttgtcgtctttcagatagttcaaagtggcagaggtactaaatgcatatctttttacctgtttatttttatttgatttgattttagctttttatgctttatattttatttttgtagttactatgcagttgatattgacaatgtcaaagcaaagttctacagttttggtcattccctcaagaagaattgtattgtgtcaccttatgtcatttcagtcttctgccgtgttttgtttcaagatagtcatccatcaaagtctaaaagaaactacttttttctatcaattggtgtaagtatatatttttatatcttcagttttattttttttgccaaaatattatgcatatgttgattagctgtattgcatttgataggctgaattgattaatgatataagtgataaaggactggaaaaggttaagaagtcattcgaaggagctaccaatgctagaaaattgcatctttgtgacatggtattttgttagtagtattttttttcctcttattatttcaaccatcttttttttacttatatgtacttttgtcatatgtatttttgcagttatattttcctattctacatcttcagcattggtttctattcattgtggatttaaaggatagaatgcttgtcatactagattgtgtatatcatgaaggagatgatttctatgaacctattatgactcaattggtaagttgcacttttatgattttagttttattattttgatttgcatttttttattttatatttaattgttattttgatctgttttattttcagataaataatctccagactttttgggacaaatttgaatgctctccaatgaattttagcaatttcaaattgaagtttccatctgttctagcccatatttctaggttagcttattttattttctctgatttgtttgtagttttttgttctgttttgatgttagcttatttttttcttttttgtttcatagtgcggattctgggatttttgttatgaaaagcatggaattgtggtctccaagagttattctgcaaaatgaattctcaaatgacaatatcagtaacattcgagttcagtatgcaaatagaattttcttccatcctagcaacaagcttttaagtactgaagttgaagatgtagttctcaattggtttgaccctgtaagttaaagttttctatcttctatatatttttttcattttaattaataattttctttgtaggctaagtttccacgtgttgatactcctggtgctgcttgataattgtttcagtctaaaagctatttggtttgaccttgtaagttaagttttaatacctgttctatattttatttactttgttttgttttgacttttttaaaaaaatttcctttgtaggtaaagtttcttcacgttgatcgtactgctgctgctttgaccagtgtttcagtatacatttcacagtttttcttgaaatgagttgtgtgacaaaaatttgtatgacgaggatatttgttctactggcagtacattagatacatataatgtagcactctagcagtatattacatacttgtaatgtagtatgagaaaaacaattatacaacatttgtagtgtttacagtctgaatgctattacatagaagaaagatctcttttttttttcttccattactgatggtattcaatttgtcctttcatttccaatgtctttggtcagcttgtctttgcatgcaacttctctttaggagtttcctcttgagtattgtttttctttcctgcaaaaaagaagtatgcattaggttttcattatatatagtttcatttttgtatatgtattataattgatttgtttattacttctttttgtagtttttgatgttttcatctcttcttgcttgttccctatattggttatctcacttgttcctgcaaaaaaaacttgttatttctacaatttatagttatatgtggattcttgatcttgctacacttacttgtttctgttgtgtgttgctcatctttacttttcctttttgaagtttctatcatcttctccactattcttctatatctttttggttttcttcctttagtattggccaaatctgggtcttctatttccacttcttctattatctcttcttctgcatgctgcacagtatcattttgtactgtgttgctttcatcttgtgacaggtgtgtttcggcctcctgttcaatcatcaattgcacattcatttctaatttctcaagttcctccatcatgaactgatatgttctttttctttttgatgcttttgatgctatgtcagcacctttccttgatagaacattaaacatcagaacagagttgtctgttgcatctgtatgtatgctgcctttcactttctccttcttttctttttttctccatctatcaataatgtatttttctggaatttttctcacattgagttccaacatcactttcaggatatgtgaacatagcattccatccttagagaacttcccacaaatgcaaccgaagttttcatttggtaagtcaatgatcactatatgtttcctttgtctatattcttgctggatgctattaggtgacacaaacacttcatacactttgccctgttgtatctcagatacttgcaaccttaaagtatcctttaattcattttggaattttctgaatatgtctagattatatagttccgatgcctgctcttcaatgagatagttgaaccatagtgtttttggcatttttgtccttgattggaaatctttgctgtactcagtatcaaagatagtatcatttatgttctcatattccttcataaaactcatcacactgtgttgtggtccaactcctcttttgaatctgctatttgttccctcactcagcgctgtgctttgtataaaagggcagaaatcatatttgaagtagacaggcacaaactgagctctattcttccacattagttgcaagtattttatattttgcaaactgaacttttcaatcatctgaggccaaagcacttcaaattcttcttctgttaggcaattgtttagtatgtcatcatattcctcatacaggtttctatttgcttttgcagagaacatgcttcctatcttttctctgcaatttttcttgatgtgaaatagacagtttctgtgctttgtgttttgaaaaacctgtgcaattgctgatctcatggcattatcttgatctgtaattatagtcttgggatgtttccctcccattgctgttataaatgtttcaaaaacccacttgaatgtctctgccgtttcatctcctaaaaatgcacaaccaaacaagcaagttgacccatgtcctgtaacaccaacaaacggtgcaaatggcatattgtatctgtttgttctatacgttgtgtcaaaactgatacagtcaccatattcctcatatagctgagt

SEQ ID NO: 25585 - DNA, 5182 bp, Oryza sativa
caactggaatctgtatattttgatgaaatgttagcatactactcatacaaatttaaaaatgattataatttatttttgtaattgcaatttttacctctggtgtgatccttgcactgttgtagatttcatcaaattcttggtaactgtaatgtttgcttgggattaataggtcattgtttctgtcttccagcagcatgtcttgttcacaaactctgctcgtagttagtatcattgaattctgcagtgtggaaattttaaaaaatattacatacaattaacaagagtatttctgcaaaatcgattagtagctgtgtatataaattaagtttaaaataaacttacattatatgctgatggtgtttgaagcatacttgtgaaactttctagtcctcttcctccctgcatcatttttatattttgttagtgaagcatatgctgttgtacaataatattaatattacgaatctatatccttaccatatttggttctatgttaatccttggactatttattacttggtgcattagacttgtgtacgacaactgtgctacctgcatttcaatttgttagtatcaaataaagtgttgtgacatgcatttttctatgttacttgtttattcaaattaccggtgtagtatgtgacttaagcatggttaactcatcatgtagtaatgctgggctttgtggcgattgggttgtgccgattcctgtgaattgaaaagcatgatggatcagctagttgaattttcaaattgaattcatttggcgtaaattacatatggttaaagagtatcatttttttctgacctgtaatttgtgtgatactagaacttgtttcttcagtatgctttgtatctattttgtttctctctgattcttttaaacttctttctccatcttgtagttgatgaatatttgtacctgcaagaagtgtcaattttattggtaagtttgatatgtttcttttcttttttgtacaagtattggcatgtcagatttttatgatctagcacagtggatttgtatgtttactaacctgactgtattgttttgttgttaccctctttgcttccttgggttatactcttgctattctcatttggttcagcatatggcattatccttattcctacaaaatataacacaaaatagtgataccataataattcatgtttatacagatcatctaagaataatactaagttacataacaaattaaatgtatgtatatatgtaatttttgcttctgattcactgtacaaatcctggtgttttaattattttgatgcttgcttaatgcttgttaagtctattttctgctttatgcttatatctcatacctgcattttgtttcatatggttttgtttatttccctgtgtctcgaagctaactttctgtttatgttctgaaattgagttcaattctgcacaaaagaaaatcaaacagttaaatgaaagaatcctagaatatatgaagttatactctaattatattgcaaatcaactatacttacatgtgtaactttagttatttgtacatgtaaatatagatgaaatttaatttgaatgacacaaattttccatgttttatgagtattaaaaattatataagatcatgcatatttatatattttttttgctattttgcatcttggtctcgaatagtctacttttttttttaccttttttctccaggggtccaatgcgaactggttcggtaaatttcattcctgcaaaattcatagaataaattagtatatttgactgctgaaaccatcttacaagaatgctaagtagtagatatttattttcaaagcatatgcagcaaaattaaaatgaacttatatgcaagacaaattgtttttataaatgttaatttatctaattactaatgtaatttatcaaatatatgaagtgatgtaaatctgaaactttattgggtttcgatatagttatatagtcaagtataactgaaatcaagttagttacaatatgatttgactgtttttacactgcagttacatgtcagtataactaaagttacaactgtaacttcacatatttcataatgtaactttctatagttctttttatactgctgtttttcttgcaaaatttgccaaagttttgcttgttagtgttggatgtgtgtaatacctatgaactatactagaaatggacaaatatatttgctgtgtgcctttatggtggacattttgtattaatttcatgaatgattcttgctacttaacataaattggatttggagagaatgcttaatgtaggtgtttattttatatctgattgcatatttatttgttaattagagatatttttcatatttatctgatggcaaggactgtaactttatattatcagatttatttcatgtcatattttttctctgaattttctgactttttgcggattggcagtgtgcttgccatgtcctgtttactattttattgtttctccctgttctttccagtgaagttgctgcttgtttggaatgatatcctagagccattgagtgattaactcattgcatgtagctttattaactcattgatagctaactttgacctttaattgctgcacaaattccacttgactgattaactcattgcttgtagctttattacaaaattggttttttattttggacttctgatttggcatttgttacatatgttttcaaaagtggttaatttgcactgctgattattctacgtgcacatttgctgattgtgactgtcttgttctattgcaatactccagttggactagcatgtcaatccctcatatttgtccaactgatcccatgtgcatattaaattgaaatgtacatttttagtgatcaagtatttttgtttaaagaagtttgtccaacttgttttaatgtggtttgttgtatagtcagtggttaatgaaatgatattatctaatggagttcatgatctgatcagatttatatcttcagatgatatgtcagtttctaaacattattgtatatgaagtttttgaatgttggtttttttttaccaaattgatgtttttgttctctgaaaaattagtgttagctttcatttcatttgtatggcgctacaaatagatttgtatgaagttacaggataaaataatggaaattacagttgtagttacattggaaatatatatgaattacaaatgtaattttaggtctgtggtgatgtaagttgttcttcaagtcaagtataattaaagtcaagttagttacaatatgatttgactgtttttacactgcagttacatgtcagtataactgaagttacaattgtaacttcacatatttcataatgtaactttctatagttctttttatactactgtttttcttgcaaaaatttccaaagttttgcttcttagtgttgcatgtgtgcactagctatgaactgtactagaaatgggcaaatatatttgctgtgtgcctttatggtggacctttttgtagtaatttcatgaatgattcttgctacttaacagaaattggatttggagagaatgcttattgtaggaatatgtgataacttagtgtgttttttttatatatggcatgtgcattttgtatggcaatagatttgtatgaagttgcaggataaaacaatggaaattacagttgtagttacattggaaatatatatgaattacaaatgtaatttaaggtctgtggtgatgtaagttttgatattgttccaattgttcttcaagtcaagtataactgaagtcaagttagttacattatgatttgactgtttttacactgcagttacatgtcagtataactgaagttacatctgtaactttacatatttcataatgtaactttttataattctttttatactgttgtttttcttgcaaaaatttgcaaagttctgcttcttagtgttgcatgtgtgcactagctatgaactgtactagaaatgtgtaaatatattgttgtgtgcttgtatggtgcaaatttttcagttcaacatgtgtatgtacagtgtaattttctgtatttactatatgattgtttcttgttaattaactgaccttgtttggatcttgatgttttgattttttcttcagatttgatcttggattttggttcttcttcttctcttttcttctttgcctttttcttttcgctctccatgtctatcttcttcgatctgactttggatctgttttggatgggagaagcgttgattcgctggatgtgtgctttgatcacgtgatgtatgtgctgtccttttctccagctttcttgattgccaagttgattgattttgggctataatcataaaattatttgttgtgtttttggcccaatatgattttatcggcccattattatatttacacgttgcaattttggcccaatttaggccttttattttttttctatttgtttccttctttatttttgctgccgttggatgctaatccaagggatcagaaatctgacaaatttggggcctgaaaatttgtcgaatgatgtgtagagagaccctaactgaaataaaaataggacggagatgttgtaagttgtaaccgaacgcaacaaataccatatcaaatttacagcccaatgggctaaaagtgcataagacaacgggctcctatatgaccacacaagctagatatagatagatgacggcaattcgacatggcaacatgtaccagcagttgaacatagtcgaaccctccagcccatgaatgccactactatagtctatagtagctcactcatcgccatcgtcggaccaggtgatgtgctccatcccgacgctcttgtcgaggccgagggcgtcccacaccgccggcgacgcgtccacgatgttgttgtcgcacggcggctcgtagttgtgctcgccgtcgcaaccgtgcacggagtcgcactcgtccaccactttgccaccaccgacctcccgctgccgccgctcgccgtgatcctgacccggtgcccgcaccgcgccatgccggcgaaccaccccgtcgacagcactccgcgggcccgccgccgtccttccccttctcgaagctgttcagcgtcagcacggcgccggcggccgccgtcaccggcggggagcaccggtactgcgggtacgccttgccgtcctcgcagcagtccgggtcgttgctctttcgcagttg

SEQ ID NO: 25586 - DNA, 5083 bp, Oryza sativa
agaaaagcggaacaagcctccgctgtcataaccttttccaacaaaagtcccatatttagatacgacacatttattggactcaaacacaagtctaaaatcttctctacacaatagagagccgctaactagattcttctttattgaagggacatgctgcacattcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttaccgtaccccgatgttcctccgccctcactaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcgtcagaaactccgaacttggcctcaagtgcatcccgcatgtccttcccagaaggcatgtgcatgtacaccttcactatgttgtcagcgagtacactgatcaatgctccacggaacaggcaatccgaagcctcgaacttagcctcttcctcaagagaaagaggggttcacttcgtttgccccgtgaaacatagaagcactgcatcgctgtcaaccacaatagtgcacgtgttttccatctcttatagtttgaaccattttttgcatgtggtttcagtgcaggggctgagcgaactaccgaaaatgctcttctcgcagtttttggattgttggaaatttggtcataattcggcatattttaatccaaaataacaagataataaacatgatatttacaataggatttgatccagtgatagtggtgaatgtaatcaacatgagcatgcttaacgttgaataagcatcaccaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacatgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttctttttctcgcgggagatcaaatccattcccattttataagaggaatggaagatgaagagtaagagtcatggaataggaagaggaatggagcaactaattgtcatcaactagccatgaaccatccttcactacacaaccatcaaccaacaatcaattaagagtaattgatgtaagttaccaatggaataggaagaggaatagagcaactaaatgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaggacttccccgggaggtagccgctgggacggcacgcgccgccggcgacggcgccggggcggagggaggaggcgaggtgggtggtggagagcgcggccaggaggaagatcatcgccatggcggccactgctctggcactcgccatcttagctagttgttgcgctaccttgttgtcttcagttttcttgatgagtttgtgctttgatttgcttgatggaatgggattagagatgcatgaggttatatagctttgttgcttgcattagttaatcaattggttttctggcacggcaatccgttgctgtgtgtgttcagatgtagctacacgttcacggactcgcattatctctcgacgaactgacgtgccgttccaaacgattctccaataccttttttttttattatctgtacgttgtgaatctctttaatttcgtgtctaacatgcataaaattgattgttaataatcgtgcttaattaagctttagttcaactaactcgcatgttcaattgattggtaataatcgtgcttaagattcacctctttagggcaacaacaatgcttaaaatcttggtgaaaatttaggacccatcatacttatgtttatgaccacaatgtatatcataaaatcttatagctcatttttatggcatattgtggatgttcttagtgtctgtcaaggaggcacacgagtgttattttttttagtgtgtgcattttttgtaaagtatagttttgtgagtattgagaaataccaagaaatgacttatttgagcacacagtactacagctgccgtaaatcagtgtacccattcctataagaatccgtaattttttttgcgataaaaaaaaccgttgtatagcataaaaaccgtcaaattcattattctgtcgaccaaccgtcaagtaaaaaccgccgagtcgtaagggaatattcagttttgttggccgccgaaagggaatgacctctttagcgttcttcagacaagaccacacaacctcgaattctcccacgctcgcgttgagcccaagctttctcccacaccaccggcgacccgccgacggcgttgttccggcacggcggcgcgaacccgtcctcctcgcggcacccgttcacggagtcgcaatcgtccaccaccctggcgaccacggacgatcgtccgctcgccgcgccggcgacggcgaagacgcggatcctccggtggcagcggcggcggccgccgccgaggcgcagccacccggaggacagcgcgaccaccagctccgtgttccggtggaagcgcatgtcgcaggacgtggggacgcctccgtcgtcctcgccgtggtcgaacaccttcagcgtcaggatcgccggcgtcgtcctggccgatcgacaccggcggcgagcacctgaaccgcgggtagcgctcgccggcgacgcagcagtcatggctccccttgggacacctcgtctcgttgccgtggaggtagacgtagccgctggcatggcagctggccgctgcatcagagacgccatggatggtaggggaggtagacagcaagctcatggcctgcaagagagcaaacagaaatagtatagccttgtgttatccatgtctcctactactgatttcaaagtttcttcttcttcgttttctttttaacaatgattcaaagtttctttgatggaattcaaattcatgaattcaagttcatgttgaatggatggggttaattacatgcatgtgtggcatatatagggagctctatgtgggatgttccagcaattcgtatgctagtgttttgactggacatgtaacacaatgtgatttttcttggtttgtcgatcccaaggttattagtgttttgaccaagaaattttatgtgtttccatgtgcatgttagaagttgaatcatttgataatgttaagaccagtgtcgtgttgtgttgtgttgtgttgctcaatattagctttggtactagccagtgattcactgagcaacggagtagttaatagcattggtcattatctcaaaaaagtaaactgaaacttaattgagctggtcaaaattggcatccttgtgatcgctatgaaagattatgtttgtaccactgaaaaatcaggaagcatatatagcgcagtttccatgaatctatgttcatctaaaaaattcaatcccaaaatctcaaagcgcactgttattacttattaatactagtagcagcactgcagcaacactaatactaacaatgttattatctgaatatttcaggtactgtggtatatgcaattgaaaaagctgaatccaagtgtttttcttatctgtgacttttagtggaaaactgagattctttcttttgtttttgtcccagctcatttacatttctcttggactgctgtctgtacacatcacatatcctatataattttattgtacagttcatgtcttggagttgtcattttctaatagtttggactgatggataaaactcaaacatttctatcattggaaggattcaaaacatatttattgatgtggattagaacacttgattgtgttgtcatagagatcgaagatgcagtaaaggagtatcctatggcaaaagtaaacattacacataatgaaattcattgcattagtgtatcacatattgaacaagtgcctttatgtgctaacctcctttgctagttgtaaatttcagggtttcaacaattgcatagacatcaattaaaaaagaaaaaaattgaacaaaatgtctggcctattttcttctgaaatcttgtaattaatcatgatagctgtgccatcactaaagtactgaaatatataatgagtcatttttcccacaaaatgctagatctactagcactaaattattttagtgcaaat

SEQ ID NO: 25587 - DNA, 629 bp, Oryza sativa
  unsure (1)..(629): unsure at all n locations
ggtaccctacctggtcatggatttggtaatatagaagtgaatttcattcacagtaggaatatattgaaaaattttttcatctagcacttttttttggtaatggggattaacataccactttgctgaaaatggccatgacagactcgtttttcaaattcagaccttgtgctgccttcttaacagcctgtcgtctattagtgtcatatccatcaacagatgaaattgcttccacgacaacctgcaaagcactaacggttgtaagaacaccactaacacagaacaggccatcaactttgcctgaacaagggaaatatagaacaggcaacatagaatatttcatatcaccttttcaaacaacttgccacagatttctgaatggacagcatcaacagtttcttgtggaatgcagagacgcacttggaatgccatcaaagcttccacttcgtccttgttcagctctccatccgctacaaactgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25588 - DNA, 984 bp, Oryza sativa
  unsure (1)..(984): unsure at all n locations
nnnnnnnnnnnnnnnnnnnnnnnnnnnnnnnnnnnnnnnnnnnnnnnnnnnnnatatatgtatgattgctttcaggtcgttcagtcaaggagtttgtggatgcctgcaaaaagggaactggagtcaacattaaaattgagtacctcagcaggaggccaggggactatgctgaagtatacagtgacccaacaaagatcaacacggagctcaactggactgctcaatataccgacctcaaggaaagcctgtcagtcgcttggagatggcaaaagtcacatccacgcggatatgggtcaaactaaatatagcttgctgatcaataattctgctgaatcgtcgatatattgatttttttagttagtggtataggatcttggtgcgataccgcttccacagtcactcatttgttatttttttctctttttattttcaaaggtttgttgttattttctagcaaaaccataagcagtgatcttgatatgctggaaatcctggaagccttcctgtaagggcaaatttcattgttttttgacacaaattgctgataaaaagaagtgtacattgtctcttaccattctgagatgcaagcttgtgaactgaactatagactacaaatatccctgtgttttgttatctatggaatgctcatcaccatttcgtgccaactgttgggtacacgtgtattgttaagcagtatcaaatcaggcgttgttcttgtgcagcctcacctgctacgcattttcaggcaaccggtttgacatgctcatgttgttttgtcagatcaggcatgcttaggttgtcattaacaaactttcagtaccaacttgatttcccatgaatgagcctgggggttgttttcaaattttgtttggtctacatttgacttctgtttgaaggtggcagcatggcagagttatactgttacaaatcatataatccctccgttttttaatagatgacgccgttgactttttctcacatgta

SEQ ID NO: 25589 - DNA, 658 bp, Oryza sativa
  unsure (1)..(658): unsure at all n locations
nnnnnnnnnnnnnnnnnnnnnnnnnnnnnnnnnnnnnnnnnnnnnntactttgcttatatggccattgacagtctacctggcaaccagttttgggaaagaataagacttatattcatcccatcaagccgacgctacaagtaatatctctatctgcatctgtttaccccatttgaacaatgaattgcatgcttgactacttgcggtgcagcctatgtgcctccttttggattaatcgtaagataatccattttttgtcaaaacagtgattaacagctcacactatgcttcaacatttgcagggttttggagggtccccatgcgtctttcatggagtcagtgccttcaaaaacaattactgtcttcacgatcttccagttggtttacctcttgatatgcttcggcataacatggataccaatagcagggatcctgttcccgttgccattcttccttatgattcttatcaggcagcatgtcctcccaaagttttttgagccaaatgaccttcgggaattggatgcagctgagtatgaagagcttgaaggtgtccaccacgatcacacgctggtataaatttatctcccattcttggattatttacttgtcagtgatgattgtgtttcactctttaattctccgatgggtaccgagctcgaa

SEQ ID NO: 25590 - DNA, 77797 bp, Oryza sativa
  unsure (1)..(77797): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagactgtcccggtggggtcgctccttaccggcgaaatgagaaggtgaaacaaaaagaaacacagtaaaaaaaattagtactacctctgttccatagtaagtgtagccatgatattccgcgtcaactttgatcgagctaactttgatcatccgttttatttgaaatttttttataattagcatttttgttgtcatgaaatgataaaatatgaatagtactttacctcgtgacttatgtttttaattttttttaaaaaattttcaaataagacgaacggtcaaagttggacgcggaaaaccatggctgcacttattttgggacggagtaagtactccctccgtcccataataataagggattttgagtttttgtttgtaacgtttgaccactcgtcttattcaaatttttttgaaattattatttattttatttgtgacttactttattatctacagtactttaagcataacttttttttatatttgaaaaaaaaattaaataagaagagtggttaaacgttgtaatcaaaagctcaaaatttaagtgggactgatggagtagtatatgtaccagtacttgtctgatccaacaagcaaaaactctctgtgtactttgttcgatcgctttcctatgcaaaatgtcggtagcggagatagcgcccggctagcacgggcgcccgggctccaccctccaccacatttaacagctgcacacttaattaatgtcatacttaatctgttggttcgccggtcaaatcaggtgggcaaactagcgaagtaatccctccatcccatacctccatcctataatataggagatttttggtggacgtaacacatgctaatacaataaatttagacagacggttttaactaaatttattgtactaagatgcgtcacatccatcaaaaatctcctgtattataagacagagagagtatggtttaacatcatcacattgtgcagtctgcagcttatggaccaaagagaggcagtacacagccatattattgttccatcgcaataatttgtagcactggtccatcacaagttagcaactactcctcgctatttttcattttatattaggagtattaaatttgcccgcatctatattaaatcataactgctatgtgtaggtgtatggattaatgtcccgagttcgaaaatgccgacgatggcaatcaactaatgtctccgtccaaaataaatttatttttcacctatttcatgcatacaaatataaaataaaaaatagaatatcatactttatcaaatcgcaatgtaactactttttaatttatctactcctaatataattattctctacttttataaactccgatgcaataattactcaaaaataaacttactgtaagataaatgaaatgatctaaaaccaaacttattatgaagcatttttcacttatctcacacatatcaatacaaaataaaaaataacacagccatattttattaaatcctaatacaattatttctctttttatctattactaatatatttatcttatctcacatatatcaatacaaaataatgattactaaaattaagtttatgttggatacaagaagttattatgtaacagagggaggagtaactattaaggcttgtactctcttcatcccattttaaacgcagtcatgagttttttttccaactctaattatacgtattatttaaaattattttatggttagtattttttattgttattttataataaaacataaatagtactttgtgtcttatttatgtgttttaaatttttttaaataaaacgaacaacaaaaattagacatgaaaactcatgtgtgcgcttaaactgggactatactacctaagctcggtatcgtaaaaagctgcttagctcggctatatatatattggtgcgctgaaagcctaggttggttccggttcgcaagttaactcattacgagctttggcttattcatattacctttacgacttttagctagagttctgacattatacatttgccgatttatcatttgctagtcttaaacattattccttccatcctaaaatataaacattaaaaatcaaattcataactaaaatttactgtattttaaaatggatgtagtacactacaagacttagaacctagcctgtaggagcgaaacaagtaattaaaaacttacgagcagggttcactgtaccgtcggtaaccgcgcggttaccgtggggtacggtaatgtaaataccacggtaacctccttaaattcaaataaatttaaaaaataatttaaatttttgatgaattttgtacagtttttcacagttaccgtggtttaccgtgcggtaaccgtgcttacggccggggcgcggtaaccccagcctcagcggtttgggaaaccctgcttacgagtaaatacaaatacaatagcttacaaacaatcggagacttacgagtagtattgagtaagaagcataagcataaatagagatattggtcttgcatactaccaagcttaacacgccccactcccgtctcaaaatattacaagcaagctaaaactggacgagatacattctagtataataaatctagacagatttatttagattgtaacacataattaattaactattagctaaaaatgtttaaaaaatgaattgatatgatctttttctaaagattattttcccaaaaacatattgtttaatagttaaggatacgtgcatgcgaggaatgagagagtgcaggttgagaatcttgagttaagaagacagccaagggcaaatgaaatggtgaaactattctaaactctcgaggcgacatcccttcgttgtttacatgtcactcaaatgataagaaaaaaattgataagatagattaataacgatgtgttagatcactccacaaacatgcaaattaaattttaacttctacactttgtaaaaaagacatgtgtgactacgaataaacattaattagctgtagtttatttttctcattgcaacttataaaagttggattttaacttacatgtttctaaagtgatatagtatatgttaatacatcttctcaatttttacaatatttttataactattctacgtgtcatgcaaacaataaaaagacatcacctcgagagtttaaaatccactctcaaatgaaatgccattcaaaattgtctgatcggttgagcaacaaaataagctataaaaaaattaacaaagcaaaaaaagtaatttataggtaaataattattactagaattttaaaagtagtaggcataaaaatacaatcaccaaaattaaattataaagttctaaaaagaatcaaacccaagggatgaatattaacatacatgtgtggattcatcccaggttttgatttcttttttcacagagagagtataagccagcaaaaagacatgaaaaccgaatctctctaaagaaatctactcgacgtacgtgttgcagttcccacgctagttgcattgggaagacgaggaaaaccaagccatggcgtcggcgaggcacctccggaacgtgtccatgcgctccggcagcagagctatgcccacctcgatgccgccggcgccagaacgatcctccgccgccgacaccgcgccggtcttcgccacggacacgatctccaccttcgccggcctcccgaacccgaagtcgacgtcgtacacgcggaacctcgtcgacccggccaccgagaacggcgcgtcgtccctgcacgcctccacgatgcgctccttccacccctcccagtacgcgggctcgccgcgcaccgcctcgtcgatggcggcggccaccgccgcgcaggccgtgaagacgccgcccgccacggcggcgccggcgagctcctcctcgggcgccgagacgaagcccgggccgacgcagttgccgaggtacttgtcggggacgcggggcaccagccgcgaccggtggtcgacggagaagatgaagtgggcggcggcggcggcacggccgctgccgccgttgtcgctttcccgtctggagcggcggtagcagtgccacatgaggccgtacatcgccacgagggacgtgcaccgaggcggcggaacgccgcgacgtgcggcctcggcggcgacggcgtccttgacgccctggaggtgctctctggacagggtgaaggtggcgaggaacttgccggcgtcgggcgccttgaacagatctttggcttcgttcgtgggtgcggcgaactcgtcgtgcatctccggtacgtcgcggatgagcgtgcggtcgatgacgggcggctccgggagcttccggtcgccggcgcaggcggcggcccaggtgtggaggaagtgcgtcgagcccaccccgtcgcaggcggagtggtggacgatgacgccgagagcgaggccgcggcgcttgggcggcagcacggtcacctgcagcgcgagctccgcgccgccctcgggaagctccgggacgagcggcgcgatcttggcgagctccctcggctcgtccgtggcgagctcgtcgacgccgacgccgacgccgtcgtgctcggcgacggtgaacgccacgccgtcgccgggctggtagaggagctcgtaccggttggtctcgccgggcgtggggcggacgcggccggcgagcgggtagaaggcgtggatcgcccgtggcagcgactcctccatccgggacagcacggcgtcgacatcgtcgtcggggccgaggcggtagaagaagacgcgctcgacgggctgggcgcggagccacatcacgtccatgaagatgagaggcagggctcgcttgggcagcgcgggctggccggcgggcggcgccggcgcgacgcgcgtcgtgcggaggacgcggaggccagcggcgtgagcggccggtggcggcgccatggtctcgccgcagaacaggtgtggtttgtgttgctcgtggcttagctgcagagcgatggagctttgcttctactcctataatacaatacaatacttatatctctctcacttcacttgtccatatagtaattaatttctaaggttaattagatacatatatcattacaaatttaacggttttaaaatattttattactattcatctaattgaaacaaatatgccactaaatatctccctcacttcactagtccgtagccattaatttctaaggggtactttctttcttaaataaaacgttttgagttttaaatagatcatgtaagcttgatatatatatatatatatatatatatatatatatatatatataatttaaattatacgtatattagtgactctaaacgactgacggtggtggagaaactaaactatcatattattagaatggaggatgagagtaggttattctacctaatcatgtgggactaattgccaatttcccattggcatttgccgagatgaacagtgatgtcacggctgacgacgggtactacgaaatgcttgcaattttgaggctatgagccaacagtttttgggtgctagtttaagctgggatggagggtctgtttggcacaactccagctctaactccacctcttctgaagttggagttcagccaaacagtttcagctccacctaaaatgtgagcggagctgggtgaagctctctcacaaaatgaactagaaaggtggaggtgggtttagacagctccacaactgcactccagacctaacttttggagcaaaatttttaggagttggagctctaccaaacaggtccagagtgtatggtttggcgtcagattcgttggtgccataaaacatggaagtggattcagaggatctcgttagtgccttcacaatgtgctgagctgtcatttagcccgatctctccacgtcagaggttcaatacgaatctttaccatgttcatgagcgggcccaccaaattgaagcccgtgtgaccctttttgtcatccgttcttggcacggggagagaaggctgcaaacgcgttgggagggtgtggcttcattccgcttttcctacatgcactgttgaccttgtggctttcctaggttttggtggcgccttaggccaagcctatgcgtgacccccttaccctcccatctatagatgcaatcatgctcttagggatggcaatgatgatattagatttgctttgaggttcgtgcaagccctcaaccctaactccctctctttctttgtttcctcgtaatgccgctagttctctactctacccaatttccccgcctcctatgttgctacaacgccacccccaagccttctctcacacaatctaaatagaaccctatctgacattgatttatttttaaaccatactagaataattttgtttaagattttaccggaatcaataaaaccattactgacatgtgctattgttaataattagtacatccgtctcaaaatgaatctatcactactacaaaactcctaatatgtactagttttccaccttcaaaaaatagagaaaatataaaaccgatatctttgatcaactatatgtaccggttttaaataaaactagcacatataatattagtgcaactggcatctacacttgtattatctgtgccagctctaaataaaaaatcaacacatgaaaaaacgatctgagctaagagccgagctgaacccatccttatctactcaagtgacttgtacttatcctcgactctctctcgtgcttctctccctcttcctctccttctccagcatctcaccctctccttctccagcgtgcttctccagccattgtctactaccttcaacgacactggcgatgcagcggcagaggcggccgccctctgtccatggagagcagaggtggccagtcccgagctcgggacaaccagatccacgcgcggtagcctcttccttcctctcccctgcgtggcgcggtggcggccgcctcttcctctacctagtgcagtggcggtgaccccttcttgttctctgcacgtcacgacaacagttgcgatgattgtctcttcctctccctgccccagcacgatagacactggatccggccaacacgatggtgactgcaggttattcatggtggagagtaggaatctaattggattgccaatatttcagaatgaatttttgtgatttatgatgtttgatttgtgcggggatgttgttgttggatggatccatggtgatttgtcctatgtgatttggggatgttgtaggatggattgatggtggtatgtggatttctgatgtgtgatttgggtaatggggaggggctcgatgcatcggctcgttttgagccgatacatcgagctgtcttttcatttgtggagtttcaaaggtgtcagttcgtaaactgccacagttgattcctccatatcaatgcctcttgggctgcgtaggttgagaaatccaaacatctatgtgggcttcccaaccgacacctaacacatttatgtgtatttctcccttgccccatcatttcaactaattacaagcattctccatttaatttcttcacctacttactttttttcaattaatcaaaatttttataatcattttcacatatcctcttactataaagttagagcccactaaatcctaaagcttaacatacaaagatgtcacatcatcatccactgataattacaacactcaggctgtgtttggtacggagagtttggaactctcccttcaaacacgtaaaacgaggtggttcattaacacgtgattaattaagtattatctttttttctaaaaaatgatttaatatgatttttttaaagcaacttatgtataaattttttttacaaaaaacgcaccgtttagcagtttgggaagcgtgcgcgcggaaaacgaaagtggtgtggttgggagctcaagctgccgaacacgaccttaaacatcatgcaagcatgttatattatctataattttataatatattaaattttatagcttatcaaatgcaaatatattaaatcatctcacataatatttgattatgtctcatcatctttttttataatatcttatatacctatatagttcatcctaactcgtaacttagttaatgcgctctctctctctcttctctcattaagtcatatcacatcaattgttttgtccttaaatgattatctatggtccaaatcatctcactccttttcttctcttactagaccttacatgattaatctatgatccaaactatctccctccttttcacatcaatttacttttatatttgaatcatcattctatatactatttaaatttaaattatcataaaccatacttgttagggttacgagtaaggtataccctctacccttcgatatacgctacatatcgatatggtatgcttgcgcgtatacggacgttttcggcataagttaaggaagtccattatggagtccacagatggaaagagtcctacttagatagaactgggtcgtcattgtatcgtaccgaatccgatgtctccgagtcctacttggaaaccagttgacctgcggtataaaagggacccccgagaggacctaaggcatcgaatcttaccaccaacacatccactacagcttacgaagccggagcctccaggagccaagtcgccgggatatctagtcgaatctgtggtttccatcatataatcccatatcaactggattagggctattacctaccaaggggcttgaaccaatataatctttgtttttctgcctgcttgatgtcgtactacgtagatcctcgtaccagcgtaccccaataccctctatatccggtctacgtgtatctcccgtcgatagtggcgcgccaggtagggggacttggtgctcaaggttctactattatgacatcctgcttcgtcgacaacagcatcaacaccaacttcaaccaagtagttcctacttcaacaacgctggtgtggactcaagtcggcgaaatcgtcttcccggtttacaccacagtgccgatctcagctggcccgccgatggccggaaatgagaacgcagtggctacaacccaggacgactctatgtcgaaggatcctcccgccgaagcggagatcggaacgtcgacgatatccgagctcgagaaggaacctagtgcggccaagccttgtccttctgacaagaatcacgagccgacgaggatgacttctgaggtgacaaggtcctggtgtcctatccacaaaaccagaaaacatgccttgcaagcctattgggtttttctcaacgtccacgctgaaattcgtgccggcaaaaagcgcggaattcagcgtacttctccaactcgtgatgtctattgtcctattcacaagtcaaagaatcatgacctctcgagctgcaaggtctttctcagcgccatgaagacgccacctcctaaggtccagcagtcacgcgtcgcccttagggatgaggacaaggaacaaggagcgacgccgatttcagatcgatttgttagggtagtcgacatcgatccccacgaaccatcagtcttgcacctgctcaaagactatggttcattgacaacgagtacgccgcgcgaggtattggctatcgacgatgtcggcacgtcagcacacgcaaatgcggaagcggaaaatcaagtgactacaccggcccagcacattggagccgtcaacgcaatattgagggaaaccctctatgatcccgttctgaacgacgatctcgcacgatggacagagcgtttacgggaatcagtgaccaacctcagcaacgcgttcgaagaggccgctgctgtagcgcacccggaacagccaccaactggcgatgctaatggtgaaaaccctgaacagcgggaatcgcctcactgagccacccctccacctcgcggcaccggcgatctccgtgatcacctgaatggtcgccgagaggcgcgacacacacaagacaatgagaaccgttcccgacatcgcatctcttcacggcgtcatgataatgaagaacgaggaggccgttcgagcgaagaccgagaccatgataaccgccacaaccgccgcgatcacgacgatcgcgaacggcgggtgctgggcgatactagtcgaggacgtcgccataatgacgacgacgatggagatcggcgccgagacaacaatgggagacgacgacaagattctcaaaaactcggccgacgtcctcgtaatcgtacgcgaaaccaagcgacccatcgtcatcatcgtcatcttcctcatcctcatcatcagatagacatccgcaaaggacgtacgatcgccgacaacccaccgcccccagcgctgtgttacagctttcggccattcacttcgagatgtccgatggcctgaaagattccgacctggagcaatagagaaatacgatgggagcaccgacccagaagaattccttcaggtttactccacggtactctacgctgccagagcggacaacaacgcattggcgaattacttgccaacggcattgaaaggctctgcacgttcatggctgatgcatctcccccctactccatttcttcgtgggcagacctatggcagcatttcgtcgccaacttccaaggaacttacaagcgccacgcatcgaagacgacctacatgcattgacatagaacccgggtgaatccttgagggattatgttcggcactttaacgagtgcagaaaaacaatccccgaaatcaccgatacttctgtaattcgcgccttcaaatccggtgtcagagatcgctacactactcaggagttggcaacgagacacgtcacgactactcggagattatttgaaattgtcgatcgatgcgcccatgcggacgacgcactgagacgcaagaacgacaaaccgaaaaccggaggagagaagaaaccagccaagggtgcacctgagtcaagtaagaagaaaaatcgcaaaagtggaaaaaggaaagctcaatcggaagtcctcgcaacagaatacgcggaccctcccaagcgcccagacccacaaggtagcgacgcgaagaaaacatggtgccctatacacaagtcagacatacactctttagaagattgcctcgtcttcaaaaagtcgctcgcaaaacatatggcattggaaaaaggcaagcgagtacgtgtggtcgagaaggacgctgagccagctactcaggaatcagactcaacatatccagactccgatctccatgtctcgcacatcttcgggggttccacggcatactcctcaaagcgagaatacaagaaggtggaacgtgaagtttgttcgatgtggcaggggctgcgcccaagatgaagtggtccgagtagaagatagaattctcagaagaggaccacccaaagactgctgtcatcccagggcgatatccgatcgtgatcgaacccactattcgtaacatcaaggtcgcacgagttctaattgatggcggcagctcaatgaaccttctcttcgccagcaccttggacgcgatgtggatcccacgaagcgagttgacacccaccgatcaacccttccatggaatcactcctcagtcatcgtccaaaccattggacaaaattacgttgcctgtgactttcggccaagcaaacaacttccgaatggaatagatcacctttgatgtcgctgaattcgatacatcatacaatgccatcatcgggagaactgcactcgcgaagttcatggccgcatctcactacgcgtatcaagtactcaagatgccgggaccgaagggaacaatcactattcaaggaaatgctaagctggcagtgcaatgcgacaagcggagcgtcgacatggtcgagcacacgcccaacccacctgccacagctgagccacccaagaaagtgagcaaaacaaacaagatgccgaaaccggacggtgcaatcaagatcgttccactctccagtgcaaaccccaacaagaccgtcaaggtcggggcatcactgggcgagaaataggaactcgcgctcatcaccttcctccgtgacaatgctgacgtgttcgcttggcagccgtccgacatgccgggggtacccagggaggtgattgagcacaaacccatggtgcgacccgatgccaagccagtaaagcaaaaactatggagatttgcaccagatcgaaaacaagccatacgagaagaactcgacaagcttctcaaagccagtttcatcagagagatactccatccagagtggctagcaaacccagtcatggtgcggaaggccaacgggaaatagagaatgtgcattgatttcaccgacctcaacaaggcgtgtcccaaggatcacttccctcttcctcgaatagaccaactggtggactcaacagccggttgtgagttgttgagctttctcgacgcttactccggctaccaccaaatcagcatggcgaaagaggacgaggagaagacagcattcatcacgccgttcggggtattctgctacgttaagatgccgttcggactaataaccgcaggaaacactttccagcgcacggtccaaggtgcacttagaaaccaactcggaaacaatgtcgaggcctatgtcgatgacattgttgtcaagaccaagacaagctactcattgattgatgatctgtaggaaacgttcgacaacctccggcgatatcgcctcatgctcaatccagagaagtgcacgttcggagtaccatcgggcaagcttctcggcttcctcgtctctagcagaggaatagaagcaaatcccaagaagatcaaggcaatcgagaacatgaagtcgcctacaagactcaaggaagtacagaagctaaccggatgcatggcggcactaagcaggttcgtcgctaggataggagagcgaggacaacctttttttgctctgctgaaaaagcaagacaaatttgtatggacacaggaagtcgaagaggcattcattgcactcaagcgctacctatcaaatccacctgtacttgttgccccccaacctaatgaagaattatttctctatattgctgccacgccatattccgttagcactgtcattgttgtcgagagagaaggtgcaacgaccagtctactatgtcagcgaagctctccacgatgcaaagacgagatatccacagatccaaaaactgctctacgcggtaatcatgacatcaagaaagctacgccactactttatagcccacagggtcatagttgtatcctccttccctcttggtaaagtagtgagaaacaaagacgttgtcggccgcattgcaaaatgggtagtcgagctaagctagtttgatgtccgctttgcaccacgaacagccatcaagtcccaggtacttgccgacttcatcaccgattggactatgcctgataacaggtcagacaaccaaatcgacaacaaaacgtggacaatggcgttcaacggcacactcaacaaccaaggagtaggggcaggattcatcttgacatcacctttgggagatcaattcaagcatacaattcacctcaacttcagggcgactaataacatagccgagtacgaaggactactcgccgggataaaagttgcagctgcactcggagtcaggagactgatcgtgaaaggcgattccgaactagtcgcaaaccaggtgcataaagattacaagtgctctagccccgagttatccaagtatctcgcagaagtcaggaagctggaaaaaaggttcgatgggatcgaggtccggcatgtataccgcaaagacaacatcgaaccggatgatctagcagggcgtgcgtccagacaagagccacttgaacctggcacctttctggacatgctgaccaggccatcagtgaaagaggcaagcgacgaagatagcctggtcgcccccagcatcagctcgagggctattgaggcagagcgcgccgttcccgatatcgagaccacagacgactggcgcaccccactcattaaattcataggcagcgaagagttgcccgaggacgacgcagaagctgagaaaatatcccgaaaagcaagagtctactgtatgatcggcaacgatctacacaagaaggcaccaaacggggttctcctaaaatgcgtctcgtccgacgacggcagacacctcctcctcgacatacatgaagggatctgtgggtcacatgccgccggtcggacattagtcggaaaagcttttctacaagggttcttctggccaaccgccctcatagacgcctgtgacatggttcagcggtgtgaagcctgttaattccacagtaaacacacaaggttaccagcgcaagcactctagactatccctctcacttggtcgttctcgtgctgggggctagatatactcgggccattcccacgaggacagggtggctacaggttcctattcgtggcgatcgacaagttcactaagtggattgaagcgacacccacggggaaatcaaggccgacaacgccatcaaattcatcaaagggatattttgcagattcggattgccccaccgtatcataacggacaacggctcccagttcatcagtgccgatttccaggattactgcatcaggctaggagtcaagatctgcttcgcctcggtttctcaccctcagagcaatggacaagtcgagagggcaaacggcatagtactacaaggaatcaagacccgcgtctacgacaggctcatgtcgcatgacaagaaatgggtcgaagaacttccatcagtactatgggccgtgcgtaccacaccgacaacatccaacaaggagacacccttcttcctcgtgtacggcttagaggccatgctccccaccgagctacgacatcaaagtacacgagtacagaagtattccgatgaggatcaggaggagcggcgaaatgacgatgtgaatctactcgaggaacatcgcgaacgagttgccgttcgagcagccagctaccaacagtcccttcgccgttaccacgagaagcgcatccgagcacgcacgctttcgatcggcgactacgtcctccgacgggttcaaagccaagcagggcggaacaaactctcacccaaatgggaaggaccgtacacgatcacacaagttgtgcggccaggcgcattcaaaattgcagatggcgatggtcgcgagttgacaaattctttgaacattgatcaattacgtaatttctatgtataagtcaatagtatccatacttgtgagacatcttacagcttcaacaaggcctattttcaggtccagaccacaatcaaagtgttccttcccgatgatcccttacccagatgacacctagcgttgaaacctatcatcatgtccctttacgccgtcttgacaaggcctccgaggtacctaagggaacttcggctagggacgcccagagccgataaggccttgtcggatcctgtagagacgaaagaccatgtaagacctggtcgtgtaagagttctcaccgtgcgtattaaccaagccgtgtaattggaaataaactttccaacttcacggctgggggctaggatcagtgcttgttcaaccgaggcaggtcaaaggtccaagagccttatcttccgagaacaattctccaatgacaaggctgggggctagcgagagtgtataactcaaacgactgatcgaagtcgcgaagtgagaagacactcatacacgctacatctagagtaagaaagcttagttatatagatttcttcactatttcacaagtacttacaattccgtcaaaatcaaaagttatattacaccttttttcctaagacatttgtcacaggatacagagactactaggaaggccaacgctagtccatcgactggaagaccttctccgccagcggcgccatcgacttcgccaggccgtctatctccgtaggagttctccgagaacgagaaaacccttcgcggaggaactcgaggtgcagttgcggacgatgatctcgtatgcaagccaacacatgccccccggcatatcagcttgatcgacgacactcctgcttcaaggcctcgtcgatgcgttgaccgatgccttcaagctgggctcaagccccattcagccacgagatgtatctggccaccgattcctcgggatccccacggggtactcagagctccctacaaactcttgacatgaacgtgcaacaactcttcctatacaagttgaaccacacctcacgaccccggagtgtctctacggcttggtccttcttcacttccagcatagccctctcgagttccgcgacctcaaacttcgtcctccaatactggatgcgacaatcctggtctgcaagcgcactctcgaggtctgcgcagcatggaaacaattaagtcaagctactcttctctcccgagaacacagcaaatctagtcggtccagacagaagcataaagaagatgagaacaaagacaaccgacctaagggagtcgttgctaggctcgtccccacaggcgaactttgatctacatcgccccccggcacaagtggctcgaacgcaagtgctggaacgatcactggcaactcaggcttctcgcgctgctggacatcctcgacatcaacatctctacaaacgacaacaaagtactcaagatcaaaatgctaaagaaagctaaggtgatgaccgcacacacaaaggcagttggaaccaataagagttttacaaagcatgactaaagagtacaagagagctaagatcctactcttcaaaaagtgggaggacggactcccccaggtcgccgacctcctccatcacatccttgcgcgcatcgctggccgccccctgatccaagatcttccgcagatcgagttcagggtgcgccagcctcacacatgcatggacatggcacgccccggtatagatcctgttggacgtctcctctccgatcctggccgcgtgcttagaggggatctcctccatcgccgccgccagctccgcaagagaagtcgtcagggagaactcatcgggatacgccgggatggtagacttgatgccgcactccccggcgagctggtgcagcccagtataggtggcccacaacgagccacggatctccgacaagttgttctcgagctccaacatgcagtgctcaagtccctgccgttgtcactcattgccgaccactagttccctcatcttctggaggtcctcgcgaacctccgccaagttgcccgccagccggtcgtcgcgctcattcgccgacgacgccaccgccgccctcgcctccgcaatctcgtggctaatgccgcaagcactagcctcgaggaggcgccccatctccacctggagctcctcccaggtgaggacggcagccggcgaacaacggccagccacaagatcgctggttgggccgctaggtgtcgcctcgcggctcctgggcactgccacgacatccgtcgaggccacagcaggagacgcgctggaggtccctccagacccgtcttgcgccgccatcgcccgcgccgccctgcgaaaggctgcaattgagacagactgcaagagttcgacgaaatcacggaacctcgaattcattcacttacttctcgccgagcgtcactagctgctgccgtcgcggaggcgggggagacgcgtccgaggcctgaagtatgacagatataatgtgaggtgaaaatcttccgactacgtgataaaagaacaggagaacttaccgagggggtgggtgtcttccgacgatgtccgaccacagaggagaatttcctcccctttttcggaacgttgccaccactcgttgtggcagcggcagcagcagcgtcaggcgcctccttggcgaccttctccttcagcgacgccgccacctgatggtccacgagcggcccgatgatgtcagtcagagggagagcctacacttcatgaagtcataatgcgatcccggaagaaaaatgcaaaaggaccactcagtacacttacattgatggcagcgtcgcgctcggctgcccctttctcgcaaaggggaacggggacatcgctcgacgttgtcgggccactgatcatcagttggccgacgcggcgctccacaggtgcgctgtccaagcctgtagattgagaccagagtcagataagtcgggaagaacacgcacaaaagggagtcaatttaactaaaaaaggaaaataccccgaggaggggcactggaagggaatgtatcgtgacttcaggccatcccgaagtcggaagccaacacacccggacacctttgtgggttccatccaatgtaactcatagtaaaagcggaagaggtcgagaaacagctctaccccaatgtaggcttcacaaagatgcgaaaagacactcaggaaggcgatggaattggggttcaaatggagcaaggaaagaccatagaaattcaagaccaagaggagaaattcagaaggcggaggaagaaaaccgcagagaataaagtcctcgatcacaaccatgtgacccaggacaggctggggttcagtacctcctacttctctctccgcggtctcgcgaccggggagggcgccttcttcctgcagtttcttcagcgacgcgctggtggaggtagacttgtcgagatccattgccgccggggatcgccgaagaatggaccgagatgagctagctagggtttttgcgggagcgaagaagacgagggacgcttggaagctggagagctttttcaacaggcgggcttcaaattggatccccaaaacccccgtaaatagacgcactcccgatggtgcgaattccaaggaaaggagagagatggccgccggaaatttctgggtccgttacgcgcggcagtttttcggacttcaatttaaattcactcacgaccgttgagcttcactcgacgttgtcgatcactccttgtctctcggccctcacatcgagaacgacgacaacttcgacatcagaagtcgcgatcggtctcacgagttcatttaagcataagtcgggggctactgtcagggttacgggtaaggtataccctctacccttcgatatacgctacatatcgatatggtatgcttgcgcgtatacggacgtttccgacataagttaaggaagtccattatggagtccacagatggaaagagtcctactcggatagaactgggtcgtcattgtatcgtaccgagtccgatgtctccgagtcctacttggagaccagttaacctgcggtataaaaggggcccccccgagagtacctaaggcatcgaatcttaccaccaacacatccaccacagcctacgaagccggagcctccaggagccaagtcgccgggagatctagtcgaatcaactcgactacgatctcatcggtatcgtcaagttccgctattccctttgtaatatgtggtttccatcatataatcccatatcaactggattagggctattacctaccaaggggcctgaaccagtataatctttgtttttctgcctgcttgatgtcgtactacgtagatcctcgtaccagcgtaccccaataccctctatatccggtctacaggtatcgccagtcgacaaaacttacaaaccatatcaacttatctaagtttatattgtctagctatcttacacatcacgtttactttgtgctatcatacttaatacatgtgtacacctaaaaagaatcttactccctccttctcaaattgatcatcatataatggaatttaaaatttctcaaattgatcatcatgtaaccgtatggatacggatttcgtcagaatataattaatgcggtatggtcgaatgtgtgcatgctaaagtgtaattagcatagtcttttaatcgatacatacattgtgagagactgtatacatggcgtgttgattgatgtgatttaaattattcttggccttggtatagaaatatatacgattatcagaatgaggaaataccatttaggacaggttagtaatctctaactgttgacaataaaaacgaatctgagacgtggaaaaaaaatcaataattgacatacagaaaaatatgctagtaaaatagaaaggttcctgtgtccaacattgatcatccgtttatcacgtgaaaaattgattctccctgactacctgcactcctgcagccatttaattatcacatgaaaaattgtactatataggggtatctcttacttccttcgtcctattacatttcaagtactgtacttatgaactttttacgattacttttttatcataaaacgttaatagtactttatatgtgaatttttatttttttcataaatttttcaaataagacgaacggtcaaacattgaacacgaaattgcataactagacataatgggacggaggaagtactgaattctctacactgtagactttagagtagagctcacttcttacgccaatatatataatagattagctataaaattggctataattttcttctactctctctatacatatttaatgtatttgtcttgtaacctgtgataagagcagatacaatgggcctgctcgcctgccaggtacagtagctgcctgcgactagccgctgctttttttttcgcttgcttcactgcaggcttcaacactgctgcagcctttgtagctgaacagacccaataatagactataagacaactacagacttacgtgtaagagatagaacatatagaagagaagcggactacagatttgtaaccagttacagcatagacttcaaaaggttgtgcctgtatgaaaggtgggagcaattattaatgatgtagtatatatatttatagttaaatattatatgaattgactattaattgatttggagctagtaattggctatactatatagagcaaggataataatacagccaattgcttactgtatagatctttatagcatatgtgctcactcatatagtggttaactcttcatgcataagccggctgtaaactaacagcccgcttcacatctctctcctctcctctatcatccacctcagcattcagctttcttatagctctctattatacttgctctaaatcagctcttgcatgagagccaacgcccttgaaagctctcactattatacttgctcttatataaatataaatattgttgttttcaatgtcagcagacttttacgtcttcattatcagtatagaaaaagcgggaatttatgataatcggacaaaccgatgaagtagcttaagtagtcttaaatctaaaatagatcctagtacttgtatgatgactcgttcaccgttcaagatattgcagttttgtactactatcagtgattagccttaacatcgaatataaaattttttgggcatggtaaaattgcacattattttttttgttaatgtgatccatgccactgtaaatttaaatttggctattaaaaaaaataccactattcgctctactgaatttttatgaaattagaaccgtgtaactaccataacgttttccatccatccccaccttttccgtcttcctacttccttctcccatcttctgcggtggagcaagcgtcggcacggcacggcgtgagcatacccgacggcggcgacgaagactcgaagacggcggcgaggtgctcctgctgcttgccgtcgtcctctcagctgcagtcccaggcggtgacagtgcgcgccctgcgcgcccgcatctaccacgccgtcgcgccggcggagctcctcctagcggcgttccgccgcgtgtccgtgctcgccgaggaagctgcggcggcgctcccggcggacccggcggacgccgagtgcgtggcggggttcgtcggccgcgtggaccagctgcgcgacaccatcgaggcggtggtgcggcggcgacgaagactcgaagacagcggcgaggtgctcttgctgcttgccgtcgtcctcccagttctagtcccaggcggtggtgcgcgcgcatcgaccgcgccatcgcgccggcggagctcctcctagcggcgttccgccgcgtgtccgcgctcaccaaggaagccgcggaggcgctcccggcggaccctgcgtacgctgatggcgcggtggggttcgtcggccacgtggaccagctgtgcgacgccatcgaggaggcggtggcgcgtggggacgaggccgtgaggagggtggaggaggtcgtgggtttcctcggccaaaccaaggccatcggccgcagttgcgtgcggcggctgaccgatgcggtggcggcggcgctgcgcgcggtgtatgaggcggaggcggaggagatgcgcttcgagggccctctcgacgaggcgctgctcgacctccaggacctcttcgaggcggcgaggaggcggtcggagaggcccgccacgatggggaagaagagagcagctggtcacactcgacacccagctgcgttgctcgaccacgccctgcaggagaccaacgctagcatccacgctgcgctcgactgcgctcgaggttaccttgccggcaagctccctctccggcttgactccgggaagatgatgggagaaggaaggaagaagacggaaaagatgggggatggatggaaaatgtgacggtatggtatggtgctaatttcgtaaaattcaagtggcatggttattaatagatgaattataatggtatttttttaatagctagatttatagtggcatggatcaaattaaccctatttttgattggagggggtaacagattgataatttttgttgggtgtagttccatcgggttccatcgtgggtggggcacgcaagcattaggaaagttttttcaaaaacactatatcgaatttttggacacgtgcataaagtattaaatatagattaaaaaaattaattacacagttaggggagaaatcacgagacgaatttttgagtctaattagtccatgattaaccataagtgctacaataacctatatatgctaatgacagattaattaggctcaaaagattcgtctcgcggttttcagacgagttataaaattagttttttcattcgtgtaaaaaaaaaacatttccaatatccgataaaacctaaaatattttatttcgcgaactaaacagctccttattttccaagcgccatcattcgtgaggctcatacacccgctcagttcacatgcccctgctgcagctcagaatgatggcgctcggaaaatatctgcatatcgtcaaatttaattttctctggtaacctagctcaactgaacagattttctttaaccaatctacccggattttaattagatttgatccggattttaattagatttgatagggatattcgatgtgacagcttaaaattttttattttgggaactaaaattggccaacatatccctgattcgaaaataccgacgatggctatcacctgctacttctgtccgaaataaatttatttttcactcatctcatgcataacaatataaaataaaataaactaaaatatcatactttattaaatcacaatgcaactatttcttactttatctcactgctacgaaaatcaatttttcatagcatcaacctacttttttcttaagcggctatacacaaccaccgccagtgaaaatgtaacgaggggaagggagttacggtccaaggttaagagagccgccagcaaaaatatctagaatttcacaggcagacaacttaacatatcggccgtgaagattaaatttcacaagcggcaggttaagagcactgtctgcctaaaaaaaatccttaaaataccctcctctccctcccggccacacaccctctccttaattactcgctggcggtcgggttaacctagccgcttctgaaaattgatttgcgcaagtggtgaaggttcgcctgtgaagatgttgattttcactagcctttaatagatggtgaggagctgagccgcatgtgaaaacacgttcggactgcctggaaaaactcatttttctagtagtgtctactcctaatataattattctctatctttataaactctggtgcaataattatattactctaaaaataaacttattttaaataaatgaaaggatcttaaaaaaattattataggacatttttcacttatgtcatacatatcaacacaaaataaaaaaaataacattgccatactttatcaaatcctcatacaattatctctttttacctatttctaatatatttatcttgtgattttataaattttgatacaatgattactaaaaggaaaaagtatataataccctctaaactatcacggtcgaccgaattaccctcctatattgaatacacgaagttattctagaatagagggaggagtaactgttaaggcttgtactagctaagctcagtatcataacaagttgttaacgaccaaattcggtaatcgtcatcggagatggagattagactgaagcggaatctaaaatagagatcgtccaggaaacagagtgggaatcggctaagtccgaattggttgtggctttaattggcagagttcgagtcggacaaggttagccgaatccgacaatgtgacacggcatacgttgttgggttgagttaacgtgcttcatgaggattgccacgcatggattgagtcctgagaaggcaattgtatctattaattaggatatttcatgtaatttccttagagatatgtttggacaaaagtctgccgcaaagacttatggtatcttagagtttgttagagataagagtcgtgtgtgacatggacattttttgtaatatcgggtataaatagaccccgagccccatgtaatcaatctaacacacgctcaatataatctcggcgcatcgccaccctttactttcgttttgtttcgacgagttcttgctttcgggttgagctgcatcggattcgatcttcaactagaggtaaaacttcttatggcggcttgcgttctcgggattagtgcttccatctttatgatactctaatctcatttatgtaattcgtcgagttatcatatatcttatataatctctggcaatatcgctatttaaccttcaatcggctaacgtctgttaccagaagacagccgatcaggttaaataccgacgttgacctagattatataggatatctaccactctatgaaagatccaacggcttgattgtctagatattatccttcttttcatacttatagctgcatcagttgagtttgatcttataagtcgtgattagaatctcgatctctagcctgcttttggttgccgattagaggagcatcggggtttcagccgattttacctgatataactacttttatcttgtatgcttgattgacatgttaaatctaccctttatattaagatcttgttgcatttaagtatattagactttcgtttggtatattctacttgctttggtatcttaatatagagtagtatcggagtattagccgatacacgctagatatatatgatcagctatgttataaacatatgtagtcttgttgttaatacatatttcgatctaagtgatttatactgtctcagtatggcgaccgatctatcccaatcacttgatttaagtatatatcgatataaggattatatattgttaatgtctacagccgatcgagtagatttagtcctttcttacttattcatgactgccgatcgatttacatatgacatcggctcaaagataaatgatacgtcatcggcaactagccgatcggctattgtttatggatttaaccgcggtttctttgtctttatttcttgttgattgcaggatcaaatcaactggcatgctcacaaatctaaagacaagatttttggacctgcactgaagttaagcagatctttcaggcctcgtgtttttacatcaacacaagttgctaggctcggcttaatatagtgcgctaaaagtctaggttggttctggctcgcaagttaactcaagcgggttaataaactcattaagagctttggcttattcatatttcctttacgaattttagtgttctgacatatacatttgccgatttatcatttgctaatcataaacattattccttctatctaaaatataaaaatttaaaaccagattcgtaagtaaaagttatatattttaaaacagatgtagcagtaaatacaaatacaatagcttacaagtatttaaaggacgtagtattagaagcataagcataaataaatatatatattggtcttgcatattaccaagcttaccatgtactagtcctgtctcaaaatattacaagttagaacgggatggaatatattttagtacaacaatttaaacaaacttatccaaatttgttatatgtatctaatccgaacgaagggagtagcttgagctatgctggagtaaaatcccaacacgaaactcacttctttacatttagggtgtgtccatttggattggtttggaaatctctccccttcacacgtaaaacaaaatgacaaaataatacataattaattaagtattaacacaatagtttaaaaattaaattgatatgattttttacagcatctttttctaaagaatttttttaaataaacattatgtttagtagttcaggattcgtgcgtgtgggtaatgagagaattgatgttgggaaccttgagttaagaacacatcctaggacaaataaaatagtgatactattctaaactctcaaggtgacatccactcattgttgtatgtcactcaaatgactatgaaaaatttgaaaaagaaattaataatatagattaatatgtgttagatccctctacagacatgcaagttaaatttctcactttaacacgttgcaaaaaaaaattgactctgaatatacgttaactatctttaatttattttttcttattgcaacttataaaagtagaattttaccttacatgtttctaaagcgatatatctcatgttaatacatcttctcaatttttataataattttataactattctaagtgtcatgcaaacaatgaaaagacatccccttgagagtttaaaatccactttcaaatgaaatgccattcaaaattgtctgatcggttgagcaacaaaataagctataaaaaaattaacaaggcagcaaaaataatttttatgtaaataattattaccagcagtttaaaagtactccagaagggatgaaaatacaatcactaaaattaaattaaaaagttttaaattttatttcgacttactccttccgtccttaaaaaagaattgatcgaatgaatctaagtacatgtgccgatccatccctagggtttattattattattttttagagagagagagtataagccagcaaacagacatgaaaaccgaatctctgatgaaatctactccacgtactgcagttttcccacgatagttgcattgggaagacgaggaaagccaagcaatggcgtcggcgaggcatctccggaacctgtccatgcgctccggcggcagagctatgccaacctcgatgccgccggcgccggaacgatcctccgccaccgacaccgcgccggtcttcgccacggacacgatctccaccttcgccggcctcccgaacccgaagtcgacgtcgtacacgcggaacctcgtcgacccggccacagagaacggcgcgtcgtccctgcacgcctccacgacgcgctccgtccacccctcccagtacgcgagctcgccgcgcaccgcctcgtcgatggcggcggcgaccgtggcgcaggccgtgaagacgccgcccgcggcgtcggcgacggcgagctcctcctcgggcgccgaggcgaagcccgggccgacgcagttgccgaggtagttgtcggggacgcggggcaccagccgcgaccggtggtcgacggcgaagatgaaatgggcggcggcggcggcacggccgccgtcgtcccgtctggcccggcggtagcagtgccacatgaggccgtacatggccacgtgggacgtgcaccgaggcggcggcacgccgcgacgtgcggcctcgctggcgacggcgtccttgacgccctgcaggagctctttggacagggtgaaagtggcgaggacgtcgaggagcttgccggcgtcgggcgctttgaacagatctttggcttcgttcgtggatgaggtgatctcgtcgtgcatgttcggtaggtcacggatgagcgtgcggtcgatcacaggcggctctgggagcatccggtcgccggcgcaggcagcggcccaggtgtggaggaagtgcgtcgagcccaccccgtcgcaggcggagtggtggacgatgatgccgacagcgagaccacggcggttgggcggcagcacggtcacctgcagcgcgagcaccgcgccgccctcgggaagctccgggacgaacgacgcgatcttggcgagctccctcggctcgtccgtggcgagctcgtcgacgccgactccgacgccgtcgtgctcggcgacagtgaacgccacgccgtcgccgggctggtagaggagctcgtaccggttggtctcgccgggcgttgggcggacgcggccggcgagcgggtagaaggcgtggatcgcccggggtagcgactcctccatccgggacagcacagcgtcgacatcgtcgtcgtcgcaggggccgaggcggtagaagaagacgcgctcgacgggctgggcgtggagccaccccgcgtccatgaagatgagaggcagggctcgctcgggcagcgagggctcgccggcgggcggcgctggcgcgacgcgcgttgtgcggaggacgcggaggccagcggcgtgagcggccggttgcgacgccatggtctcgccgcagaacaggtcagggttgtgtgctcgtggctagctgcagagcgatcgagctttgcttctactcctataatacttgcatctccgcgagtgacttcacttcactggtccatactcgaattatgcccctaagttattaggtgagtacgaattaccccttaaactcaaaaataagataactttcaccctcaactattaatattggatgaaaacccccctcaaatagctttgagagcggttttggtcctacgtggtagttcagtcaacaattcttttatcaaataatcgatggggcccacccgtcagatctctcacctctctctctttcccctctcacacctctctctcgcgcgcacggatgccaacgacgaggatgaggcacgtgccggcagcactgcaccatcctgacggcgctcacttgccgccccaagttgccttagccacgccgccaccgcgccgccatccgccctccccgagtagccttcgctacctcccgccaccatcctgcccaccccgagctgcctccatacccccctccccgccgtacccccgccctcgcttgccgccatttgctgctgccctcagcgcccaagcggccttcgctaccgcccgccaccccgagctgcctctgccccctctgtcgtcccgctgccctcgcccaacaccatccaccgctatcctcgatgccctaagcggcctccgccatcgccatcgcgccgccccgaactgcgtccacccccgccgctgtcccactgtcctcgccagttgccgtcctgccgtccaccctcgttgttgtcacatcgctccgcccctaactcgccgccgtccggcactccccatttagtgatagagagagatggaggtgaggggagggagaagagagatgatttgggaaagagagatatagagaggagggggaaaagatagagggtgagagctgacaggtgggctcgttgataaaaaaactgatgactggactgccttgtagaaccaaaaccactctggtttgtcttagggaggtaattcgtctagtattaatagctcagggtgaaatatttctggttttcggtatatggagataatttatactcactcaatagttcaacggtataatccgtcccaaaaaacgaatctagaacgaaatgacgaatctagaacgaaatgtggcacattatagtataataaaactagacaaatgtatattcagattcgtagtactaggatgtgtcacatccagtactaagttggttttttataggacggagggagtagatatctagaaaaatcactaactgttcaacttaaattgataaagatattacaaggggcagaaaattataaaataaagcatactccccttgtatattgattcgccctagctacttgcagccacttaactatcacgtcgaaaaatatatctcttatcatgtatataaataatttttttcattgtggctataattgtttgtaataatagattgttgtagattagtacttatctatatctctctgagatatatagtttgaatccactgtcacttaaaactcaaaatacaaaaattggtcacatctctcacactagtcccaagtcccaactacctcttgtctttcccaagtcccaactacctcttgtctttatgatggctccaagcagtcaatgcctacatctcacacactactataaaaaaatacatttttcatgacactccattttattctcaacgatggacttaacaaaggccgtgtttagttcacccccaatttctaactttccatcacatcacatcacatctaaaattttcctacacatataaactctcaactttttttccaaactaccaactttccccaaactttcaacttttttcaagaactaaacacagacaaaagcatactgggagtatgtggtcacaactgtatgagaattaatttttacagattgtcggtttaggaggccacagccagaaaaataattctattttacgagtggacctcctaagggcaagttttatagtagaggtgaccatcacatccaattttatacatgatatacataattaaattaagaggtgacatgtataataggttgcctctaccacacaatccccaatatctctaacactctcacatgtttattaaagtttgtgtaggggttgccccttgcatgagatgtgactatttctctctcatctttcttctctcctccacctcactatatagtcctatgtggcatcttgaggtttgtgcttggatgcccatagtacttgccctaacctaaccaaccacctggaaaagaggaggccactttgaaaaaaaaattaatgaacctatctcctagttaccactcaccagcccccacttctcgatgtgtcctcccacaccggggacgtggtggatccggcattccggctccagctcaacatcgacatgagggcagcgatgacagtgaaacagagaaggtggagcacgtggaaaatatagtcatattttaatcctaaaaattaagacaataaacatgacatgtgtagcaggaattgatctagaaaaagtgctaaacatgaacatgctaatgactagaaaagcatcatagagaaacacatgtttaacacacaatagttaaaaatgtaacatacccggataacgcttcggtactggataatgcattgatggtgttgttgcctccgttgatgttgacgttctcgccttctccagtgacgttgcctccaggagcgccattgccgccacctctaggagcgtcgttactaccaatgcctctaccattacctcctccagtagacatagcgatgtagaggaagtagacgaagaagacgacgccgtgcagaaccgatgcagcagagcagttgcgctaggaagcgctccccaaaaacttaaacgcccgcatacccatgtaggtactcaagcgagctgagttcgggagacctgtttatcctaaacacttgttcatgcaagtgctttgaaccggggaagcagaggtgcagcgcaggaacagaagaagaaaagatgtagacaccgaggaggagccggtgcgcgaagagaggtggaatcaatccgggattgattcgttcatccggtgatgggtttgcatagtgtgtctctgttattggagtaataacggaatcaatcaatccgggaatgatttgattccccagccggctcggtgcgcatgtggtagtcccactaccacctctaccggttaacaagtgctctccaatagcaacctagttaagttgaaaccttccacataaatttttaaggtgacattaatctcttaacattaattgtgggcctataaaattcattaggaataaattaggcctaatccattttctctaacataggatacagcagtgacggggccggtgagcgttggatctggtggaggcaagcgttgagggtgccggatccaacagctgtagggttactgctcggcaaggtcgaccttgagtccatgatgacaccatcgggtggatacaggccgttgtgcctggtcgtctcctgcgcttgggcgatggtagctcgggagagctgtggcggctgtgctcgggggagtgacggaggcagttgcaatgagggagatgatgaccacgacgatcacgatctggatgctgtcggaggccgccgtgttttgatggttctcatgagctgttgtcccatctgcatgaatttatattttgatttggatgatattgagcttgtgtttagaggtgttaaagaggaaatacttacaagaaggaggtgtgttccaggtgaaaaatggtgttggctcccaattttggagaggtttgcttaatattagaaaatgggtgattttgggtgctgaatggaaagttggtgagggctcacatatctatttttggaaagatacttgggtggacaattgctctctaaaaattagatttccatccttatttgctatctgtaaccaacaagaggtggctgtctaatagattgctagtgagggcactgattgtctctctttcagaagatcttttggtccagctgaaataactgaatgggaggaactcaagaaagtaattgataatctggagacttcccctgttcctgacactttactttggggcctagctactaacaagaaatataccaccaaatctatgtacaggaccctgacctttaggggtataagagaggtgaatactgagatgtggaaaagcccctttcccatgaagattaaacactttctctggctagccattagagatagaattcagtctgcggaacaacttaaaaaaaaaagaggctggaatgattcagagttctgtcagctttgtggacatttggaaactaccaatcacatcttgtttaattgcgttatggctagacttatctggtgtatttgcagagatggcttaggctggaacgttattcctaggagtttggacgagttctttttgctttgtgacagtgataattcccctacttcgattagattgcatcttagcctacttgctgctgtgtgctggaatttgtggctaaccaaaaataatatggtgtttagagataaattgttgtatttccccctgtctctaacttttcaaattgttgcaaatttgctgcagtggaagaagctctttcgtcctgaaggctggagtacaggatcaagatggtgtcgactagtctaagatctccaagaatgggtgtgggttaaaattctatcgttctgttgcttagtcgttagagtttttgtttcccaggtagatgtttccctggctcatgtcgttgtcagcttagagtttcggctggaatctagatcgttcgctacttgttcgccagtctggttgctgttcctggtctgtattttcttgaactcctctttgtcgctggcaaccccagctgaacacttcgatgtggctttcagtaaaaagccgagtctctgaccttttctctaaaaaaaatttggatgatattgatgccgatctagaacgtttcttgcacgaacgattcaagaatttgaatattgttttgtttttctccggaaatcctccgtacaggtggttaaggttttcatctattacaatcgattttcccaagcggaccatattcgcttacaaatcatggactgtcataggcgttcagtcgcaggcggtcatcatgattgccagcaaaaattgattttggttacctctaaagtcaaattttttagcagtgccatacaccctgagaagagaacacgtctttttaccctggacaatactctcttaggacggagggagtattattccactgcatattaaagcttatgcaagaataacatatcattcataatcccttctttctatcaatctaatatcaactaaacatctaaaattcaacatacaagcatagtatttattagcactcctaaaacttacatgcaagcatgacacatcaacccattagacacacgaagctcaatatgtaaggatatagtaattatatctaaaatttatttcattctaaatctagcatacatatgctacatcatcgttctcaaatcattttcataatgtttcaatccaaatcattttattatttctccaatatataacatatatcctgcaacaaaacacgggagatcatctacgttattataatctagagtttagcatgcatacgagcatttttaatcatcctccacacgttattttcttaatatttcaacatatatcttcccatcatttttactagtataatatgcaacatatattttccattcattccgaagcaacgtctaggacatcaattagttatgtaattaatggttcgttcactgttgatatattgcagttttatacggtcaataattagcatttttccctaagtactgttttaacgtcacatataagcatttctccgcacattggtaaaatcgcacattattgtttcagtctagatgaacaccataccaaaacatgtgctgtatatagtgtatacgtagcaggctgataatttttgcgatctcgttctttcccaaggaccttcaaaacatgggttaatttgattcataccataataaatgggttaatttgattcataccataataaatgtgtttatacagataaatgtcattacaatttgctatatgtagccgtgccacttaaattttataaaattgaaaccatactatcgctgtcacgtcacgtttttcatcttctttcccatttgcacgtgaggtccagccatcaaattcatcatcttctttcatcctcccctcttctctttttgcccatctctgagagccttggcgcgacaccatgctcgtgggcaacctggagtccagcctctcgagatggcttgtcgaggagccctctgctcccacgcgtgagcacggttgggcggtggctgccattagctgcgcactccggcacggggagagatggattggtggagagaaggttgagaagtggtggacagataggaagagaagaggggaggacggaggaagaatataaaactgatgagtgaacccaatgcttagatggaggagaagatagaaaacgtgacggcaatggtatgattttaattttgtaaaatttgagtggcacggctataaatagataaattgtagtgatatttatctgagtagacaaatttgcaatggcacggagcaaattaacccttaaaacataggattgtcatttgtcaaaacgtaagactagaaaaacataagaatataatatcatgttcattgaattcctcaatttgaaaacatagaaaaactgtcgtttgatagtcacacataaaaacgtaggaattcaacatacgggaaaaataaaacattaggtaaaacctcatgcttattttcctttaaaattcgtctacaataatctattccatatgaatttaaaaggaattgatatgaatcaatccattgaaaccccttcaaggggtttcgtaggattatttcctgtagggtattaatcctttgaaatttctatgtttttcctttgtttcaaggcaaaatttgctacagtacaatcaaagaatgtgtaattggctaggagacacagcaaaaatgtgacacgactgatggacactccaaaaattatgtaattggctataagacacagaagacaatattttataattacgggccaaaagaggtgatatttttttcaaatggcgagattgcccctggtgccatcttcccctacccgagaactgcaatgccgtgaggatgagcttggccttggcggcggggcctgatctgttctcctccgcctggatcacgtagttgtggaagttgttacccagcacgcaaacatggcggagcagcaagggtggctcccagttgacggcaaagaaggcatcgtagagcgacgcctcgtagtgtggcatgtagaagagggtgggctcgtcggcgcggtggcagcaaccgtcattgacacctggcacggcacagagaagcccagcgctgccgcagaggcgcactcgaccgcagagaggatggggtcgaagaggtcggtgtgggcggatgattccggcaggaggaggaggagattgcagtggaggagcgcaagctggaggcggcatgagggagagttctcgaagctgccgacgccaagaagtgatagcctccgtcttcacccaccatgatggatcgatgcgtcgcccatcaagcaggaggcggccacatgcagggccagcggtggccacggcgacaacgtggagcacgagcaggaagcagccgcgtgcagaccggtggaggccacggcggtggcttggagcgcgagcaggaggtggccttgtgtgaggcggcggcagcgttccatggcaggggcaatctcaccatttgcaaaaaattatcacctcttttgacccggaaattataaaatattgtctccggtgtcttttttggagtgtccatcagccgtgtaacgtttttacggtgtctcctagccaattacatattttttcagtatcctgtagcaagttttgcctaggtttaatccggatacctcagatgcatgacctcataccgtaaatgtttgccttttctgcagcttcacaatcgtatcagataaaccatttgtccaaaaataacggaaacttcagttaaccaaaggaatctttacacaaaatgttcaaggatttgtactcaatcaaccctaattatattgtctctgactctaaatatgttgtctctgccaaatagtcaaattcaccatatcactatcttgtttcttgtgattgattctttatcctcaccagtggcaatgcaagggcattttgctagtaaaataaaaatcaaggaaaaaataccgaacaaaatctgttcggtttattcagaatacgtttttactgaagaaactaatgctctcgatctcccgttctctcagtgcccatcatgtgaagcgaggcatgggcccatgccatgcatacatgactacagcccaggaatgctgtgggcttcacagcccatgtgttaaaagaacaaagcacgacggccacaaaaaatcatagtaggaaatgtccaattaggtcataggttttatattttgtgacggaggagtagttgattgcatgatctgggggtgatttgatcagtttgttacatgctgaatttttttcattatattttttaaaacaattaatcattcaccaacctgtatataaaaaaggccataagctgatacgcaggatttaagtagtgaacacgttagaggcgcgctaattttttagttgtgttgcttgatgtgttgtctctagtctggttggctctcctgaatatattactttcaaccatctaacacaagacaagtttcgtctgcgcaagcatatatgagccctggaggataataagaaaaagcggaggtcctgtcacaattgaactaaagctccttagtataaattatgggaaataatagaaatcattctaaaaatcacttgagtttgatattcgatttcataagttattttactgtaaatatttaacacccagcgtaaatgcttaaccgaatcaccccgttatcgctgatatagagccaccgtaggttaagctagccgcttcaaaaaaaatttctgatgtttgcattagatttattttttatgtgtcactgaaatctttttctgcatatagagaaacaacgtttaaactctcatcaataattctatttatcaaatctcacaaaaagtgttaaagtctatactcctaaaggtaaattttgataagaaccatattgatggcttgcaatttataaagacatattgatttggataaacacatgtgcactggggtggtttttcaaaacaaaaccgagtagagatgatgatttgcaacaaaataatttgtggggtgaaatgtcaaatttgaagtgacttttatgatagtttttgttatcgcccacgcgcgcacatgacgtcgctagccatccagaatccagagacctcgatcagccgacacgcgcgccgcgcccgacgtactgcaatggcgtcgccaccagctcacggcggcagcttccgcgtcgtgcgcaccgctcgcgtcgcgccgtcgtcgcctgcggccggtgccggctgcaacccgcagccggaggccactctgccgctcacactagtacagatccttccatctgtaacggcccataacaagaatggaatttgcgggccgtcacaaggaagtaatctcaatcaggccgaagtttcgcctgattgagatatggtcgcacagctatggtatatcggcataaaactaaagcccgtcacggatgacacttatctgtgacgggctatagttgaggcccgattgagatgagggttccatatcttaatcgggccctaaaagaagcccgtcacagatgacccgatgacactcttttttgacggccttttattaaggcccgatagagagtacttgtatgcccgtcacggttgattgttttagagccgttacagatatttgttgcatagtataaatacccccaaccacctagtgtaactgtatcccactgttcactattttggtgggaggctatagggggcgattttttgtcctttttccaaggaaaacagaaattaaattcccaaaagtgatcaaaatggatcaatcaagtgagtaatataaatcattaattgagcaatttcatcacgtcttacttttacttttgcaatactgatcttataatatgtgtctctaatttgtttttttttagcaatcgatcgaagttggatgtatgccaaaaatttgaaacgtcattctacatagtaccgaaagggcgtaataaattttatgaacgccgcggaggagaatcggataagaagaaacagtgattacatgtgttgtccatgtgcagattgcaagaacgagaatatgtttgatagcggagaggacatacacggtcatctgatacaacgaggattcatggagggctatacatgttgggtgaagcatggagagcaataatcaggaagtggagcagcagcagacagaagtggtgtgcataatcaggaagatgaaaatgagcatgacatgtttataccttctccattgggcggtgaaatggttgatgtggatcacgatctgctgcaagacatgttacatgacgttgaggacctagcctagaatgagagagatggaatgaaattcagcaggttggtaagtgattccgagacgcctttgtacgctggatgcaaagcaaaacacactaagttgtcaattaccttggacctaatgaagctgaaggcaagtagtggatggacagacaagagtttcacagatcttttaggaattttgaaggctatgcttcctgttgagaatacattgcccgagacgacatacgaagcaaagcaggttctgtgtccactggggttagaggtccgtagaattcacgcttgtcccaacgactgcatattgtaccacaagcaatatgcggacttggatgctttcctgtctgcaaggcttctcgatacaagcgaaagaaaagtgctgacgaaggaaataagtcaaagaggggtggtccggcaaaggttgtgtggtatctacctatcattgatcgtttcaagagaatctttgccaacccgaacgaagcgaagttagtacgttggcacgccacggaaagaaggaatgatggtatgcttagacacccagcggattcgattgaatgaaggaatatagatcgaaaacacaaagactttgctgccgaccctagaaacatgaggatatgtctttgtacggatggcatgaatcctttcggtgacatgagtagtactcacagcacttggctagttcttattgcgaactataacctcccgccatggttatgctttaaacggaaatatattatgttatgcttgttaatccaaggtccaaggcaacccggcaatgatatcgatgtattcctggagcctattatcgacgatctggagattctttggaaagaaggtgtggaaacttgggatacatatggtcaggagaacttcaagctaagagttctattgttctgcaccattaatgactacctaccattcggtaatatttccggacaaactataaaaggaaagaaggcatgctccgattgcaaggaacatacacaaagccggtggctgaagaaatcacgaaagatggtatacatgggtcaccggaggtggctcccgctacgtcacacatttagaagaaagaagaaaatttttaatggtaagagagaacttcagcctgctcccaaagatttgtccggagatgaggtccacaatatggtcaaggacataagcaatgagtttgggaagaaaagtaaacgtaacaagacaaaggagaagggtatgtggaagaaaaaatccatattttggcggctaccttactggaaagatcttgatgtccatcattgcattgatctcatgcatgtagaaaagaatgtgtgtgagagtttggttggcctgatgttgaatattctcgggaagacaaaggacgggttgaacgcgcgccttgatctacagtcatgtaatatttacaaatgctgtttacatttgtcatattgtcaaaatcaatttcaagctgttggaaacaaagttatatagacaaatgaccaaaataaaagttgtagatcttgatgagaggatcaattttgttgttgaccatatttcgatttgaaatcatttactatccaaaaatgtgttatgactaataaaataaattattatacagcagctatatattttgtactcacaaatataaagacttatctgggaaatggaaaaatagtcatcggtgacgggccttagttcaagcccgatagagattaatcgatctctatcgggcattatcttagggcccgtcaccgatgactcatccgtgattggcctgaatggtatctcaatcgggcattagtatggagcccgtcaccgatgagtcatctctgacgggctctacggcaaagcccgattgagatgactcatcactctaatataactagggtttctcagatcggatcgaaaatttttctaagtcccgctacagtttcccacctccttagaaccctagcgttgctgtcatcctccctcaccaagcccgccgccgtcgccaccgagcccgccgccgccgcaatcgtcctccctcgccaagcctgccgccgtcaccactgagcctcctcggccctccattcggacctccgccaccgagcctcctcaccgacgacccccccccccccccgagcccgccgccgccgccaccgagcctttacaccgaccggaccggtgttggccttcctcgtcgtcgccgcccgcgtcctcaccgacccacgtcgccgaccctcaccgagcacgacgccgcctgcctggtgccgacctacccgatcggcgtctccaccgaccagcgccgccctccaccgagcccgggcgccgccgccaccgagccccatcggccatcctcaggtgagtcctccatcgcgccgccctctgctaactgtgaatgacatgtcattgaaatgtggatgtggatcatatgtgattgaactgtgagtgagacatgtcgatgttgggatgaaatgtggtgcatttattcatgttgtgatagatgattgtagtgattgatgaaatgtggttcatttaactttatttatatgcaatatggttcatgttgggatgaaatgtggtttatttatgttgggatgaaatgtggtttattcatgttgggatgaaatgtggtttattcatgttgggatgaaatgtggtttatttatgttgggatgaaatgtggtgcattaatgaaattattgtgaaatgtggtaaatagattgtaatagattgtagcactcaattgtgtttttttggaaaaaaagtagacaatgtctcagcaaggcgaaccaatgtcgacaacaactagtgggtcctcaagggcacgtactcctaggacagggaataaaattcctaaggaacggttccgcataacagtggtggacgccgtagggttgccgacatctccaaggaaaatattgagccgatttaggtctatctgcgaggtcatagggaggcagaaattcagtattctgcaagacgacttcaagctcgtgtcggccgcagagaaggacattgcttggctaacgttcaaggagagctttgattatcctgcggagcatgaggaccgtatcaggcgggctgctttcaaggttatgggcactgctcggaagaacttcaagactaagctagtcggcgagttcgtttacaacccggcaaatccagatccaagagagaaatttccttggatcacggaacaggtatgggaggaattctatgcgaagaagtcgacccccgagtccagagctagaagcgaggcatatcgcttgctccagaccaggaaccagcatccgcaccggcttagtaccgtcggatatgccggtaaggaagaggaatggcagcgtgaggatgaagaagcggaggaatcgtgcacaccgctcgtgtttggcgatatcccacaccctcgggctaggaactgggccaaggctaggtaccagaaacatgatgatggcacaatcttcatgcaaaatgcagaagatcaacgagtatatgaagctatagtaagtgtctaatcaaactagatgttcacattgtttcccatcatgcagtttatttgaccccactaagttgtaatgcagaaggagttggttgccgagcaacaagcctcgcaagaggcctgctctcaaagacgcgaggacgacctcctcacgaaagcgttgggcaacaaggaacaccgtggacggacacggggcgttgggtcttctgttccctggaagtatggatttccagactacgcgtggcagtacaagaagcggacttccaacaaggcggagaaagatgcacgccttgaagccaagatccgggagtcgatacgagctgagctgacatctgaattcgacgaaaagctcgagtcgatgagggccaagattaggcaagagatccgagaagagcaacagatcccccaggccgccgctgctgctgcgcacaaagagttaggaagtcccaccgaaaaatgcagcagttgcgcatcaactgagttggcggaaaatccaacatcgatcgacagcgccgtcgaccacataacggtaaccgtgaacttactcaatacatgaaagacgtaacgaatccatatgatatatagtattctaaaaaaattgattaatctatcgcaggaaccaacgagctgcaccctcacagttagggtgatgccgaccttcactgttctagcagccgagggacttgcgtacaagccgaccccagagacaacagtgcatggagcgcaactcagggccgactgtgcaaaagttcaagttgactcggtgaagcccgaatacgagctgttccctctgaagtatccaccgaacgacgaggtcctctcactaggaaatgctcgtggtaccttcatccaatggcccaaggacctcattgagatcagggttacagcgaggccaaccactgcaccaggcggtcgtccaccaaagagacccgcctctgctccttcagcccctcctgctcaagatcgtcatgcacaatcttacgatgtgcagttgcagtacgacgcggattttggggaggaccgaatggaggccgacagcaaggcgattcataaacccccaccgatgaagaagagcaggaaggcacactcttcccctcagagaattactctcgataaacccgaagcaaaggggagaggaaggggaggaaaggtgcaggcctcgcttctagctccaagaaagctagatctgggcaagggccaggaagagactaagggcaaagaggtcaagaagaaatacgtcgctccacaggagttccaactaggcatgccattggttggagatgacgtgcttgctgcaatgggcaccacttgtaaggaccttcacttatactacatggagaaatctaacgccaggaagccaagtaaagctaccgatattcttggacagcacgatggaaagtcattccttggtccaacaaattatatcgtggtcgacttcaaggatcttttcgacctctacaggctccgagcggtggacacaagcctccttaagtgttactccttgtaagtattgtcgcccaactcattctggtaataacaatcgatttaacttgcttacaagatcattgatcctgtgtgtaggttaagttggcaatggtgtcagaagcatgcaccggaagttgccttccttgatccacaagtggtcactgtcacaaatctccagaatgaccgtcaaggaatggtcaactacatctacgacacattgtggtcccgccgagacaagaagtacattatgtgtgcctataatcaatagtaagtgtgttaactaaatatacacaacagcatgacacattccttgagtacttaattaactttcactatattaatgccgcagtgcctattggatccttctggtcataacacataaatggagtacatgtcattacctgaactctagaattgataagaacgcatatgattggaccccaattcaactagcgatagatgaagcgtgggcccaatacgtgcaaagaggaggcctcaggaagacaggacatgacaccctcatccacaaaaaagacttcccggtgaagcaacaaataggtgaccagtgcggattccatgtgtgccacaacatgtgacttctgtatagagaaaaggtgaagactttggctgagtttgaggtcggtggtctcaattgtgatagactaactacattttagtacttatatatgatcgatggcataatctggaattatgacaatgtagggcacaataaccaagtctctgactaccagctttgaggaggttcgcgaggagatagccagcttcatcctccacgaaataattaaccccaaaggaatgtttaggcttaaactaaaatgatgaacaatgttgaacttctatgtttaggcaatgatgaacacttattatgcaactgtggtgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgatatggctgtgaatgtgtggttgtgtgaaatatattgatgtctgtgtatgttaatgcatatgtatgaatgggtgatgctggggagctggggatattggatatctgtgtttgtttctgtcatttttgcagcgggcatggctagcaaaggcctgaggctagccaaaaaacaaaatttttttttgtggattataatcatctgtgacgggccataactaaatgcccgactgagatgaggtcatctgtgacgggctctagcttaggcccgattgaggtcactagtcatctgtgacgggctctagtttaggcccgattgaggtcagcagtcatctgtgacgggctctagtttaggcccgattgaggtcatcagtcatctatgacgggctatagtttaggcccgattgagatgagtatcatctgtgacaggctctagtttaggcccgataaaggttagtagtcatctgtgacgggcgctagttgtgacccgatagagataggtcatctgtgacaggctatagtttgactggttgtctgggtcaaagctatcggtgacgggctttacttagggcccaattgagatatattcattcgtgacggccgtttgcccgattgagataactcttcacatcagtgacttctagcctgtgacggacgctgtgcccgattgagatggggcttaccgcccgattgagatgagggtatccgttctagtgtcaccttcctcgacgcgatgtggctcatcgccccacccgtcgagcgggtcttcttctaccgcctcggcgacggcggaggcggtgccacatgtgacgtcgacgttgcgctgtccaggttggtcgactccctagcccgcgcgctccacgtcttctacccgctcaccgtccgcctccgccgcacgcccggcaaggccaaccggtacgagctcttctaccagccaggcgacgccatcgccttcaccgtcgccgagcacacggcgtcggtgtcgatgagctggccacggatgacccgagggaggttgccaggattgagccgctcgtgccggagctcccggatggcggcgcggtgctggccgtgcaggccaccgtgctgttgcggccggcggcgccgcgcggcctcgccctcggcgtcaccgtgcaccacgccgcctgcgacggctcgagctccacgaacttcctccacacctgggccgccatctgctcaggcgccgccgccgcccgtcatcgaccgcacgtccatccctgaacgtgaagatatccaccatgtaaagacgaggacgaccaactcgcccgaccccgacgtcgtcgacagcaagctcctcaccacattcacgctgtcaagggaaaacctgcagagcatcagggacagggtcagcgccgcggcgtgctgcctccgcggtgcacgtccatcgtcgcgacgttcgccgtcatatggcggtgccatgtccgggccgcactaggcgcgggcggcgacgtcgaagcagagcctcggaaccatggccgccgtgcccacctcgtcttcgccaccgatctccggtcacggatggaaccccacatcccggacaagtacctcgggaactgcatcggcacgtgcttcgcgtcggcgcccagaatggacatcgccgcaaccggcgcggatggcctattcgcggcctgcgctgcgatcgccgccgccgtcgacgaaggaatgcgatatgatcaaggctactgggacaggtgcagggagcacagggcagaggtgacgacctggccgttgtcggtggccgggtcaccgaggttccgcgtgtacgacgtcgactttgggttcgggagtccggcgaaggtggagatcgtgtccgtggcgaagaccggcgcgatgtcggtggcggagggccgtggcggctgctccggcggcattgagattgaggtaggcatcgctttgtcgccggagcggatggagaggttccggaggtgcttccgcgatgaagtcgcgtggctgtcgtcgtgatccagtcatagctaggtggctgtcaatagctggtcagcgctataccagttatatactacttcgtactagtgtaatttaaatttgaatctgtaagactgtaaaattcagttttcaattgtatcaacttcattgtttgtggtggatatatttgacatggattagtatcctattgtgaccatttatgaagtgtttgttaaatactccctccgtccctaaatatgaaacgccgttgactttttaaacatgtttgaccgttcgtcttatttaaaaaatttatgtaattattaatttttttcctatcatttgattcattgttaaatacataaaagtatacatatagttttttaataagacgaacggtcaaacatgttttaaaaagtcaatggcgttaaatatttaggggcggagggagtatatgggactatttatttgacatttgatagaaaacactctcctaaatatggcaaattctagactgttgggttagcattacttccaaccctaacaccttactcttctcctccctccccgccatcatcgcacagcacacgagagggcaagagtcaggtgatcagaaatctgccccaccttcttcaccaccgctcggtctcaccagttggccgggcggcattaacgacgccgacgaggccccttggctggcctcctccatcacctcccccttccccaagctgacggtggcgaggtcctcccaccccgcctgcttccctgtcttcggtgcctccctaccgtcggatccgccaccgctagcccctgtcttctaaccagaaccttcgctttgcccttaccggcccaccactctcctccatccccgtggcttccatgccaccgctgacacctcgttgctcacctgtgtccaccacataccaccgggccgccatttcccacagtcctctgtcaatgcatcacgatttatgcacctaatgtggaaaagcaataatttctctcatacggtgggttccattgtatgaatacgatttaactttacataaatagagcccactctctctcttatccctccttcccggatccctatcacctcactctctctttctctccttccgtctttccccaaatcatatcccgcggacctcactcttgcagggggcgaggcatggtggccggaatttaggtggagctcggcgtgccttactacggcggtggcgaggtgtcacggtgcggatctgaagccagtgatacaaatccaatgccggcagtcgtgcggtcggtgcggagcttgccttgtgttgttatgtttttattggaaatattgttattttttgtgcacaaaagcacaaataaataaatttagaaatgttatgacatgtgtttttttatgaaaagtactttttttctcaaaaccgaacattatgtttataattgtgtaaaatataatgtttatgcaattgtgcaatatcatttttctcggaaattttgtagatataaatttctgtagaaactataaaatattaaatgtacaaatggaatattgtgtacggtgcatgtgtgtaaagagcggttaactcatcaaattttgaattggaactttgatggggaatgtgcaatgtctgaggtctagatgtctggtaatatggggtgtttgaccacactttaccacgccacaatcttaggtgccataatttattaggtatttcctccgtggtataatgtaagactttctagcattgtctacttttgtatagatgttaatgaaattagatatacatatgcctagattcattaacatctataatgttagaaagtcttacattataaaacgtatgtgtttagttcactacactttttttaatagcatatgccccgcatgtcgtacacttttttattttttttataactatttagatgacatgcaaataaccagagaatcttcactcgactactcgagagagtttagaatctacacccttattttctctcacctttgtttttattctttttctacactcatgcagttcacattgttttttccatcgctcgttttgtggctttaattagcacacaagtccaaagctacccataactatagatggccaagtgggccgctcggccaggcacgacccggcacggcccgccaaacggccatgcccgcccacggcctccacctatggcccaagcacagcctagttagagtctgaccgtgctgggccggcccgaaggcacatctatcgtgcttatctttgaaataagtctattttgtatctctcctttttgggtcctgtcttacctatggctggaataagtctattagcctccctgccctttgggttgtgtcttatactccccccgtttcaaaatgtttgacaccgttgactttttagtacgtgtttgaccattcgtcttattcaaaaaatttaagtaattatttatttttttcatatcatttgattcattattaaatatactttcatgtacatatatagttttacatatttcacaatttttttttgaataagatgaacggtccaacatatgctaaaaagtcaacggtgtcaaacattttgaaacagagggagtatatgcctagaataagtctatcatgcctccatcctctttgggtcgtgtcatatatatatatatatatatggtgaataagtctataacatctctggtgtttcgtgccgtaacgggccagcccaccgtccccaggcacaactatcgggccaggccggcatagaccattcagcactctagccgtgccatgcctgggccgggccaaaaggtcatgccgtgggctgggccatcgatcggcccccgaaccttttggcccatctatacccgtgactgtttggccgtcgggccctgcctaattccgaattcttaatcctaatctcagcttccggcttcgcaggcgagggcgagttgatcgacgagctccgtcggctatgcatgttaggcggcgagggagttgggctagacgaaaacatcatcaggaggagaagacggaggaggctgctggggtcgagcaccgctgactgacactgctataaggtggagattttcatctgcaccgccgcgatggaggacatatagcagcgatgttagcgccgatggtcgcgaggtcgtcgacaagctagctagtggtgtcagtggtcgccgtcgccggaggcggctgtcggcgacgtgtcccaccgtcaccacggagttgtccacttcaacgacaacgacgcacgccgagaatgccgcggcgaagtctccgtgatcgggacaggatcggccactcgggactcgggagtcgatcgggagccatcagcgagaggagcaagctggtcgacgtgcggccagtgctgccgcggcttctccggtgccggcctcttcccctggtcgacgccgagctttccttggtgctgctgcaaatcgatcgcgcgcaggaccgcaggttatgaacctgctgttctttttcttcttgttcttgccatagccgctaatcttaccttccgctcctactgcagctgcagccactggttgacttccgatcttgcagaagggggaataagctagacgagaattatttcatgattgcttaaaaatagcttcttgattttcattttattttatagctgaagaaatcttcatatcccacacgggcagggcatgcatgcatgtggtcatgcgggtccagcgtgcaagctgccagccaaccaatcagcgagcatgcatgcgagtaccaagtgcggccggccactttatccaggcggagtggatgacgcaactctgccctctgtcctctgttcggtgttcgctgactccgatcctctctctcgctctttgcttgtcggctttatgtaccctcactactgtgtatccatttctatagttcgtgcctgctctttgatactgcgaatgtgaaagattaaactagctgtagtttaatttgtttttttcattacaaatttatctgcgacgatgagaaaaatccatatatgttttaaatagggatggatattgggatacggatacgtcgatacaatactacggtattctcttaaaaaaaaaaagagcaaagcgtccggggtgcatgtgcatatagcgtgccttcagcacttatcaatcgtccaagccatccgacggctcacatagggcacgcacgtgatagctgacggaagcagcccatcgaagcccacgaaagccaagcgacacgtgcctgcctgcctgcctgccgcgcgccacgtgtcacgtgtcactggacgatggcgacgatagccacgtgacggcatcagtgaagcacctccggaacctctccatccgctccggcggcaaaccgacgcccacctcaatgccgccgccgcggccctccgccaccgagatcgccccggtcttcgccacggacacgacgtccaccttcgtcggcctcccgaacccaaagtccacgtcgtacacgcggaacctcggcgacccggccaccgctagcggcgggccgtcgctcgtgctcatccctctgacgtgctccctgcacctctcccagtagccgggatcgtatctcgttccttcgtcgatggcggcggcgatcgcggcgcaggtcgtgaagaggccgtcctccgcgtcggcggcggcgatctctttcttgggcgccgaggcgaagcatggcccgacgcagttgccgaggtacttgtcggggacgcggggttccatccgcgcccggtgatcggtggggaagacgaagtgggcacggccatggtttcgagggttgttctctgcttcgacgtcgcttgctagtgcggcgtggatgtggcactgccatatgacggcgaacgtcgcgacgatggacgtgcaccgagggggcggcgactatatccttgatgttctgaaggatctctcctgacagcgtgaaagtggcgaggagcttgttgtcggcgacgtcgggcgagctgaacttgtcagactcctccttcgttcgattgaccatgatgtcgtagaggtcctcacgttcgcggatgaacgtgcggtcgatgacgggcggcttcggcagcaccacagcgccggcgcaggcggcggcccaggtatggaggaagtgcgtggagctcgagccgtcgcaggcggcgtggtgcacggtgacgccgagggcgaggccgcggcgcgcggggggcagcacggtagcctgcacggccagcaccgcgccgccatccgggagctccggcgcgagcggggcgatcttggcgacctccctcgggtcgtccgcggccagctcgtcgacaccgacgccgtcgtcgtgctcggcgacggtgaaggcgacggcgtcgcctggctggtagaagagctcgtaccggttggtcttgccgggagtgaggcggaggcggccggcgagcgggtagaagacgtggagcacccgggacagcgagtcagccagccgggacaggacggcgtcgacgtcgtcgtcggcggcgccgaggcggtagaggaagacccggtcgacgggcggggtcgggagccacatcgcgtccaggaaggtgagcgggacggcacgctggcgcagcgaggggacaccgtcgggcgacgacggtgcgacgcgagcggtgcgcaggacgcggaagctgccgccgcgaggtggtggagctgccatttgtgtcgcgggcgccatgtctcccggctagcgagcgagctatccgcgcgcgtggctgatgtgagtagatggagtcctatacaggacgtagtgacgtactcctactatatagtccattttttctgtctcacggtataaatgctgcatgccccatgcttgcaaatcgcaatgcggccgcatgcaaggttctagaaagccattagtgtgtttcactagttgtcaagtttgtattggcggagagctcgagattgattggttgtagcgtcactggtgacgatggccttgcatgcactgtttgaggagaaaccaactggacttttgctgctgctttcggaattttgcggccgcgcggagctcatcgtcatacagatgcggagcagcttggtcgatccgaggataatacgactgctagaaaaagcattttcacagatgttcagagattttcttccaaacggatatgacctgcggagctaaatggccatgaaaatgtaaatcgggatggagctctcttttcgtctgcgaaaatcaatattttcaagcagaccacttaagagatccgcctaaaaaaacctttatttttgtatgcggacctcttaagtggtccatctggaaaatatgatttttgcaggtagaacatgtaaaaaatcatgccaacaaaaaatatcaaagttttatccctatcctttccccaccactcattttcctcccactcctctctctctctcatttgttcaccagcagcagcaaatccaccaccggctcagctcctcgccacctctgccgctggccacgacaaacggcgccgacgcttgtggatctgccgccggctcgcccgccttctcccggcgaggtgtgactcagctcggctcctccctttcacggtgacgcgcgacaacgacgacgatgacggtgctgcttatgggtagaggaggagacacacgacgacgacgacaacaacgcctgtgggagacgatggcgccgacgcaacgaggacgacgcctgtgggagcagcggcggacggaggagagccgttggaggagagccgttggctggaaggggaggcctacggcggcgcccgtgtgcggctttgttttttattcactgaatgtgtttttgtaggcggatgaatcactgcctacgaagatggagatgtcgcttgcaaaaatggccgcaggcccgcctacaaaaatcatctattttcgcaggagattgcacactagtagagaaacgattttcctagacgagaagctatttagtttatatacggaccgttttcacgtccgtatgcgaaaatcgattttcatatgcgggtctcttaagggtctgcacgtaaaaataagtcgatttttacgtgtgggcctcttacgcgaaaaccaattttcacgtacgaacctcttaaaaacatgcctacaaaaagtccatccatcctctctttcctttgtcaacacttcaaaatttcatctcatccacccatcccaatccttatcttttctatactctctctcacactctctcacctctctatcctctctcactctctcaactctctctcctctccagagcgcggctggcgcgggcacggccggcggcaccgcgccgctcggcgatggccccggcggcatgcgcgcaacggcgaccgggagcggcaggctcggcggctcgtgcgcgcggcggcgggcgaccgggagagacggcggcagtcgaccggacaagtacctcaggaactgcatcggcacgtgcttcgcgtcggcgcccagaacggacattgccgcagccggcgcggatggcctattatcgccgccgccgtcgacgaaggaacgcgatgtgatcaaggctactgggacaggtgcagggagcgcagcacagaggtgatgacctggccgttttcggtggcggggtcactacaccagatcctcacatctttgacggcatatctgtgacgggctttagtattggtcagtgatgagggtcacctttgacgggttctacgggacgccgtcatcggtgaggcatccttctgcaatccgtcacagataactagtcacctgtgacggtcccacagtagaaaccgtcaaaggtgaggtaaatctcacctatgatggcttccacatccggcccgtcacaggtaactagttacctgtgacgggttgcatccttataaactgtcaaaggtgaagttaactcacctcaaacggacccatcactggagcccgtcacaggtggggaggggggcggagtatactaatatgtactcccttatccactctgtccctcacacactctctcttatccacataaacaaaaaatctctctctcccttatccacactcacagaaacaagaggggaggctcttgcggggcggcggaggacccgacgaccctagagagaggcggcggcggcggcgcgcggcggtggttcggcggcgttgggcgacggctcagcggcgcgtggcagcggcggtggtgcggaggcgcagcgacaaggtggtgcggcggcgctgggtggcagcggtggtgcggaggcaaagcggcgaggtggtgcggcggcgctaggcggcgagcggtggcggcggtacccacatcctcctcccccttctttctcccctcctcccccttctcttatttccgatctagtgtgtggctcagcgatgcatggcagcggtgaggagggctcgacagcgtgcggaggcgaggaggaggtgggcggtggcgccgcggcctccatccccgactgccggcctccaggagctcggggtcaccgacgctaagctcgagcgacgacgacgatgaccaccgacgacaaccgccgagtctgcctccgggacacggatctggcctctgggacacggatctggccatcgacgcctcccccacctcccggccgccagcgcctccaccctttcttccccgccgatgtggtcggtcgccatggctgccatccctcgcccgccggtcgccagatctgtcgccggtgtgcggtgtgcccctctcgccccctatacttttgcattgatatgatattgttgtctgtgcattgagaaattcttgccatccactttgtgtgaatacttctatatgagatctatcggtttgaattttttgtgtgatgatgaatgtgagcaaagcagctctgagcctgtgacaacgagcaccaccacagcagtgtgcaccattttttttttgtttgtttttcacaccagtgacgggttgcatgctgcttcttttatttttttttgctgggttaaagacatcagtgacgggccacaaaataatgggtcgtttgagataacagtcacctgtgacgggttttatatgtggtccgtcacaggtagccttcaccactgacaggtctacacccgtcaaaggtgaggagagtcatcagtgaccactaatatctgaccagagctatatccgtcaaaggtgacactttggacccgtcacaggtagccctacccagcgtagtgggtcgccaaggttccgcgtgtacggcgtgggttcgggaggctggcgaaggtggacgtcatgtccgtggcgaagaccggcgcgatgtcggtggcggagggccgtggcggctgctccggtggcattgagattgaggtgggcatcgctttgtcgccggagcggatggtgaggttgcggaggtactttggcgatgatatcgcgtggctgtcgtcgtcggggcattgaatatcaattggtagagagtagctggtcagcgctataccagctatactagtgtaatttaactttgaatctgtaagttaaattgtatcaattttctgttgtttgtggtggacatatttgaaaaggattagtatcgtattgtaaccatttatgacgtgtttgttaacactaccacagaacacatgaatagtgctggttgggaaaccccttaaagtgttggttttcccaacctgcattatggaggcggcactaaagagtgatcgggcaccaattccgttttaaaaactagcatctttaaaaccatttgcgagccaaaaaaataggctcgatgcatcgagctcatccaccccgcatcatagaactccaaatcaattacaatcctcaattcccaatcaaacaacatcacagaacaagaaacattgaagaacatcacataaatctttcatagaaatcattcactaacattgaagaacatcacagaaaatcatcacagaaagagaggagggagggcgccgctgcatgccgcctcccgccgtggccgccgctgggacgcccctccccggatctggtggaggggagggcgcggccactgccgaccagccaccgcctctcatccctgcaagagagaggacagcgagagagagtcgagaagggagggcgccgccgccaggctgccaccgcctctcatcccgccgccgcatcccccctcccctctgccgccgcatgccgcctcccaccgcggccgccgctgggccgcccctccctagatctggcggaggggagggcatggccgccgccggccgcgggcagtgagagagaggacagcaagtgagagacgagccaccgcacgccgctcctccaccgccgcctccaccgtcgagagagagagggtgctcgagagagaggggagagagagcggagagaacgagagaaatcgagagagttcgactgtgcgagtggacgctgcggaccttatctcctcgtcctcgacgcgtcgtggtggggcctaccggctcggctaaattcgtaggtgccggtttgcacctataatttattataggtgtcggtttttaatattataggttctggtttttttaaaaaccgacacaaaatagaataggtgtcggtttttatttagaatcgacacctataattacttaaaggtgtcggtgttttgtgatttcaacctacggaggtgggaaaaggcctataggtgccagttttagcactaccggcttttccaggatttaatggtattgtactttcagtggtaggcgacgtatccgtcaacagcgaggcgcctgtggtgacttcgtcaatctccaggatttaccaaccctgtcttcgaagatgctcataggggtagggtttgcctgcgtgtgttcataggggtaagtgtgcgtgcgttgtgagtatctgcgttgtagcgtgtaattctaaaaaaaagaatatatacatgggactatttatttgacatttgatagaaaacactcttctaattctagcaaattttagactgttggttggatgtgtattttcattcctcgaggggatattctctcgttgtttgcatgtcatctaaatagttattacaaaatttgaaaaaaataacaatatagattaatatgaaatatatcactccacaaacatccaagaccaaattcaacttctataagttgtagcaaaagaacaaaataaactgaaatagttatcgtacattctcaactatatttgttgtttttttacgacttgtagaagtttaatttaaacgtgcatgtttctgaagtgatatatttcatattaatctatgttgccaatttttttcaaactttttgatgactatttagatggcatgcacaaaataagaggatatccctttgagggatgaaatcacttttccactgttgggttagcattacttccaactctaaccccttactcttctcctccctccctaccatcatcgcgcagcacacgagagggcaagagtcaggcgaccagaaatctgccccaccttgttaaaatcacttgagtttgacatttgatttcataagtcattttgttgtaaatacttgaccaatttggttttgttataaaaaccgcatagcgtacgtgcttaaccggatcaccccattatcgctgatatagaccaccacaggttaagctagccgcttcaatctttttctaatgtttgcattatatttatttttcatttgtcattgaaatcttctacaaatagagaacctcggtgtaacaatgtttgaactctcataagcaattctatttgtcaaattaaaataagtgttaaggctatacttttaaagctatttaattttggtaaaaccatattgacggttcacaattatgaaaacatattgatttggttaagcacgtgtgcacttaggtggtttttcaacaaaaccaagtccgaatgattatttgcaacaaataatttgtgataaaatatcaaacttgaagcgacttttacttggtttttgctattttccctataaattatactctctctctattttaatgtacgacgccgttgacttttagactaatgtttgaccattcgtcttattcaaaatttttgtgcaaatataaatatgtgatgtgcttctatgctcttcaatgtattaaaaactgcacaatttttaaagaagatgaccagattagaaggatagtgtaaacttcatttagggagggtaatttcatccttgagggagttatctccgatcctataagtccggagcccacaccaacactgatcaccggcaacttttcacaaactgaaaaccactaattaacaacagcgatctctattgcatttgcatcgcagcacaacaagatctctattgcatttgcatcgcatcacaaaaacaaatcgatcatcacctgatagtctgaaacaaactaaaaacgaaatatgcatgcattccaagctgcaatcattatcgtgtacgaaatgcatcgaaaagttaagcaacggcaattgttggcacagcaccatgggtcgagcaagcaagaatcaatgtgttcgttcacttaccctgatattttattttctcctctatctctctccacttaaactgccatccaagcttcttccaattcatggcgatgctggtccagaatcgataactgaccggattactcaaccgtactgccattgaagcaaccgaatcaaggtatttcaaagcaaatatcgtagatgagacgacagtgaaggaaaagtaatagggcttaattttgtgggcgtcttgagtacgaactcccagtccagatacatcttgtgctagccaaaggattgatctgttgattgttgggatcaatctgcggttctaaccacgacaacgggatccatgtagacactagcgactacaacagttttgttcgtgggtagtgctgtcagtggcgtatctaaaatttaaggtatgggtggtccgacttataaaaaatttaaaacatctcgaatataataatgttaatatataaaatataaatataggtaatagatccgcttcttccgtatcttgtttagagtatactcttctgtcataactgggaaaggatattcagaagcttctttttttttttgcatgtttctaaaaatgagatgaaatatctacatctgttgttatgttttaagaatctacatctacatctacaatacaatagtagaattttagatgtatgagttgggtcaaaactgaaaattgaatgcctaatatggttctaatctgctaatcagtaggagtaattaattatcacctgccctagtgctctttgttggttccttcccttgcagctcgcgcagatcccagttggccaatgccctagatgcaggcgctgatcactgcacgtcgtcgtcggctgccgcagccgcaccagcactccggcgccctcttgcttctttgcttgtacgttgttggcccatcgtcacttgatccccaggaagtagggaagagaaggagcagccagcaacaaaccgccgcgctatgcacgcgtgatggcgccgctgctacaatcgcgcgacgagaaggagatggagtcgcggtagcgaagagggagcggaaacggcgtcgcttaattcgtttggaagcttcagcctcacgggatttttttttttcttttttacccaaaaaaacgtgttgggtcgctaatttttttgggtggtcagggaccacccggaccacccattagagccgccggtgggtgccgccatggtgactttgacaagatggtcgagcgatggcgccggatatggagaagaacgacgagaggggaggggccgagatgctgcataattttctctaaagacaaaattgccctttgataaaaacgtttaggctgttaattaaggacctcctaatctatgcctctcatccgttttaaaatatctgcaggtttttctatgaatagtaagaagcagtacacatctcgtgatggggcagtcaatatgtgcactaaattcaacttgcaggaatactggctaatatttaatgataaatcaattcacaattaaataaataataattatataaatttttcaaataatataaatggtcgaacggtcaaaaataaaatcaatgatgttggcgtgtttagttcgcgtgccaactttttttttaaagtatacggatacatatttgaattattaaatgtagactaataacaaaacaaattacagatttcacatgtaaacagcgagacaaattttttaagcctaattaattcgtcattagtaaatatttaatgtagcatcacattgtcaaatcatgacataattaggctcagaggattcatctcgcaatttacatgtaaagtgtacaattggtttttttcatccatatttaatgttttatgcatgtgtcgatgtgacggaatttttgaaattttgaagagaactaaacactgtcattatacattaaaattgggagggagggactaatacagtactacacattacgtcgctagccatctagaatccagggagctcgatccgcggtccgccgacccacgtactgcaatgacatcgccagctcacggcggcagcttccgcgtcctgcgaaccgctcatgtcgcgccgtcgtcgtcggccggtgccggctgcaacccactgccggaggccactcagccgctcaccttcctcgacgcgatatggctcatccgcccacccgtcgagcggggcttcttctaccgcctcggcgacggcggcggtgcgacgtgtgacgtcgacgtcgcgctgtccaggttggtcgactccctagcccgcgcgctccacgtcttctacccgctcgccggccgcctccgcctcacgcccggcaaggccaaccggtacgagctcttctaccagcccggcgatgccgtcgccttcaccgtcgccgagcacgacgtcgtcggtctcgatgagctggccacggacgttcgcagggaggtttccaagattgcgccgctcgtgccggagctcccggatggcggcgcggtgctggccgtgcaggccaccgtgctgctacccgcgtgccgcgccctcgcccccggcgtcaccgtgcaccacgccgcctgcgacggcgcgagctccacgcacttcctccacacctgggccgccatctgcgcaggcgccgcagcgacgccgccgccgcccgtcatcgaccgcacgtccatccgtgaacgtgaagacatccacgacgtcatgaccgctcgactgcacgaccacgtaaagactacgacgatcaactcgcccgacgtcgtcgacaacaagctccttgccactttcacgctgtcgagggaaaacctgcagagcatcaaggaaaggatcgccgacgtggcgacgcgccgcggcgtgccgcctccgtggtgcacgtccgtcgtcgcgacgttcgccgtcatatggcggtgccacgtccgggccgcactaggcgcgggctgcgacgtcgaagaagagcctcggaaccatggccgccgtgcccacctcctcttcgtcaccgatctccggtcacggatggaaccccgcgtccccgacaagtacctcggaaactgcgtcggcccgtgcttcgcgtcggcgcccagaacggacatcgctgctgccggcgcggatggcctattcgcggcctgctccgcgatcgccgccgccgtggacgaaggaacgagatatgatcccggctactgggacaggtacagggagcagagcttagaggtgagcaccagtggtgctccgccgctttcggtggctgggtcgccgaggttccgcgtgtacgacgtggactttgggttcgggaggccggcgaaggtggacgtcgtgtccgtggcaaagaccggggcgatgtcggtggcggcggcattgaggtgggcatcgctttgccgccggagcggatggagaggttccggaggtgcttcggcgaagacgtcgccgtcgcgtggccgtcgtcgtgatccagtgataagtggcattgaatatatgtcaatagcggggccgcctaatgggcgactggtcgcgcaggggcgtgggcgcgcgccccgcgccgcttctgctctactagactactagctactacgtgcagtacaactagtctactctgttgctgtatgatactactactgctatgtagtttgcactactccatccgtcccctaatacttacactatttgaccattcatcttaataaaaaaaagtttagatttattatttattttatttatgacttactttattttataatttttcgtctttttatatatatttgcacaaattttctgaataagacgagtggtcaaataatataaacaaaatgtcaaaatccttttatattaggagatgaaggtagtaatattcttatatatgtatacatatgcataaaatttaaatacttacctatatatactttgattataaaaaattatatacacgtatgcaaactttagaacgtgcgtatacaaactttgtatacatatgtacacaaatttgtatacatacatataaaaaagaaaaaaaagtttatatacgtacgtatataaagttttcatacaacatatacaaagtttgtatacttatatataaagtttgtatatgtatgtatacaaaatatatcaactttatatatgtaaatacacacagtttatgtacatacatatagaaaaaaaatacatgcatacaaacgtatacaaacttaaactttatatatgtacatattaaaatattaaaaaaaagccagaaaaacatatggcatatacaaactttgtatacgtacgtatacaaagtttatattcatgtatacaaactttgttgtatatgtaagtatagaaagtttgtaaacatatacattaaaaaccaaaaaactgagccagaaagaaaaccaaagaaaaaaaacgtgcatatatggtttgttggtttttaatgtatacatattatatatatattttatatatgtttacaaagtttgtatacgcatgtattaaaaaacggaagaaaaaaaagaaaaggaagaaaaaactgaaaagaaacggaaaaaacccaaaatgaaacgggaaaggaaaaaaaaaagaggagagcgaaagaaacggaaaaaaacaaaaaagaacgagagaacgcaccgtccccccccccccactccacgcgcgccacgtgtccggtcgcgcggaggggaccgcgcttgactagccgctaaatagtcacttcggtcaatagctggtcagcgctataccaattagtacatactatgagtgtaatttaaattcgaatctattagactgtaaaattcagttttcaattgtatcaactttattgtttatggtcgatatatttgaaatggattaatatcgtattgtgaccatttatgacgtgtttgttaaatatacgggactgtttatttgacattcgatagaaaacactcctgtaaatttggcaaatttttggcaaattttagactgttggattagcgttactcccaactctaaccccttactcttatcctgcaatcatcgcgtatcacacgagagggcacgagttaggtgaccagaaatccgccccaccttcttcaccaccactgcttggtcccttggctgcctcctcctcctcctccacctcccccttctccaagctaacggtggcgaggtcctcccaccctacctccttccccgactcccttgcctccttaccgccagattcaacaccacctaccattgtctcctaaccagaagcttcactttgcccttatcggcccatcactctcctccatccccgtggcttccatgctgccgccgacacctcactactcgcctgtgtccactttctaccattgggccaccatctcccacagccgtccgtcaatgcatcttgatttatgcacccaatgtggaaaagcaagaatttctctatatggtgggtcccattgtatgaatacggtttaactttacataaatagatccctctccctctctctcttatccctcctttcccatatccctctctctctctcgtacgccttttgcttttcatttggcaacaagggggttgtaactgacttgcaattatccatcttaaatttctttagaattattttctacttattttctttgagatataaatatcgcttcagtactctgatgcacttccattaccaagaaattgtgcaacaagccaagatcactcatcccatatatattcatcatgtcttttttaaaaatcttacatcagcttctcactattgccggtatatatcaagtcatcaacatatagtgagaaaattaaaatgttcatacatgtcctcttgatatatagggtaggctcacttttgctcttggcaaatcctttttgaataaagtacttgtcaatttgactgtaccatgctctaggagcttgctttaattcatataatgccttcttgattaattgattaatagggacttatggaaccttccagttccatctagcgttctcatcaaaaatcacatctctgctataatgattttctttttctctagattataaagctgatatcctttaataccatcagcatagcccacaaatatgcagcgatcacttctattatcaaatgttactctcttttgtgctgacacttgagcatacaaatgcaaccaaatactctctcatatgaccacaaatgacaggcttttaactataccaagcttcaaaaggtgtatagtttggtactgccttgtaggacttctatttaaaatactaggtgattccccgcgctttgctgcggaaattgctaagtaacttttaacattcttttaataatcaagctaaaagtaagaattatattacttattaacaataaataaaactggtttgtcaaataatgtttagagagaaaaaaatttagtagactctgtatgagattgtagatgaatatgatatcccacacttttattatatggatgaatatatgttaagtattataataactatatatatatatagtattgcgaaaaatagtgtgaaggaagatgattggatgttgatttgtagaattcaatgaattatacatgatgctgcatgattgcatattattgccagtggatgatgaggtggcatttttgcatgttgagctttaggattagtggattatgactttatagtaagatatgataaattgcagtgttaactgctttagcccagaaagatttaggcgtacctatgtcttggactatagagtttgccatgtcattaatcgtccgatttttttttgcaactccattttgttgagcactatagccagccgttaactgtcgtctttggatgcaagcattttcacaatatttctcaaattttattgagatatattctcctccttgatcgctgcataatactttaatttttcgattactctgaatttccaccatagacttgaattttttgaatgtattgagggccgctgatttttcttttagaaaatatacccagatcattcttgtataatcatcgataaatgtgataaaatatcaattttctccttgtgacattgttggcactttaccaactatatcagtgtgtactagttccaatggtgcatttgctctccaagctccactatgtggaaaggcagttctaatttgttttccaattacacaaccttcacatgggtcaaacttcagtgtaataaatagaaggtcttgtaccatacctttagtcttgagtagctttagtgctctgtaactaagatgacccatcctcttgtgccatagattagaaatatcaacttcacttctgagagccatttgagtaggatgattcatcttcaacaaaaaatttatgtttgtccccatatttattttgcaaccagacggttatttttacgatccaatattttgcaagaaaattcctcaaaataaaccgcatacctgtgttctagaagctgccaaatacttagcaaattttgcttaaaatcgggtaccggcaagacatcctttataaattttggacggactgctgtttggacagcaaccgtacctttcttttcactttgggatatagattcaatacccatgtgaatctttgcatgatatgatgaatctatttcttgaaataaatttggatcagcagccatgtggtttgtacaaccactgtcaataacccaaacattatccttttcttcttaagcagtacgacaagagaaaatcatttcttcatatttttccttttcttgggaaaaattagcccgattaatttctcgagttctgcaatattttgcaatatgaccctttcctttgcacttgttgcaggtcattttcttccaggacatatctgtaatatgactagattttgggaaatgtcacaccacaaatttgaactggatgtaactttttctattctttcttgattgtcttccttctgcatcatgttctacttggaaaatcctttttttttctgaaaacaaccacggtcttgcattggaaatccatttttctgaaaattcccgcaaaaccttaagttttgaggcctgaagctcaactttgattgaaatgcattttcaacgaagttcccttctcgttgaagctttctttcttcatgagattccaacgagctcattagttgctaagttgtgagagtcgacaagtctttcgactcctcaatagcagcaacaatgtactcgtattttttaggctgactgattaaaatttttatccatgaccttttgatccttaatatcctcaccatagaggcgcatctgattaacgatcttaataagtcttgagaaatagtcttttaccttttctgacgccttcatttgtaaattctgaaattgcattctcaaagtttgaagcttcactgcaagtaacttctgagatccttaaaactcctctttcaacttatcctatgcttccttggattttttggtgccaataatacgtggaaatagactttccacaactccttattggatcaagaacaaggctttggcgtccgtcattcgattctccgtcagagacttattatgttccgctataagagtgatgagggtgttaggtcccgatctttcaataggtattgataaacagtcgatttgggcagagtcgtgacacaactcgatccggcttctgaacgaacacgctactgagccccgcaatcgcagcaccacgtctcctctggttaccaactgtgccgaaacccagttgacctcgccgagaaagctaatccctacatgcaaaatcgaagaacacaagtaagaacaagatagattgcaacacaattgcatatgaatgattaagcactcaaatttggtgttctacaaaccgatctagcggcgaaactattcttggcaaaataatctaagcaaaacccgactctaaacgatgacggctactgattaagtatgattagggacgtcctagggttgccctagggcgcacaccctcatgggctaagcccacgacacaattacaaggcccaaaaacccaaatcagatttggactggatgagatatgtggtttgttttgcagattcccgacagctcagtattaattttgacgtgggaccaaaaccatctgaaagtagattccataagctttctaacaagtactcatgggccctgaaattccttctagatcagtggctaggtccatttgaagttgatgctatcaggaggcccgaatctgaatacaaaacatgtagaactttatctcttgtcttctatagaccaaaagtgacgtggtgatataaaagaagacttggagaaggtcttggtttggtcccccaatcaacttcttcaatcatccatgcattccttacgctcggtctcttttctttcgcccaagcaaatacctctgcaaacgaaaacacacaaaactcattgtgtagcaacgtttgttcaaatatataacaagtaaatctaatataaaacatatacacctttggttgattaatacataaggtaatcatggttatatccgagttagttgtgtcctcatcatcaaagagtactttccaatatcccataatccttgatagtagcagtgtccacatcttgatgcaccatatatcataactttctcttgtaaatacaggaaccatagaccgcgtcattgtggcgctcgaacttgaagccatacctatagcttcaatatacaatgccgatacgtcgagctacttcgtcacgccctactcgaacttgggcgctctaatttgttgttggtgtatatttgtaagcaagggaacagaggggagtgctggatgaagtggagctagccaagggaacagaggggagtactcgatgcagtggagcttgccttgaatatgtgggctgcttgttgtaacttgtttgcttgtattagggcgttcacagcgcgccacaaatttttgctattcctcatgtgccacgtagacgaagaacctgataagcttcatacaacagtgcaagtattgtgggagggctggcggccgccgcgtgaagccacgcaacgctaaggccacgagctccacaatgcagcgcccagccattctccatgcgccgtgctccctcacctgccgtggagaacgcgtgccctcttttggctccgcgaactcgcgcaggcaacgcactttggcgacgtgacgtcgaatctttcctggatgaaacatcagcaatctacacatacactagttgcctatatttataggctgaacaaccaaccaaacttgaagcttcatgaatatagccccttttcagatcccacctcaaaatttttcaccctgtcacatcgaacgtttgaacacctgcataaaatattaaatatagacaaaaaataactaattacacagactgcgactaatttgcgagacaaatcttttaagcctaattgctccatgatttgacaatgtggtggtacagtaaatatttgctaataacggtataattaggcttaataaattcgtctcgcggtttactgacggactctgtaattagttcttttattagtgcccgaacactccatgcgacacccaatagaatatccgatgtgacacgccaaaactttacaccctgaatctaaacaccccattagtagaaagtagtactaccgctggctgcctattgctactactacacatcggccgtgtttagttggtgtgccaaaatatttttttttatatacggatacacatttgaagtactaaacatagactagtaacaaaacaaattacagattccgcttgtaaactacgagatgaatttattaagcctgattaatctatcattagcaaatatttactgtagcatcacattgtcaaatcatggcgtaattaggctcaaaagatccgtctcgcaatttacatgcaaactgtgcaattgtttatttttccgacatttaatactctatatatgtgtccaaacatttgatgtgacggaatttttggaagtttaaagggaataaacactgccattgatgcatagaagtacactagtctagaaacttttacagagtagtagtagtactggtcttttgaccattggttctagagaagttgacaagaataagatgtctatagagaattcaggaaatggattaactacaacagcaggaacatatcgctgctgatggattaccataagatttaactttgagacacctgaaacattattccattatttttagacaacaaaaataagaaacaaattgtaaaaatatataattaccctctgtcatatctaaccctcacttggccttcccatgaaactcacatctcacactccttttgtcgtcgtcagtcaaacttgggcgcgcggcaaccgttgttctgctgcatgcaccccgcgccaaaagtgttggaattaattccagtcgcctgatgcaccaaaaatagcagctctccccagcaaatcaacgaccattacgtacgcgggaagcgggacacgtttgaaccgagctatcacacgagttatacgtgcgacaaccgggctatcacacgagttatacgtgcgcaccagcgcatggcacttggcaccacaagccgcgtatcactgccgtatcgtgtactcggatcgaccatgcaagctgcactgcatgacgatgagctccgcgcgcgcgcggccgcaaaattcacccaagctgcagcagcaaaagaccagttggcttctcctgaaacaatgcatggccatcgtcaccagtgacgctacaaccaaatcattctcgagctctcgaccaatagtaccaacttggcaaccactagctcaaacacactaatggtacactaatgttcttctagaaccggcggccccacccgcattgcaatctgcgagcatggccacgcagcatttataaccgtgaaaatttggtaagactgaaagtcttacgccccctgcgaaagacttcatcttctgtgcgacacgtgtcccgtggtaatttcaaagcagataactccctcaaaccctcctaacgatacaacctaacgtcctgacgtcgttagcagagaagacgaaccggcgcggcacggcgcggctgcagggagatggagtgttggcgacccgggcgcgccggtgattcctgatgaagtggtggcggcggcgaaagccccggctgcggcagcagcggccttgcggtagctagggcaggaacgtgaggctgaaactcccacgccagcgatgcgtgagggacggcgagtttgtggcgttgccgcggctgcgccggcggcatgagatgatacggccatgactcctgatagtggcatcttcagcatcatacatatagtgagctcgtatggtgattagataaattaattacagagctctgctattgaagctccggtaacaaacttgactattggcgattatataaattgggaattaagataacaagctccaacagtgaagcagcacagaatttcatcagattagaagatgtcttaatatccatatgcaaaaacccaaaataacaagacaacagaacttgaaaagttgattttgatactcgtgtctctgacaaagtggaaagattttgatgctcgtgtctctgacaaagtcaaaatgattctaacatcagtcataagatgtcgatgaattggggtcttgattttcaaactctaaacgccaagaagctgatgctgctgcagtagtttcatgatgagcttgaaataatagatttgtgaattctcctcgaattggcggaacgaacatcctcgaaatgtcaccaaatggcatcacaatatttgagtcaagtggttcctgaacctattcatattgtaggaaaacaagaaaatttttaaagtacgctcgcattatgatggagatttaattcttattgatcttacagttggctgcgaagctccagctatatttatgtttgatggctgtgtggtttcttctcctgcaatgttcataaggcaaaaattggtacttaatgaagtcgatgaaaatgaaaaaaaataaaagacaagcaagttaaaatagaatacctttgtttgttgttttctttcctctgtcaagcaaacttctagatcttttttgcaatggaccttttttgtgaggaggagctctaattgatatgcgctcttttgcaacttcttctgtgcactcaagaaaacattgtggagcttcattttcatctagattgaccttgcttagtaaattttctacttctatggtcagtttatcaaaaccatgatccaagtgttggaggacttcattggaaactccacattttagtgtaacagatatcatttttcggcaaagatatgtactttgtgatgctaagctgtcgctttggccttttctcttgcatgtaaagattcctctttttgcatattttgtccatctactcaatatatactgaggaggtaaaacaataatactgttgtggttgaagatccgtagtacatgcttgcataaaatacctacatgattcagaatatgttagaggtgaaatattaatcccaactagaatggggaatatgtcaggaaaatacacttaccaagacaggtatacttcctgcaagaacatgatatattcatatcaactgaattaaaggtgactcttgtttcgtccttactgtgatccacagttactaccttctgtattgtggcccacttctcacgcaaatcatacaagttctgtatccaagaattgtcttcaaggtggtaatcagatatcaacttttgccaattgaagttaaagtgtgccactgacctttcttcatacacacatcttttaaagtcatgaagaaaattaggattattggagattacatggcttagatgctttgcagcattttggtatatatgccataggcaaagacagtgacttgagtttaggaatacaatcataatcgcctttgccattgcagcacactgatctgtgaaaattgtttcaggttgcttccccgacattgccttcaaaaagtttctaaatagccaaacaaatgaatcagcactttcatcgaataataatgcagctccaaaaataatagtttgcctatgatgatttgctccaataataggagtaaatggcatttcagacttgtttgtttgaaatgttgtgtcaatggagagaacatccccaaaacaagcataatctgcaatggcctgaccatctgtccagaagaaattacaaattcgaccatcctctttgtccaactgcacagaataaaagaaagaagggtcttctgcttgtttgttatccaagtactccaataatgtttgtgcatcttgtgtttctaaatactttttgcgctctcgaccaataaagttattgcaatccatttgtaagaatggcacattttcatctccacctaaccaccgttgaaaaaaatcaaatatctcagctagcttaactcctgcttgttgcatcatgctaattatatgctcatcggcatttgacatacgccgttgtgatctaagcatgtgtgacttgtcaggacttacaaaagggtaattgtgtgccaattcgattttctgcagcttccaaataccttcctaggaaataaagaactgaacacgagccttgcaatctgtttttgtacaagcacgttatttctttggctggtgtgttggattactgttcttgtgaccttcattactgcaaaccatgtacttggatgataaagtgccatctgctctgtagttaacgtggcactttcgtacactaaatcccactcttctagcatatgaattgtagaaattgtatgcatcatcctcagattgaaaggtcatgccaaccttcggcacttgctcgcaaggagcattctgattggtagcctataggtacaatagaagcatatattaaattggattttttcttggatattagtttatagatgacttctacacggatatacgctaacaacctgcagtcactttattacaaaaagaatgccttacctttatatttgattgagtaacttgttcagatttctcacgatctgatctgaacactacattatgaccctcaagattgcaatttgagctttcacccatagcatgatgaccaacagagttgaacgtaaaaccggttcctaccaacagcaaatggaatcaaatcgaatgaaaaatcgagtttaagtcatcaatctatcggccatatggaagaatcaacaacagatggatagtaaaacaagcatcttctcactttggctggcttcgctgagtgtggggtttgattcacccacttgctgcacctcacccatgagcaccggttcatctcccacgccgcgttcgtccatctccccgcagccgcaccgcgtccgttcgtcttctccgctaacgacgtcaggacgttaggttgtatcgttaggagggtttgagggagttatctgctttgagattaccacgggacacgtattgcacaggagatgaagtctttcgcaggggagtcttaccaaattttctgtttcacggtataaatgctgcatggccatgctcgcaaattgcaatgcgggtggggccgccggttctagaagaacattagtgtgccattagtgtgtttgagctagtggttgccaagttggtattttgattcttcgaggagatgtctcctcgttatttacaatgtcactcgtatatacgactcctatatcctggtagaagtaggactccattccccagccacccgcgcggatcggtcgctaagccgccgagagacatggcgcccgcgacacaaatggcagctccaccaccacgcgctcgcggcggcagcttccgcgtcctgcgcaccgcccgcgtcgcgccgtcgtcgcccgacggtgtccccatgttggtcgagcgcgccgtcccgcttaccttcctggacgcgatctggctcccgaccccgcccgtcgaccgggtcttcttctatcgcctcggcgccgacgacgacggcgtcgacgccgtcctgtcccggctggctgactcgctgtcccgggcgctccacgtcgtctacccgctcgccggccgcctccgcctcacgccgggcaagaccaaccggtacgagctcttctaccagccaggcgacgccgtcgccttcaccttcgccgagcacgacgacggcgtcggtgtcgacgagctggccgcggacgacccgagggaggtcgccaagatcgccccgctcgtgccggagctcccggatggcggcgcggtgctggccgtgcaggctaccgtgctgccccccgcgcgccgcggcctcgccctcggcgtcaccgtgcaccacgccgcctgcgacggctcgagctccacgcacttcctccacacctgggccgccgcctgcgccggcgccgcggtgctgccgaagccgcccgtcatcgaccgcacgttcatccgcgaacgtgaagacctctatgactacatggtcagtcgaacggaggagtctgacaagttcaggtcgcccgacgtcgccgacagcaagctcctcgccactttcacgctgtcaggagagatccttcagagcatcaaggacagagtcgccggcgtggcggcgcggcgcggcaagtcgccgcctcctcggtgcacgtccgtcgttgcgacgttcgccatcgtatggcaatgccacatccgagccgcactaggcgacgtcgaagcagataataagcaccatggccgtgcccacttcatcttccccaccgatcaccgggcgcggatggaaccccgcgtccccgacaagtacctcggcaactgcgtcgggccatgcttcgcctcggcgcccaaggaggagatcgccgccgccgacgcggaggacggcctctacacgacctgcgccgcgatcgccgccgccgtggacgaaggaacgagatacgatccggactactggaagaggtgcatggaacacgttggagggatgagcgcgagcgacggtccgccgttagcggtggccgggtcgccgaggttccgcgtgtacgacgtggacttcgggttcgggaggccggcgaaggtggacgtcgtgtccgtggcgaagaccggggcgatctcggtggcggagggccgccgcggcggcattgaggtgggcgtcggtttgccgccggagcggatggagaggttccggaggtgcttcgctgatgccgtcgcgtggctatcgtcgccgtctcgtccagtgacacgtgacatggatcgatcagctccgggccactccccggcgtaggcggcggcggcaggcaggcaggcaggcaggcacgtgtcgcttggcttccactcgctgggcttccgtgggattcgatgggctggttccccgtacccttattttttttcttggaaaataccgtagcattgtaccgacagggtgtgttcgctaagttgccagcgtggaacagtctgcatggtatgcatggtaaacagaggtattagcgtgtgattaattaagtattatttttttaaaaaatagattaatttgatttttttaaacaactttcgtataaaaacttttttaaaaaacacaccgtttagcagtttgaaaaacgtgcgcacggaaaacgagaaagaggggttgggaaaggaggtgccgaacacacccttatccgtaccgcaatatctatccctatttaaaggacgtgacgatcgggcatccgatgggagaaggttaaaatcgggcgctgatgtcagcatgacgtcagcacccgatttacgtgtaaaactgctctaaactgaattttctcctaaattatttatccaaatcatgatctgattgcaccattaatttcattgcaattaaatgttcgaaacaagaccacacatggatatattccgacgaaaaaaaatcttattattgaattatttttaaatgttgtacgatgttccaccagatatatcggaaatgtttcattaagtagatcaaaaatgtttccctcgtttaaatcggatgttatttcacattatataaaaacaatatttcagcaaatagtgaaagaatgtttcagttcactgcaatattagatctatatatagtgaaacattatgagtacactaggtgaaacattttttcggtagaaaaaaataaaccaaattcccttaataggagtttctaaaatatgtgggttttttttaatggaatgtttcgttcactgcaacattagatatatacatagtgaaacattgtgagcacactaggtgaaacattttttatgaaaaaaaataaaacgaattcctttaatagggagtttctaaaatatgtgggtttttttcaatggtaggtgggagcagacaacgcggtgggaccagggcctgcatgcacgcacgtggggggaggggtg

SEQ ID NO: 25591 - DNA, 10405 bp, Oryza sativa
cccgcgccggtcgcccgatataatcattctcgctattttaaacatactccctccgtttcgaaatgtttgacaccgttgacattttaggacatgtttgaccgttcgtcttattcaaaaacttttgcaaaatatgtaaaattatatgtctccataaaaatatatttaacaatgaatcaaatgataaaaaaagaattaataattacttaaattttatgtgctaaaaagtcaatcgcgtcgtatatttcgaaacggagggagtaggatttttcccatcgtcacgacacaacccgatttcattcgttgtccatcgtgggtccgtctgcttttctgatttttccatttgtcgtttgattactccgcgtcaagcccgcatcttccgtatgttccacgtagcacgcgtacatcatgcaaggcccgcaaaccgcatgccatcaaacactcaaatcaaatatgaaacggagagagctacggattggtcgcccgatcggggctgggaaaatcgggcgctcacgtgagcatgatgtcagcgttcgatttacgtgcaaaactattttaaactgatttttctcttaaattacttatctaaattatgatccgattgcatcattaaattcgttgcaattaaatctttagaacaagaccacacattgatatattccgacaaaaaaaatttagcttattattgaattatttttaaatattatatgatgttccaacaggtatatcggaattgtttcactaagtagagcgaaaatgtttcactcgtttaaatcgggtgttgtttcaccttatataaaaacaatgtttcagcaaatagcaaaataatgtttcagttcactgcaacattagatctatacatagcgaaacattctaagtacactaggtgaaacatttttcggtggaacaaaaaataaactaaattctcttaataggggtttccaaaatatatggtttttttgttgttgcaatggagtatttcaattaaataagcgaccaagatttttcccacaaaatcaaaaggacaaaccccaaaatttttccgaaacaaatccaagtgcaaagagcatatgcagatgaaaaggtttcaaagggctcttagggtttccagttggcttgtactacggtcaaggtcggctctgataccaacttgtcacgcccagaaattcacgaaccagaatttctaagctgaatgtgcattaaacccctgtccaggaccagccagggtacacaaacgacaattgttgatatacagatccacgtcttacaaaaatataaaacattacaaatgcagcggaaaagataaaagtgagctaaacctgaagacttgactcctgcagcgaggcgactccattccacaggcatccttgacggcagcgacgaagccaacttcttcgagacatcttcaactgaaaaggacttcaactctagtgtgggggaaaagagagcaagactgagtactatccactgtactcagcaagtcataccggaagagaaggtatgatgcagggtataaccaaaggaggctagaggttcatttgcataaagctagcatttaaaagcagcagttgaaagcaataaaacagttgtagtaattaatcaatattaaccaatcactgtccaacgctacaccacgttgcaacaggcccaaccaaccacctgaactacaccaattcattagctaactagggtgagactaatcacggtgaatctggtcgaccgcccataaccgcgggcacggctattcgaatagttttactctgatcagaggtgtacaactgtatccacaacacacagccccacgacacgtttccgtgcgccgatatgccaccacgacataccggaaagaggccgtgataggacccttcacataaccccctctaaccgatcgcaccacaccttaggattcgccctcgtccccaacaggcaacgggcagcccccctttcgtgccgcgatgaatccggaagccgatcaaccggacaccccggccgacccaactccatcatgcccaccctcgcctgggtacgtcggctagaggaaagctacactacaagcctagccgttgcccacgctggcttgtggtaagtacaataagttcttctagggcatcccgcgaaccggtccttaatcgccatgggtacgactagaaaaaccatgcacccacagcccaccatgtagtgtattttaattaactaacaccattgcggtggcactaatccaaagctatgccaataatcaaagtccatgcattaatgtgatttcccttttgtgtactagtagaactaagcatggctaagcatctcctaaaccaacatctagtcattttagtacccaagttatcaatgtcataaggtaatcaatatatggctgagtagtaggacctatcccacatgatattgtaaaacaatgcaatatttaatagaaatgccggacatttgtaaattgggtacaatatgatcaattgtaatatatgacttgccttactctcgcactgatgagaccacagcaacgtctttgagaaaccgcggatcgacgaaacggccgaaatctacgcgtcaaacaaagcacgcaagcaaaacacactataagtctactaaaacaggaaacaaaactacttttaatggattctatacatttttcttgatttaccgagacttgaatggacttaaacggagctcggatgaattacttatgaattttagaagataaactgtgtttattactataaaagaaaattcttaatgagttttattgcacaataaaggatcccggatgaagtcagcagggggggtcggcgccgacatgcgggacccacccggcagtggctcaagggggaggaggtggcaccggctggtgggtgggccccaccgggcagtggctcaaggggggggagacacctggttggctcggctcggcttcaaaccggccggccggttaggcgatgcagcggcggcgagcggccaccgacggcggcgactagcggcgcgggagacggcggtggctggcgaggaggcggcggcacacggccgaagcggcggcgcggacaggaggcggtgacgcgcccaaaggcggcgacgcacacggggaagagggagtaaaagagggggagggagtcctcatcggggattcggccggcgtgggtgaagacgacggcggacggcggcggcaagcggcggacggcggggcacgcggaatggacgagacgggcctcgatctcgcgaggccaacagcggcaatggagcagcgcgtcataaactatcagtgtgtccgactaccccacatctagtacatgctttgaacttcaactctctttccctgaaactatcaagggtcgcatcattgtcgtcatcatcatcatcgtcatcgtcatcagcagagaaccgttctcctgattcatcatcttcgggtctgggcggaccgtactttataaggtgccgggttagctgacgcgctccacggaaggtattttttcgtctctgacgcttgggtatccttgcggcatcttcaggagtaaattctgaactagtgatgatcatggtccaaccattatccatcttccatattactgtcctgttcgctccagagttgggctgcaaagtaccatccttcttgtcggtaggctgacttggagcttggttacttcctgggcactgcttctcgtccttttcaagtgacctggcgaacaccttccatgggcagttccttacataatgaccttactcgccacagtcataacaggtagcacttacttctctttggtttgacggtggcttggctgaagttatcttcggggatctggacagcattttgacaggggtcttcggtgccgatactgggaactcctgactctgactctgattcaggttctgggctagcacctggacttgcatttgtggctggtggccttgccgcggctcctaacattgtcgttgcatctgctgcatctggtatatctcgtaccgacgtcgtatctgttgtaacaactcttccactgtttgagtctgattagccatgacttggggttgaagctgatcttcgtgaagttgacgtggaatgcccataggattgcactgagttgatccatgaaattgttgagatcttgacctgatgagattgtccctcatgctgaccaattgttgcgggcacaagagagagagggggagatgagaggggttactaaagataaggtactggacctcttgcctattgatatgttgttaatggacttttattgttcaagttgcttaagcaaacaacctagtatggtcgcatccccaccaatgatgcaaaccatacccctacacacaagcaaacaatcacacgatctagcagctaacgaaactactcttccgggaaggattgggttttaggtaaattctaggaaaacttcacttggccttcgtggaacgacgactctggactgatcttcttgctccttgctgcacgaagcctgagatgacctgacatgacttgacttccgaacagacatgaagctgacggtttgtccaccgggttttgcaactaaaagagttggagagaaagggaggagaatttcgaaaaaaccgtttcacaaagaaatgccgaagggcgagaggagacgttttgcaaatagggttatcagaaagcttgtccttagggtttgaccatttggctcaacctacagtcgagttggctctgataccactttgtcatgcccagaaatttagcccaaatttccagactattttgtgtattaaatcactgtccaggaccagccagggtatacaaaacgacaagtaaatatacagatccaaacataaataaagcgtaaaatacttacagaagaggcacttagtcctcacaccaaaagagaacgacagcagcggaaaaaggcgatcctagcggggcttcagctccactccacaggcaaaactcaactggggtctaagccttggtcttctgactccgtcttcagctcagaagcactacacttctgaaaagggggaataatagcaaggctgagtacaaccaccgtactcagcaagccacaccaatgatgcagacgtgcaaagggattcaagaatggcttgtggctatttgcataaaggcggttgtaaaacattttattgagcaaacagtaaaacaattgagtaatcaaggtaatattaaatctccactgatcaacgctacaccacgttgaacaggcccaaccaacccacctgaactacagtgcattgagtcgatttattaagtgtgagactaatcatggtgaatctggtcgatcgcccataaccgcgggcacggctattcgaatagttttactttggccagaggtgcacaactgtacccacaagacacaatccactggaatgtcaccatgcctgcgcagacacgtcaccatgtcgagtgattgtgacaagaccctccatataaccccctctgaccaagcacaccacacctcaggtttcacccccgcccccagcaggcagcgggcagtcccctctcgtcctaggcgaatcagaaagccgcataggccgtcgcagggcccatccgaactccatcacgctcacccttgcctggatgcgtcagccagcggaaagctatacttcaagtcaggcagttacccattcccgcttgtggcaagcgctgtatgtcttccagggtttcccacgaaccggtccttaattgccatgggtgcgaccagcaaaaccatgcacccacagcccaccattcagtcgtgttttagttggataattacgactatgaaacatggccggatgtctcgagcacgcagctcgtcatgataccaaaaggtctaatactgcaattatcccatcgactgagctagtggtaattaagcatggctaagcataaagttctagctaggtcatcatagtaacccaagctagtcgatttatcacccaaatttgacaaaggaccgtcacgtcccaaaacgactctaaaatacatcctctaaattatgccgagaataattaaaatccgtgtgaaagcctccaacaattaaaatgtgcaaagttaaaagtcaaataaggcttgggggatttttgtatatttcctaaaagcctaaaatacgtaaataaattttagtggaattttcagagcacaaataataattattaagaaataaacaaagttaaaatgattttataaaaagaaaaactctaaaaagtcccctctccctccctctccctcttgggctggctcgtcccatctccctccccctctctcctctttcccgcggcccatccggcctctccccgagcgcgcgccgctgacgggcgggcccgcccgccaccctcgctgacgggtggggcccacccgtcatccccttcctcccgccgctctcgccgcctcccccgcaccctagcgccgccgccgccgcggattccgccgcatcccgccgtccccgcgtgcaatcaataggggggaattattccccgcgatcccctctccctttccccccatttttccctctctctctcgcgttcaaacgggcggatttgcccccgcaaatctcgccggcgccattgatggagcccgagatcaccgcgccggtttccttcccctccggccactctctcccctttccaaccctatataaaccctccccgtgcctccctcacccgtttccgcccttgccgcaccgtctcctcgccggaatcgagctcgcgccgtcgctctctctctctgccatcgccgtcgagctccggtccgccgccgccgtcgccccggaccacctcccacctcggcgccgcctccttcggcttcgccgcatcctcgccgacctcgtccacccctctgtttcggtcgccgaccgccggaacgccgttgaccccgtcgacccgagccgcgccgccgccttcctccgctccggccgcctttttcgtcgtcgccgtcgacctagggtgagccgaggaccgccgcctcttttcccccttcccttcccctctctcggccgccgctccaccgtgcctatggccgccgccggcgaccataggggcgcgggcgccgcctcccgccggccgcgccgagtggccgccgcgtggggcccggctgtcagccgcccgcgtcctcgggtgtggctgacgcgtgggacccatggcaccgggcggtgcgagcccgggtgcgcccggtccaccgtggaccgtgaggctgccgcgtgggccccactcccgtggactcggtccgcgcgcccctccccctcggctgacgcaataaaccctttttaaattaaaatttaaatgaagaaattcgcaagtattcatttaaagagcatataaacttcaaatggccataacttggccatttgaactcggaattggaccattcaagtctctaatttttccttaagaagtcaagaacccatttttgtgctctgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattaatgcattatcgctttatttaaattcccgcgttatcattgttttatttagccatgcctatttatctttgttatgaccttattattattgttattgatattattaccttgttcaccctagattaaacaaaaccccaactagtggacactctactcatggttccactagtatgaatttaggtagatgcttcgctggttaattaggcaacattaggtggttttacaactttagactttgggaattctcatatcatttggacactatggaatggttggcttatgttggaattggacacacacctccccctctattcaaaacccccaaaatggttttaggctgggctcgaagtgcgtggttgggttttgttagtcgtacctcgggtactataaggattaagctcgggcctctgttgcaaagcactaccgtacttctacatgtctagtgggtaaggcttagtttgtggctcagtctggttataaacaaaagtacacggatagagatggatgaagtcgggggtcgatggacatctctaggacaaatgaaggctacacgagctgcggcccggttgtcgagatgtcatggcacagggccggtgtcctgttgctaggggctcagtcctgcctacctgtcctgggggttccagccgtaggtggggttgggtcggtattcttgtctatggctaggatgggttggaaactatgtcacgtctttcgtccgtataccgtggtggtatgtggcacgtggttacacgtgaggaagatgtgtcttgtgggtaaagatgtacacctccgatcagagtataatctattcgaatagccgcactctcggttatgggcaagtcgagcaatgtacccaagttagagttttaattcttaaaacctgcctaacaactaaaatgtggaatggttggcctgggttggcttgggacgagctgggacccagggtcgggttgccagttcggtctgaatcatcgtaggccttgggttaaggcaggttcgtgtgggttcacggccttgtttaataatattgtatagctctaggatcgtatttacaaaatagctttgagcaactaagtgtcttttaatgctgtttactgcaaaccctaaccctttatattataactcccttttactcccttgcatttattctgcacttgtgggtatgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgagtgtgctgggccttcgccgcccatgtaataaattatctatttacgcttccacttgttaaactctgaactgtatcaacttttggtgtaccttgcctcctgggacaaggaataatgcacgcacgtaaggaacgcccgttgtgttattttcggtcgtgacaaggacagatatcaaataatatggcacaagcaagcatatacgtgaaccctattcccatgtaattagcaaaacgatgcatatttatttgcaaacggaaaacatttgtaaggtagggtcaaaatgctcaaggggaatgtgtgacttgccttgcttcttcaaacaatcttccgaactcttttcctcgcgaccgcagacttccgaaacgagggattctacatgctggtacgcaaaacgaggaaaaactcaaataaacaccaagaaaacagtacataaaaagtaaactaacatgtagagctcaattttagatgaattttgcaacttgaatggctcaatttggagtttggatgaattagatatgaattttagaagctttgagccatttaaatgaatttctagaattaatatcgaattattgcgcaattattatttatttttacaaagaaaaggggattgctgacatcagcaaggggtgaggcgcggaccgcgtccacaaaggggtgggccccacacgtcagcgacacaaggaggtaccggcccatcgtggaccgagtccatggcggcgaccggccacgcgggcacacaaggccggcggcggcggcgaccgggaacaaagcggcggcggcacacgggccgggcggccaccggcggcggcggcgcgacgcgcgcaagcacgggaggcggccggcgaaggggagaaggaggagggaggcggctcaccgagagccgcggcgacagagggagcggccggcgaagggaggcggcgacgctcctcgggtcgacaacacggaggggctcccggcaatggaaggtgtcgaccgagcggcggccgagaaagagcgtgacgcggcgagggaggcgatgcagccggcgcgtcgcggcggcagccggggcgatggcgaacggcgaccggaggaggaaaaaggtggccggtagggtggtgtggtggggaggtggttctggtggtggagggaaaaaagggatgggcggccgggcttgccctcgcggtggtggagctaacagaggcggcggtgtggtgtgaggtggccgggaatggcggcaattagcgatcggaggcggccaatggtggtgggagtgacggtggcggctagctggagggcgccgacgggcggcggagatcgggcgcgcggtgcggcggtgttttagaggcggagaggggaaaagaagtaggggccggggtgtggcgtggagcggcgacgacggtggtggcgacggcgcagcgcggcgacggcgagagcggcggctagaggcggccggagctcgccagcgacggcggggagagggagcgacgatggcagggtggtttttgggcatgggaaggctcgggagggagggaaaaatg

SEQ ID NO: 25592 - DNA, 14973 bp, Oryza sativa
  unsure (1)..(14973): unsure at all n locations
aaatgggggaggaggaggtggggatcgagtccacgctctcgcggggcggggtggagtgcgggaggcgcggcgtcgtggggtgaaaccggcggccatggcggttgcagccggtcggatggaggtagggggagaagctgacgagtgggccccgcggtcccacttgtcgacgagaggagggggaggaggccgagggggcaaaagcagacttttgtgagggagtggggaaacgggccgacagcccaagagaggagaacgaggccggcctgggaaggaggggaaaggaggaaggaaggggattgggccaagcccaaacggagaaggggagggattaatttgtttttctttttatttaattgattaaatgaattttgtgacttttaaaattatttctcgagctccgaaaattcgcgggaaattttagagtgttttttttagggcacaaagaatattacaaaacattcccggccaatgatttttaaaataaattttaaattccctcaataattcacttgattaaattgctttaacttttatttaatttctagaaaatgcattatttaatgatatttaatcccgaacgaaaatcggggcgttacaaatatgatcaattgtaatgtatgacttgccttgctcttgcactgatcagaccacaccaacgtcttcgagaaaccgcggatcgacgaaacggccgaaatctacgcgacaaacaaagcatacaaggaaaacacactataagtctactgaaacaggaaacaaaaccatttttaatggattctatacatttttcttgatttactgagacttgaatggacttaaacggagctcggatgaattacttatgaattttagaaataaactgtttttattactataaaagaaaagccttaatgagttttattgcgcaataaaggatcccggatgacgtcagcaaagggggggcggcgccgacatgcgggaccagcccgacagtggctcaagggggaggaggtggcaccggctggtgggtgggccccaccgggcagtggctcaggggggggagacgcccggttggctcagctcagctcggcttcaaactggccggccggttaggcgatgcggctgcggcgagcggccaccgacggcggcgaccggcggcgcgggagacagcggtggcacactgccgaagcggcggcgcggacaggaggcggcgaagcgcccaaagacggcggcgcacacggggaagggggagtaaaagaggggggagggagtcctcaccagggattcgaccggcatgggtgaagacgacggcggacagcggcggcaagcggcggacggcggggcgcgcggaatggacgaaacgggcctcgatctcacgaggccaacggcggcaacggagcagatttatctaattttcttcatttatctagcagtagtgtgtacagtctatttttaggctatcgttttatttcagaaagcagagcattgcaataccagaaatgaggcttattccttttgtacatctagagcttctcatatgttgtaaaagagttgaactagctcagattataaatagtataatacaagttcttgatagattactaaccatcaatatccaaatcctttgtttgggcattcacaagcttccaccatccatggaatcctccaggtccaggttctgtagataaagatgaatacatgatagagacattgaaacttcatattccaattttacagaaagctagcaagtagggcaacaaacccatataggcattgtgcaatactggataaatagaaagacaaaaagctggaagagatcttgcaagcaatcaagcaaatagacatctttctctttcagaaaattaaatagacagatgataagaagagcacgagaaatttactgaccacaaaattatcactatagctgatttcatttagatttactgagctcactgttgctgccggtggagtgtcctccggagcacctcgccggttggccaccaagcaggtagccgtcgcccgccggtgcctccgtcggccgccgaaagaaggaactgcatagaagaggaaccaaagaatcaagaaccaaagaaaagaataagaaaatcaagaaccaaagaatccgttgcttgttgctatcatgtgaaccacactaccagtcttggggggagttggagacgtgaggaggactgaagaagcacacctagccaccgctgcctcaacccgtggtggatcacaccgcgaagtcgaagccgccactgccgccgcctccgcctccgccgggagccgctgccgccacctcgatccacggggaagctgcgccgccaccgctgccgcctctgccgggagccactgccgccggctcgatccgcggtggagccgcaccgcctcaggccgggagccctaaagccgccgacgccatgcgaacgcgagcaagcggagcgctcgaacaaggccgacccgaaaacccctaggatcaactgactcatggacccattgttacctaagaaaatatggaccggcccgaaaacctattggtgccacaaatttaggttcgggccacggacctaacgggtcgacccgccccacttgcaggctgaattaccgactcagagactatcgccaccggtcgccacgcgtggcatgacttacctccgcgcctcaactcccatatgacactacccagcctcagctgtgtcgtgtacggtgtgacaccggtatggctcccgtggcataagatggccatgcgtgcggaccgaggctcgcctcagcacatggtctccaccgcgggccgtcgaggagaatcttaacctaataggcgcacaacggcacaagcgacatcaattgagcgctcacgtgcgcgctgccgccgtcgtgcggtcatcaccgcccatatcactggagaagcaggtgttaggtgtcaccaggtatcagttttggctcatttgcaaccgacgcccgcggccgtctactcggactgcattagcttcatgggccgagcatgtggacaacagcttttctgaccgtataattttggaataagttcatctaggtcccttaattttacacagaatccgatttacgtccttgaaccccaaaaccagatacaactggtccctgaactgtcaaaaccggtgcaaatgaggtccctcggtggtttggaaggcggttttggctgacgtggcgtctacgtgactaggtctccatcccacgtggcattgacgtggcgcttacgtggcaactatatctcggaaaaataataaaaaacggtgggtccacatgtcagctaccaaaaaaaattaaattaaaaatggtgggacccacgtgggcccacatgtcagcgaaacaaaaaaaaataaatatggaggggcccaagtgggccccacatgtcattccctctcggctctccctcttcttccctccgccgaccccgacctctttttcgccatcctcggcggcgtcggccagttcggcgtcatcacccgcggccgcgcccgcatccctctctctccctgcgccccgacctcagaaaagtaagagagagcgagagccgctgaggtccatcgaggtcacctcgcccggcccgcgcccctgccacggcggccgccgccaccagtccaccaccgtcgcgcagccccacgcagaaccctgtcgcgctgttgcagctctgcgtcgaccgcaggtgcctcatcttcccgttcctccacaccgactacgtcccgggctccctccgccgcttcatcaccggcgccgcggactgcttcgtcggccttggcgtggacaaggaggccgagcggctgagcgacgaccacggcctccccgtggggaacaccgccgaccttcgccccctcgcggcgtagaggctgggccgcccggagttcagacaggcctacctagattagatttagttgctgttgcatttcgctcctgctgtctcgtaatgttaggctacctagattcagttgttgttgtatttttctcttgctctctcgtgatgttaggcaaggatttatgagatttaaggtgctatgggtttatgcttagtactgaagaaattgaagaatcggatgaaaaagaacgtgcagatcttctgatctagactatggttaatgaaatttccagtgctgatcctttatgcgtttttagtgctgttttaatatctgttttagatgatactgtttgcagatcgtgtcatcaactggaaatggctcgtttgctcaaattgttctgcggctccttgcacggcggtcggacgcggtcggaggagatgctcccactactcgccgcacgtggtcggaggagatgctcccagtaagaagagctggcgacctcctcctctgcctcctcctcctccggccaccttcgccgcccacggcctgctgtcgtcgccgctccgcctacccctccgctccgccctgccgctccacccgcggcctgccgccgcgccgcttagccagcatgcttcggccgccgccgtcgtcggaggcagcggggactgagacgacgacggttgtgagacggcgccgcggcgcgagaagcgcccgaagacgacgcgttaaggaagaaggggaatagccgagagggaatgacatgtggggcccacgtgggccccaccatatttttttttttgtcattgacatgtgggcccacgtgggtcccaccatttttaaattattttttgtgtgtagctgacacgtggacccatggttatttattatttttctgagatataattgccacgtaagcgccacgtcattgccacgtgggatggagacctagtcaaactagccacgtaggagccacgtcagccaaaaccgccttccaaaccgccgagggacctcatttatactggttttgacagttcgggaaccagttgtatctggttttgacgttcaaggacgaaaatcggattcggtgtaaaattaagggacctcagatgaacttattcctataatttttgtgcctgggttgggccgtaagaaaggctgcgcctatgatgaagttttgagccgcaagctaatcaatcatcaatgctataggtgaagaaaggaaaaagtatacttcgactctctaaactatcacccgagtatgatttatatcctccaaccacaaaccagatatatcaactccttcaactattaaaaccggtgtaaataatgtctgtcagtggttttagaggtggttttggctgacgtggcgcctacatgacattcttaaccgagtctttgtcctatgtggcacttacgtggtattagaataaaaataaaaataaaaaaatacgtgggacccatacgtcattaaaaaaaagtattgtgggacccacgtgtcatcctccctctcccttcctcctctcctctctatcccttatctctcgggagcggcggtgacggtgggagcgccggccgtggcctcgtgagtacactcggcggcacgacgaagttgctgatatggagcacgaagatgttgtacggcaccgcggcgaccaccctcttgagcgtggcgttcaccagcgcggagagcgcggcggaggtgaagacggcgccacccttggccgtcggggtgatggcaagaaacctggtgcggcggcacacgttcccggtggtctggaacagggttgtcgacacggtgggcctcccccgcggcagcgcggcgatcttcgcggcgtcgatgtagtcgagcacgacgtggacggagaggagctcgacgagcgccgcccgcggcagcctggcggctgcggcggaggagtcagtccacggcggagttgtccaccagcacggtcaccgtgttgcggctgttgatgtcgcggtcgacgtgcgtcttgctgatcaggtagctgaacacaggccgaactctgggaaccgcccgaggatctccgtcacgttgaacgcgccgcggcgtcatcgccggaagccgggaggacgaggccgaggagcaggagaaatgagagcctggccgccatgtgttcgcgtgaacaggaggcagatatgcggtggaatttttttttaatgacatatgggtcccacagttttttttatttttgttttttattctaatgcgccacgtaggacaaaagctcggtcaagaacgccacgtaggggttacgtcagccaaaaccaccgaaggacattgtttgcatcggttttgacagttagaggagttgatatatccggttgtgtggttgaaagatatgaatcatactcgggctattgtcgagagagtcaaagtatactttttccggtgaagaaatgcggatgtgctaagctaattaacgggccaaattaaattttctattattttcttggcctatttaaatattttatcaattacataatgagttgttgcacctttggatgatttaaaatttgggagaaaaacaagataaaaaattatcatgcatattatattatttcttgcttaacggaaccggatttattttgaccaatattgattataggcccccatcgattggcttattctgacgacatatttgcaaacgagaaatataatttataaataaaacttttatattagtgttcttagcgatctaaaagctaacgctaaaaaataaacttcgataagaaaacctcaaaatcaactccaaatttaaggttaaaaaatcaaaatttagctgagaaacataagaacaagagcatgtacaataacagactataagccaactataaacaaatatcaagaagataaaaagggagagataaaagtagcaagctatatatttgagctagctgcagcacagacttcaaatataatgtgtgtgtgacatgtgggaacatgtattaatactatagtatatgtttatagataactattgtatgaatttactattaaattggctacgaatgatttggagttaatagttgactatactattaaactcgctctaagcaaaatgatgaggctgatagatgtaaatctcttatgcttaattttcccgagtcatttctagccaaatagaaccaaccggaaatatggtttgaaatttctcagttatgtggaattattaatttcatgtcagtaataatgttatttattccgatttattattctccatgattatttcctttaccatcgtatgtctaattttggtattattaaggattttcattcatataattatggttttagtttcttcatctaattttgtccaatgctgaattggcgaggaggatagcgagctgagggctgctccatgattcagggcgaccgagctggcgccattgatgccgatgggaaggtgatgcgatgcgggagagagcgacacatatggacagtccgtactccgtaggccgggggagggactgggagggggaaaaggggccccttaggtgaaggaaggaagaagtgggagttgggctgagagaagagaaaaggcggcctagcctggcctaggaagaaacggcccaattgaatggtaaaatctgttattttccttggattttcagagttgggttatggacgaatttcaatggattttgaatatggatttgagttcaaatgtgatgtttggcctgatagagtgacagagaataaaaggaaggtttcaaaatgtatgtttgaacaattttgaattagaagttgatatttgaggagatttcgtgaggaagggaaagagatggatatttgattcaaacttgatattttaattcacataaattcaaggaactttgggagaggatatttgaattatattttgatatgggatgcagaacttgaatttgaataattgagagtggagaggaaaacggggaggatttcaaagggaagtttgattttaaaattgacatttgaatagagaaaaagaaaaatagaaaggatgaaatgacaggtgggggtttggggccaaaaatttgatccacatgcagagtgatatgcctgccaaaatcgtttttctacttgtgtatccgtgtatgtatattactagcaaaatgcccatgtgttgtaccgggtaataacttttaaaatgatttttcttttaaactactgatccaatcggcgatttgattgcaccactgtattcgttactgttaaatctttgtaataagatttttcatggttatatttctaataaaatttatagatggttcaaccactacaatttgatgtttcacgtataaaaacacgaatgtttcaacttgaattcaactttattaaacagtatatttttctgattttatgatttttattatgtattcagtcaatatgactaaatgtttcatatagtggttgtaggccatgcagtcaatattttttaatgctgcattttttaagatattttagaagtaacctgaaacatttattattaaaaaatgtttcatcgagtattgtgtgatgtttcagtagtgataacttaatgtttcatgcgtaatatataaatgcttcaattagaaaaatatatgtttcttactaggatataatcatatgagatattgttttaaagtttagttggaaggaatataatagtacaatcggattataaattagatacataatttaggaaaaaaggtgatttgaatcttgcaaaaagttgttcatacataatactgcataggcaggaaagtacgtatttctttatcttgctgagagatatctaaattcctaccagaaaaaaacaaaagaggaaaagataaactggctgcatggagggaagggtatttgattttgggaaaaaaactgggtgcccgatctgtagtcctctcccaatttttgttttgctagcgccacaatttggcactaccaaatttagtgtaaagaattttaactagtgtgggcaaaaataggtaacaaaccaaacattcttggtactattaaagatgccaaaattttggtacgacataaattagcttcaaaccaaacaagaactaatgatcccactaaaattggatgaaaaataataagtagaacttcaggcatcgctgggctcacatcggtactgctatgtgcactattgtccatttgtcctcctcattcggactccatcggtttgctgctctagggccagaacactgttcgtctcctctactccctaagaaaattaattaaaattctgagaatgattttaaacaaactctacggccatattcatttgttggattgggttttttttaatatataattacaaacggagtacgatggcgactgcgtcctgccgacaatgataaaactaaagcatgaaaaatctggaccgccaaacagctgtttcctaagccagcgggatttttcggacggctccatgattgcatcgatctagtcagcattcagccaacccaatttggattctccgtaatctgtgggtgttccaaatgagcccattatacagtaatcggataagcacgatagtattgctactgtgatacgtacttggattacttcttgtctcaggctgacaacgagatgtcgatcatgcattcgcacgcatgctgcgcccattcgagcaaatgcaaaacagcgctggatctgacaattgagcctaggcggctaatagcgttgtccggtgattaccagttttattttacgaacattggtgaccttccataatagacgcgttaacggaagaggctggacagcccgtcgacctgcgtgagagacttgtacagaaaagattttgtccagcctgtcgacctgcgtgagagacttttttccgtgtggttaaaatgttttttttccgtgcgaaggtcttacccatctgcacctagatgtctgagagatggccctgcctgagaggtggctccgccgatgacattaaggtgcatcatatcaatatggcatggagttattaatgattcaggaatgacgggctagtgagttttaaggcccgttagattaatctaagtttcatttgttgttgatgctaaaaacatatactggcctagaaaatctgtttagctccagtgcagttctaaagaattgctttcgggttctgagcgtaccaattagtttgatcctgcaaccaacaagaaactaggaaaagatgcaaagttaaatccataaacgacagccgatcagctggatcgctgatgacatatcattcaatatttagccgatgtaacgtgtatcagatcggcaatgcgagataaattatagaaatagttaggcccgcccgatcgtctgaagatatcaatgatatacaatctatgcttcggaatacatttataaccaagtgattgggatagatcgtacagcacaccgaggcggtataaatcacttatgtctaaaagtactttgaagtgtagattatatatattcatagcatagccgatagagcaaaccctaacatgtctcggctactactccgatactactttatactgagatatcgatataagggaaatatactgaacgaggatcaatataacaggacaacctaacagaccaatagcaggcttaatatatttcaaagaaacaagatcctaatataaatggcagatttagcatatcaagcaaacacaagaatgacaagataactaaaccaggtaagatcaattgaaactctggtactatctctactagcaaccataaaacaggctagatagtgcagttcaaaacattacttaacagattgaacctaaccgatgtagcattaagcatgaagagaaacacaaaatctaaacaagccgatggtggcctcatcaagatggtggatatgctgtgcagtctaattcggtcgccaatgtctaaccttgttagctgttttcgatgatagaggctagtcgataaagttaaacaatgggaccgatctagattacacagcgttgacggtcgttagtgatcagtttcgactgtcaatattaccaaaatagaggagaactaactttgcttgcaatgcatattcatgttagaataataatattccactaatattgggattactaaccttttgcagagaataaccataaagtggaggagaatcgacatcaaatcagacgataaatcaatcggataatgtcgagaatcagacttatgtataaatgggctcagaattgacacgatgaactgggccaaaattcacaagtttgcgcatgggagcaatagaggaggccacttgccgattttgggccaggctggcccagcccatggttcggccaaacccaccacggcgccattcgatccagggttctcctggacggctgggattgactccctatggcggttggagggtatttccgaccattccaaccgccacaaccgtcattctcaagctataaaaggagctctcatcctcacttcactcacactccaagcaaagctctctcatattctctcaagtttagtttagtgttcttaagctagtggagtaggaatagaatagaaattggagtccggaagccttcgaaagagttcaggtatggctctagtagcttccctttcctcttttgtaagttttgtacttttattagaatactcttctttatatatttatggtattgaaatactttctgagtatataaatgccaactttatagtatgtttatgttatactgattatactgctagcttatctaggagatgcataggtacgggtataatgtttgctattgcaattactctatatcatgacgatgatattagagtagtatctggtagtttagacctggtgtctagattacgggatatcattatttgtggttatatgctgcggatgagaggtgggctgctgatggtgacagctcagtatatatagtcctaagttaatttcctgggaagggtactcctccgtatttagccccgattgtatggtcatgacgggctgtcgtaagaaactcgacagttaggagtggcttctcgaagtactagcagggcatcggaaaaagggtattagctagttaatcatatagctagaatatatgtatactatatatatatatatatatatatatatatatatatatatatatatataagtataggaatatattctctttctattttctttccacttagcttagatattttagtatgagaatgagtagctccctgcttgtgtatcactctacccttgatttatcttaacccctgcttagactatgattagggcatcaccaatgtatatgtcaaagtgatccatataaatgaaacccacataaatagtttatccttatagcaatctccacaatatatatagatacaagatatcattaggagaagagagaggagtagagatagataatataatttattccatatgggtagtccatatgcatatgggtatcttttgctattttttctatatggactagttgcacaatgataataggtggctgatggaatattctattgcttatggactacttttacacaacattgtggatgcccttattacaagtaacatataaattattagtccggttctctctgctatgatctttccacgggattaaataaatacgatacccttggaatactctcgggtgaaatgctacaatggtatatccgtacgcttgcggatgaactctgtaaccataacataccatgagtatttctgcgccattgctgggaattatatttctagtaatgtcgttaagaaataccaacacacagcatatatgataactcggcgattcacataagcaggattagaatgtcatgaatatgcaaacactaatcccgagaatgcaaatcgccataacaagccttacctcttcgtcggagatcgaaaccgatgcagccggaagtattattgaactgatgttgtttgtttacaatgtctcgggccatatttatacccaaaatacataatatataatatgttcttgctggacacaactctatctctattacaacttaaaatacgaacaagtcccttaggacacatgatacgattgccttttctagactcaatccttgcgtggcaatgcctgtgtagtgccttgatcgatcccaacaatgattctagaaccatattcctgggatcggctgcatcagcttctccttgtctgactcaatgtcagccgatgcagacaacagttgatgtcgtttgtagccgatgcgtactctgcttttgagaagcaaactctctccaaatcctcttcgattctaacttcgaatccgatctatgatttgccaaatttggtcgttaacagttgtatctatccattttttaaccgtggatgcacaataaactaagcatatgtttggttagctgcatcacctttagcccgcttagttgcccaaccgagtatagaagccgggtttttcccatgcaaacttcttttccacagccttggattttcaaattgtggaaatgtttttgttggttccaaattttatttcttggatgttaaattgaaaaatttcaggattacacgcgtgaatctttgtttgcttgcccatgtctctatccatgttcgtatgtcttatatcttatataggaaagggatttgtgagagaatgattcccctcaggtgcccaatattccttggattttatttcttttatgccagtgccaacattcaaaattttcaaactaaaattgctaaattgaaaagtttttttttttgcaacgtctacttttccctctttcttgggctcaattctcctcccctttctctctttcctctccaaggtacgtagagagtgcttatgaatgagcaagtggggacatgtaatgccactttgcgatacaaatatatatgaaaatgtttctgaaaactaaacttaacatgtgaaactagttttgactgtggcattatggatttatttaggtggttcatagacactactacagattcgatttctccatgcggccataatcaattttcgcatgcgggtgggtggctcgcttgcgcccaggtgtctgcgaaaattggattcttgcatgcgggtagagcaatcgtgtgcaaaaatagcatgcggacgcttaagccatccgactactataaggaaaaaatcgcaaaaaaaaaccaaaaatcaaaaacctaccccgaaaccctaaccttagaatcctcccttcaccaccatcgccatcgtcatcatccttgtcctcctgtcgccgccgctgccgtcatcgtcgttgtctttgtcctcccgtcaccgtcactgtcgtcgtcgtctttgtcctcccatcaccgccgccggcgtcgttgttgttgtcctcgtcctctggtcgccgcctacagtggatgcgcgcgcgagggtggtgggatccatacgggtgggatagggggcgttggatccaaccctaccattgccaccaccgatggatccatgcgaatcaggtggagcggtggccagattcttgcaggagggagagggggtgccggatccaccctcctgtcaccaccgctagtgggagccctctcagccacactcgccgccgccgctctcacccgaacctgccgtcgcctgagcctaagagcgccatcctcgcacgagctcgctgccaccaccggaacgcaagcctgccacaggggtgccaagaagtgtggacaggaaagagtggggagaggaatgggagagttgaacagggagtgtgaggagtggacaggggaggggactatgggagagggatattttcgcatggcgttcttgaactgtgcatgggagattgatttttgcaggcggaagtagttatgatctgcctgcaacctaaaggagatctcgtctagaaaaaatcaattatgtagtagtcacaaaatggttattgttgaccctattttaaggactagtcaagaaaatagataggaaacgaatatgagtacgaccattttttcgtatgagattagacctagtgaatgaggtgattctagtgaggcagcacaccggtcatgtccagtacgttctgatcgctgtggtcctatgtgtttgaataaagagggtagagtgtggtgttaatgacaagtagaataaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25593 - DNA, 1447 bp, Oryza sativa
ttctgattgatatatttgatcttttatctaatgctagcaagccaagtgttcctgataatactggttagtgtacatttaatctcttaattactgtcatcttcattagtgttcctgataatacttgcttattattgtcatcttcaatattttcaagtccattaaattaatttattttttcttacacattttgaagattttaatccttctgaagatgacaagaataagttgaatgatggcagcataataaatgaagctaacatttgtgaaaccccaaaggtaattatatattttttcattttctatattctgttttttcaattttcatcatttaaaatttgacctaaaacttttatgtacagatccattccacttgtgatgacaatgcaattctaaatgaacagtccccaatgctgtgcaaagatactaaaactcccgaaagatcatgttctgaaaaggtatctaaatagaaatactttgcaatgaactacaattttaatcctaattttccagtttattaacatttcattaatatgaaattttaaattccaaatttgtaggataaaaattctgatgttgatggtataatgagaaagctttgtaagcctggtatgtcttttcccttttcaattatgattatttctttgttatttttttgatagtaattctgctttttgattcatatctgtttcttaagaaaaaaatttatattactgatttaattttttatgcaggaatgatttctagtcctccaaagataactaaagcaagatttgttggtttcaatgaaagaaaacccatctattttgatcatgagaagccacagtttcaaatctgggattcagatgatgataacattaatcaagaagataatttgaggtctgaagtaacaccaagacatggactcaaatcaagcaaaattgttcctgattcttactccccagcatgccctactgaattgaacaaaaccaaggttagttctctcattctttgaattgtggtctgacatcaaaactttgtttgtttatatgatatatgtggtcttagatatgttctaaaattgattggccaaaattcaattctgatcttgaggtcttaactagaaatactttgcagtaaacaacaaattcatatttgattatttatatatttttttgtcatcctcatgagttatattcacattccctgttactgagatttctattataactcactttgtttgaaattttcactttctattaacaaaatataactattataagtttttactatgatactaactgtattgacatgtcacagttttcattgaactttataatcaaattcagatagcaaacatgtcacatggtataatttattctgatctttttttgtctttacaatttgccatatagtgcaaatctatttaatcatcttgttgtactattacagattattccattggacctgt

SEQ ID NO: 25594 - DNA, 4186 bp, Oryza sativa
  unsure (1)..(4186): unsure at all n locations
caactaacttctctgttgttaaaaagtgttttgatggagcatcccttgcaagacctgttcacagctgtgacttggttagtattttttaatctaaattaaattttttataatattcaatcttgtcattatttttttctttttcagcttttttttccaattgtcaagaatcggcactggtttgtgtttgcaattgatctgaaagctcagaggtttgtttttttggattcaatgtatgatgaggacagtatatatcatcaacagattaggccaaaactggtatgataagttatagttatttaagttcttatgattttgcttatctttttttttgaattttttccattctcatatgttttatttacatacaaatttgtaattattacttgaaattgattgttcgtagatatcaaactttagtcttgcctggaacctttatgtcaaagatcatccaatagatttcaacaactacacagtcatttatcctccagtgcccaagcaaacaaacaggtataaactcatcttaaaaagtctcatttacatatttctattactgaaattacagtattcttttcatgtaattttaattcaaaataactgtaatttcattttaagtttaattttgtccaaaatacatgtcttcacatgttgtttagcacaaattaagatttggcaagtaaagactagattcatttttataatagaatgtgtatcagctggtcattggattttgattcttctgatttatgtcatctaaaatgtcaattacatgatttttgtattgatattacagtttttttctatatatttatgattcaaactcactgtaatttttttaattgttctgatatccttacaattagatgctaacatgttctacaatgatctccaatacggaatacaatgggtaaaaatgtaatttggttgtttttgtgatgtgtcaacttaccaaaattcatttattttgtagaacaaatttaatactagtggctcattaacagagtttgaatgattgttgtttagtatagggaattgtttacctcctagttcactgacctttcagcatatggctgacctgcatgttagtttacatatacttgctttatgggctttcattgcttattttctgagattaattgataatgattatgactcttctgatttatgccatcttgaatgccatttacatatttttactattgatattacagtgtttttctttataattattgttctaattcattgtaaatttaatatgtcactgcactattatgaattatgagttgtctattttcattttatgaaatcaatgacattgaagaaaaaatatgtactgaaattttcagatatcttttgtttggtatttttcaactgccattgattgatatgatttttatgaattgtaaaatttttgatgtcagacatcatttgagatgttttatgattttattttcttttttttgtagatttgactatggtatttttactctcaagttcacggaggtttggggccctagagtgctgcttccaaatatcttttcgcaaagagatattcctaatatcagaatacagttactcaacaaaatgttgtttcacccacacaattcaattctttgttcagacctttacaaactactggatgatcacttctgaaggtaacaactttcagtgaacaaatagctaattcaaaattgataactttttaaaatttaattaaatttgagattntttttgttaggtgtgctgaagatctgattcaacaggacaacaaatttgtctttacatgcaagcaatagagtatagcagtgcaggatatcaattctcataaaactgtaactagaatatatttgtctagacaatttttttttgtaatctcagtactgatactagactatagcggtatatgatatatagtactgtaactagaatatagcagtacatgatataattttcagcacaaattcatggtggtgaaatatacaagttctgatatttgtgctgtcagcactacataaattctgtttgttctagttttcatcttctactcttttcttttcatcacacatctcttgcatgtgttgatttctgatttcttcttgacccttttgctcaactgttgtacttcgtcttgatgactctagcttatttctgaattctcctttttgtttggttttcttttctttgaagtagcttccttcttctcttcttctccactctgtaaatgagccaaaaattaatcactcataatatcttaaaatatgaaaaacagaattcatttgtttttgcagattaccttttgtggtttacttggaatttttcttttccttttccttgccaaatcaaactcaatatgcttgaagggacatgttggaaaagtatgttctgtcctaccgcagtgactgcagtgatttgtttctttgtcctctatttgctctctaattgttttatatctttgcttaggcctcccttttgaatttgctatatctggatcttcaatgtaatcttcttcatttctgatatctccatgaatgtgtgtgttttctgatttttcattcacttctgctgttggactaaaactattgttctcttcatgtccctgttgtttatctgctccttcaaattcatgagagaacatagtattcaacttttcatcaatcttttctgattcttccatcaagaatttgtatgcttcaactgttttcgcaccttttgatgcaatttcagcaaatttccttgacaggatattaaatctgagaactgatgattctgaaacaggtatgatttccttccctataattatttctgttgatttatgattctttctccatctatgcatgatatatttctccggtatttctttgatgctaaggtgaagcataatcttcaatatatgagagcatagtatgccatctttctggaacattgcacaaatacatgtgtattcttctgtatccaagtccatcatcacaaggtattttctctttctgatttgcttgctgatcacattttctgcctcaaacactgcataacacttgaactttttaatctcttcaacttgtaattctaatgtcttcctgagctgagcctgaaatcttttgaatattttgttgttatataatttcactgcttggtactcaatggagtagtttgaccaaaaactagtcggcctttttgttcttgattcatgatcgtcatgctattctaaattttgaatagtgtccataaccctttcatattctgtcaagaaacttctgatgctatattgggggccaacatttttcttgaatctcgagttagttccttcacttaatgctgttgattgaatgaaaggacagaaatctgttttgaaatatactggaataaacctttttctgatatgccacatgtgtgctagaaaatttatctcttgcagattgaattcttgaatcatatcctgccaaagaacctcaaattcctcttcagtcaaacagttatgtatgatatcactgtatattgcataaagaccttgattctttttgaataaggatctagatcttttcaaagcttttgaaattatatggaaaaaacaatttcgatgcttagcttctctgaaaatatttttgatagctgctctcatagcaccatcttggtctgtaattattgtctttggttgcttcccattcatacatttcagaaatgttgtgaacaaccattcaaaagtctctgttgtctcatcatgtaaaaatgcacaaccaaacaatatcgtatttccatgaccagaaactcccacaaaaggtgcaaatggtaggttatatctgttggtcaaaaaagtagtgtcaaaattatacaatcaccaaatttgtgataccaatctctggatctaccatctgtccaaaagaaatttctcactttcctattttcatctaaatcaaatttataaaagaaatttggatctttgtcttgttttttcttcagatatgtcaaacgttgcatcatatcatagcggattgattctctgttgatttctgttctgacattgatgatatcattcttagtgtaaggtaatcaagttaaaccacctctaagaaatgacagaataactatcatgttccatgccggaatgtggcattctttcaaagttggaataagcaccgcccctctcgttgataaatacatgtgtgaccttagaaatatgactttgtttggaggg

SEQ ID NO: 25595 - DNA, 11941 bp, Oryza sativa
aataatatgttccattagactagtgtatgatataaatgaatcctatttgataaaaaaaacaaaaaatcaatgtagtcttgattgtcaaagaaaataaaagaaattatatcaaacttaaggttgtcaaagtaaaaatacttactgcaatgtagtcttggtccaacagagatagaacattgttttcataatcaacctttgcattgttagctccattttctgcagaaattttgaaaattctaatcataaaagaaattatatgaaagaaatagtgctattctacaattcttgttacctgaattaatttcttgcatattcatacaaatatgattgaatatgaaagaaatatgattgaattttttcaacttgttacctgaattaatttcttgcatattcatacaacttatagttcctttgtcattgttttctataatacctgcaatatttgataccagtattataggttagtgtaacttttaattaatcaaaaaaattctcttaaaaataatataaatattactgcaaattttttacttttctctgattcattcaaagcactacatccaatgtctgcttctgaatttttggtcttgtcaagtttagcttctgtttctgagaagtctttactgttacctgaaaataaatatgaggaaaatatctatttttttttgttttactattactcatacctgcaatttgcttcataatttttcccttacctgtttttgtaatgtccatgttttcttgcactctataagatagtgttgtattgtaattctcctcaagcaatgctaaacctgttttcaatcatataaactattaaatttgtttcacaaaataattaatgcagtatgaaagttgtcaaacaattttatacatttatttatatttacatgtctgatttgttgtgttcttcttctcaatcttacttcctatatctgacaagtgccccttgttccctgtttttttaaaaaaaattgttgtcaatccatagttgtataacatttacaattttgatgaaaatatgattgagtgcttgtaacatattcattaattacctgattttatgttgtctctgttttcttgcattttatatgattgagttgtgttgtaattcttctctaggaatgctagacctgtttaaaatgaaagactcacatttgttagaatccagttaaactctttctatgaattttttttctaaaaaaataatttgaatttaatggacttctttttgtatacctgaatttgactgaaccaaagcagtacaagttccatcttcgaaaattcctgcaaaagattataaaacaaattacaagcataattttttacttttaattattcttctaattattcttataattacctggtaattgcttcattgtcttaaatctctgtgcttttttgtcggtatctgtttcaaaacctttcgaaaccaaaattttttattttttgatcaagattagtgaaaaaaaagtacttaatatgaaatttacatagcaatacacttacctctcgatgtctttacttcttgtaattgcttttcatcagccttctttagatcatttgatattttcaaaatcttctcttctgttcctgaagatagaagcattcctcttcatgaatttttttttttggccagatgatgataaatattttttttgattaagcaaatcaattttctgtacgtcatcaggcaagaaaattaatcatgctaagttaaaagaatgattaaaattcttgtcctgatgatgtgcagagaattgaggtgtttttttacttatctgatggccacatttgtttttatgtcttttttttcatttttctaaatgaatcttttgtggttcaagtaatattagtatgaagttttggacttcttttgcaaacctgattttgaattaacagaatcagtactagttccagcttcaatttttcctgcaaaagtttataattaagatcagatacataatttttctctcgtcctattgtttaatttgataaatagataatattataaaatttagcataatatacctgctaattgcttcattatcttcagaccctgtgattttttgcctgaatctgtttcaatacaaaaaaagtaattttatagaagattagtgcaaaaaaaacagaactaaacatgaataatacagagtaatgcatttaccacttgatgttttccctgcttcgaattgcttttcatccgccgtctttaggacatttgatattttcaatttcttctcttttgagaagcattacccttaatgaatttttttttggccagatgatgataaatatttttttgattaagcaaatcaattttctgcacatcatcaggcaagaaaattaatcatgctaagttaaaataatgattaaaattcttgtccagatgatgtgcagagaattggggtgtttttttacttatctggtggccacttttgtatttatgtcttttttttgtaatgattttgattctcctgatctatatgatctacaatgtcagttacatgatttcaatattgaaaatacagtttttttctatgtaattatggtacaaattcactgtaatttttatatttcaaagtttttgtttgtctaagctttggtttgtaatggaattgtttgaatctggattgatatgtttttgaacattgaagtacataagctcattaacaacatgaatacaaaatgttgccagattgacaacaatttctggtggactgaattttttgatgtatttacttgttctgtttcttagtacaaaaggacatgaactacattgaatttcacttgttttaatttcagaatgaaatagtgggcaatgaattttttaaacaatgaaagtttgacatgaaatgctttagtgttctataatgaaattttgacatgacatgctttagtgttctgttcattcagattttttcagaggtgacaagtgtctgctattcagattttttcagagcaaatcttcttctatttgaatgacatgagctgcattagaataaactagttttaattacaaagtgaatttttactttttttgaatttatgtctaagctatgttatgaaatagattctttgaatctgaaatgattttgaacattggagtacatcatctcattataaacatgaatacaaaaatgtttgctagattgacaacaatttctggttgtaaaatgttttttacatgatttcaatattgaaattacagttttttccatgtaattatggttcaaattcattgtaatttttatatttcatagttttagttaagtctaaactatgttatgaaatggagtgctttataaggtgtagttatgtcatgtatcttgtttgatgatttgaaagtgtttatgtttttcaaattttttacaaaaaggcatataaagtgtgatcttgttcaattagacaatctgatttctagattttcagcagatcctgtttttattcttgttcatccagagaatcttttttgttcaaacatgatttctgattctgttttatttgcattgtagtataaaatctgaatttcctacatcattcagaattttagttcctatttttagtgtactgtttattcagaattttcagaatgtacaagtctctgctgttaatatagaaattttcagaaggaacaagtatttgcttgttctgtttcttagtacaaaagaacatgaactacattaaatttcactagttttaatttcagaatgaaatagtaggcaatgaatattttaagcaatgaaagtttgacatgaaatgctttagtgttctgtaatgaaattttgacatgacatgctttagtgttttgttcattcagattttttcaaaggtggcatgttttctgtttcagagcaaatcttcttctgtttgaatgacatgaactgcattagaataaactagttttaattacaaactgaatagttcacactgaattttttacaatcatgtttattgctggtgaattttaattttctgaaagtttgagatgacttgctttcgtgacagtggagagaattacttgtgacagtgatttgagtttccttattcatgtaaaatttttgaatgagatgtgtttatgagttgcatgaatttgctgatgttctacccaagagattctgtttatcctcctaaaattgtaatgattctgtttatcctcctaaaattttctcttctgttctaatactgtgatgttcatttaacaggaatttagaagtttcgagagaggcactgtctacaatgtgtgaacatgtgtatattcagaagtcaatatatgtgaatatttgaatgtctcaaggaaaactctccaaaatttcatattcttcaaaagatcagagttaaagtttatctagaatggtcagaagaacaaaattcaagatcaagattcagatccagattcaaaacaacaagatatttcaaaggaggaatcaaaaggtgcacttacctgttgatttttcctgctcttcacctttttccttctccaaatcgctcaaacttgtgattcctttctgtgtgtactgtaaatttgcttctctatcgtcaattttctcgttaatctccatctttttttcttctgacttcagatctgtctctgtttgattccccctatgttgaatttgctttttgctttttatatccagatcacgtgacactttcttcttgggtgccaagttttctaattaagtaacctggcatgtgtcacgtgtattgtgctcatctatttgggctttttttgttgatttattacattgggcttgaattttagactttttttgtttgggcctccatttaatttggatcgagtcagctgggccaatatctggcccgatctgtgtttttttttattttttttccttctattttgatcaaaaaacgttgttcgttggatctggatcaaatggtcaaaatattcgacagatgggaaacatcaaaatctgtcgcatgatctgtagacactccctttttaatatgttgaaactacagccggtgtgatggcccatagacatgcaaagaagacaatggtggtaagtcctcaaacgtggtggtaagtaaaaaaaagaaaaaaaaatctgacctgaccaagagaaaaccagatatcaatcgtatccgcctgctcctgcatggacacgtaggcacacacagagactcacgcatgcatgtgccacgtcggatcccgccgcaacagagagacccacacggtctcttccatcgctcgccgtgcccgactccatctgcgtctctcgcgccgccgccgccataaaaccctccggcccaacccaaacccaacccaaccaccacccaaaaccccacgccgccacaccaccacaaccaccaccaccgtgcgccgcggccgcgcgcgcgctccggcgagcgagtcgccgacaccaccaccaccgccgccgccaatcacagattaattaattccgatggagtcgtcggagatggcggtgatcgagtacgtggtggcggagctgagggacgaggcggcgggggccggggcgcacgtggcggcgctggcggcgctctgcgacgtgctggcggtcgccgccgaccacctcttcgacgccctccccatcgccgagttcgtcgcccgcctcccgcgcctcctcgcctccggcgagggagacgtgccgctcttcgccgcgcgtgccatcgccgaggtatgcgagggcgtccggccctgggcgaccagcttcgccaggtacggcgccatcgaggcgctccgtgacaagctcctcgccatcgactgcatcgagctcgccgaagaggtaattaatcggtagtagtaatagttatattcatctttctgaattaattatatagctatacttataaaaccctcttatataaaccctagttttattaggttaaagtactgataataatactatggttaatatgtgtctgtttaaataaaatttaaaccatttatatgcattaaaaccctagctatgttaggttaaactgacaatattatggttaatatgcctataaggactacatccagcttgtcgaagaggtaaaatttgtacgtactagtagtaattgtattcatcttttcggaccaccttaattgtaaacctaaaacccctccttaaaacctgaaagccggcctaaaaccctagctatattaggttaaacttgataatacaaccgttaatatgtgattttttttctaccttttaaaaaaattaaatgtatttcaggtgtacgagacaatcttttttaataaaaaattacgacacccactaatacttactgtccttatatttatatttatataccaatgatatagattttacactataatttatccatatttttgtcggtaacataggttttacgtgcacgattaagttaattatacgttcgttcgtgtattgtgtaacataacacgtggtttcatcaagactgcattcttttttttttacaacgacatacattttttaaatctaaatctcctattgttgttccatcaatagtaagattaaattgagtacaattgtaagggtatatccttctcttttatggttggttggtgtggatgtggtgctaaaggagacggttgcttcgttttgtgtgtttatacagtgccttcgcgctctgggcgtcatatccatggagtgccccaaggagtgcctcagccacggcgtgccagccgccgtgctgcagttcttcgacttcttctcgatgcacaagcaggtgaagcctcctcatcctgatcagactatctctcatctcttgtggtttaatccttctttgcgctgctctgccgcctccgtgcttgacatgcttgcgcccacgctcaccacctgtttgtggaaatgcctcgcagaagctggtgctcaagatcgtcgccaacgtcttgggcgacttcagcgcgaaggatgcggccaaggccatggaggccgcgcccgttctgtgcaacctcctgcaatccactgacaagacggtacgcgtgtttaattttatgatggttatattatgagtttgtcttcttcttctctttcttggagagctactgtttctgactgatgggtttgttgaccgttctggatgtttagatactcgactccgccgtttcttgcttggttttggtctctgatggtgcttgcgacagtgcccaacacatggaaaagctttacgagcttaatgcagtccaagcgacgatgaggttgatggagaacgacgggtggaagagcctcagcgatgagactttatctgtatgttgcatgatactgcttcctcagccatcgtttttcttactctaaaattgactcaaaatgaaatattcttgttattccacattaccttataaacctgtagccttaaagatgtaactaattatcaactctttaagtattcgaaatcaggagactctttgattaccacctttataattcgcatgtgttttttcatgtttcatgaaaaggcgtcctttttatttagaagtcatttttacggcaaactatcttagatgtttatggctccctttagaaaatctaaatagtgtaagaagtatcgacaacacaggcacactatttagtaatccgcagcaaagcacatgtggtatgttagctgttaattcattcctatcttagttttagcaattgatcattcatgactgaattgacatgtgtgacagggcatccttggtcttctcaaagacctagcttctctctcagcaagggctgtaaagtctctttttgagttaaacatttgtgatttgctcaagcagatgataacatactacacctcgtcgcacagtgatcacaataaggtacatttttccctgtgtgtcttagcatcagaaattttgttgccatgttttcctatgatgacctaatacttgacacaaaagcagattaaaaattttagtgtaaattgttaaagtggcgtcacatgtttataccttaatgtatattttcaagagttagaaaaattggtagtacttctcatttgttttttttatacaattacaatgaatgtgtgtttatcagagtagagtagatatgtgaatgaactgtacaagtattccattgtacagtagtttttcgtaatatctatttacacaattcaattcaattcaaaactgcaggtgcagacgcttgtagagctcatttattatcttatgccacctcttgaaatgtgtgaccatcgtaccgaactaatcattgcaaagaagaatgtcatcacagaacaaagtggatacatccaacagcttgctagcatccttacttttataatacaggtaagaaaattctctccagtctccttgtaacacaggaagatagttctgcaactatcccttgatataacatatttcttcttgtaacgtaggttgcgaaatctgctgcactatcatcaatttgctacagttgtgttgttgtcatcagaaacattgttgaattaagcacaccttcttccttggtggaggtacagaagacagtaaacctgtcaaggtgaacttttcacacagttgaattttctcccaaaaatattttgaggggccttgaaacacgcttcctttatttaactaaccaacttgaatgatggtactgatatcttgcccttgtatcagcttacttgctggctggttggcccggaagaaccgccatatcatattccaaacgctcaacgtttcgaagacccttctgagaaaagaccagaaattcttctttgagaccttcatcagggagggtctaaagcatgcaattgatgcaatactaacacaggaaaaaggaaagagccgcttgccagaaagttgcctttgttttgatttagacttggagacctcgacagatgatgcatgcaggattaataatggtgctatcctgaaactagcggaggagataaagaaaaacttcttggtaaaggttgccaagtctcctcacaagtttgggtgtgcttttaaaagcataaaggaatttttttctcgtttgaattgtcatgccacggcacccccagctaaagatcaggatctctgcaagcagttgtctgatttttcaaggcaattattatcggatgaactgccaagtacttctacttttgagtttgtgcagagtggatctatcaaacatttggcaggttatctttccaatgggacatactttaattcaaatctcaggaattgccaggacttgataggggagcttaaggaggtgaaaatccggctgcagaagttcacgcacttggctctcagcgtggacaatgaaagctcggtgaagccacttgagattttggtggagaaactgatagatgcgttgcatgtgtggtatgacagtttccctgtaatcctggctgatgaacagtgcacacgtgagagcaccatgattcctctgagggattcaggaactgaggaaccaatgtcactatatataaaattttcgagatcagccagggaggaggagttggaggattatggtggagttctccctgttgatctttcttcgacacctgaatccattgaagaggtcctgttgcctgagatctgtaaaagaactggcaatgaaacttcatacaaggtattacacattacaccggcttgttcatattttctcaaacgtttactgcatgttttcacttttgtattcacacatatcatgaaccatcaagtgtaaattcagttttatttataacgtgttatttctatgattcaggaaaacactcaagaagcaaatgggagcagaaaatctgttgggctcagaaatggtattaaacctttctcctatgccgcttacctctaggatctagtgtacttctttacatgatgttacaaactgcaatgttgtttacttggtcaattatgatatcatgattttaagagaaacaaactaacgaatgttgattccccaggtgacgggcacaagttctcaagattgaaattctcttacaaaggaacacaactccagtcatctacaccactttttgagtcaatcctccgctcaatgcatgaaggagaaaccgatctccagattgacccatctttttgggataaagaacacaagatagtatacagaagaagaaacaaaagcaagaaaatatcttcccatagttcctacaatattcagttgtgccgtgtgcatgaaaaacttgaaatgtcattgcttaaggacccctttttctccaccatactcactggcaagcttcctggtgatctggatgaatctgatccatcatataacttcctgttcatgctgaaagtcctcgaagggctcaaccgtttttcatatcatctatcaatggatgataagttatgcaaatttgctgaaggctgcctccaagagtttgatgaccttaaggtggcaatttgtccaattccacgggatcagttcgtgagcagtctactgacaaataagttagagcagcaaatgcaagatagcttgtttggggatggcttgataccctcgtggtgtatctatttggttgaaacttgcccgttcttgttgtcattcgaagctcgatggaagtatttctgcctgacggcacatcactcattcatgacagatgaggctagcagttcaacagaaactaagaagtacagcgtaacacggagcaaaatccttgaagatgcttcatcgatgttgaacaaacatggatcagacaccaaattcattgaggtggaatttgatggagaggttgggaccggtcgaggcccaaccttcgaattctataccacagttagtcatgaactacagagagtgggtcttggaatgtggagaggagacgacaccagccaagaatgcgaagctggttttgtccatgccccttttggtctctttccacagccatggtcctcagcaaacacttcatctcaagggatcagtttgtccaatgtggtacaaaaattcaagcttcttgggcatcttgtagcaagagcagttttggatggaagggttctggatattcctctctcgaaagcattttacaagatcatgcttgagcaggtaacttttcagcaatcgtccaatgtcaatctcttccctcttctttgatcattcatgtcaccttttctctgatcatgcctgtttttgcttttaggaccttgatatttatgacattccatcatttgatcccaagttgggcaagactgttatggagtttcaagcacttgttaaaaggaagaagttcctggaggaaagggcatccaatccagcagctgatttgtcctataaaaacgtgcgattggaggatttatgtcttgactttacccttcctggaaatccggaatatgaacttgtccctggaggttcagagaagatggtgacacttgacaatttggaggagtatgtgtcttcaattgttgatgcaaccttgaaaagtgggatatccaatcaaatagaagctttcaaggctggaattaacaaggtttgtgaggaaaatattcagtagatctaatgtctttatttttttccaaataaagccaaaaaaatcactcctgatttatttcagcatcctgcaggtttttgctcttaagactcttcggttgttcagtgaggatgagatggagcgtatactatgtggcgaacaagattcttgggctgtatgcatcctttacaattccttttattttatacattcatttctgcaagagagtttcttgttagagtttctaactttcaatacttgcagtcgaacaaacttgaggatcacatcaattttgattatggatatgatgcgaacagtgcatcagtaattagtgtaagtacaacatataagcctatgcctcccacatattttatatcttaacttgtaatgaggaagtcaattggaaaaatcgttttcttttcagttcctggagatcttgcgggagtttggaagagaggaccagcgggcgttcttgcattttacgactggagctcctcagctcccacttggtggcctagcttcgctcgatcctaagctcaccgtagtgcgaaaggtttgcgtttatttttaactc

SEQ ID NO: 25596 - DNA, 29002 bp, Oryza sativa
ttttttgatcattgttcctttccatactttgattcttggagtatcttgcaacacttttcgcataccaaagttaagaaaatccaagtaattgacctattaataagaaaaagcaaaaatataaagttaagtggttacaaaaaagcaaagcaattgaaaaaaagatagagtaataatactaaccacaaggtagttacaggacaaccaccaaaacttttggacttctcaagcttgctaagatgtttcatcaaccattcaaaaacaagattgctccaatccaatttatcaatagaagtaagatccgcaaaagcactgagatattttgtgctaggttgaatggatgagtttgggcaaagaaaacaattcaaagaaaccatcatgaaggatatcaacacttgatcatcagacattgattcgttccttatcagcttatctccaaaaaatttgacagtaggcaaagaagagagaccaaaagtgtcaagaattttctgcttgccaatttcagaattggaactgataggtaaacctccaacaggaagacctaaaactatatgaacagattcttttgaaagtggaattactttgtctcgaacaatgatgtcacaagaattgacatcaactttttgggcaatccataaagcaagtctatatggcacagaacatttctcaaacaacaaaagggttttgaaacaagatttggaaatgatatctctatgacgtttagacaacttttccagaacttcagaaagtacttcacagagaatcttgtcaatttagtttcttctgttgcatcagtcatgacagattttttctgcaaaaaaagaaaattggaaaaataaaaaaaaattgcataaaagaacaatttatggacgggcagtgcacatcttcaatttcttgcctcgatatattacatttaccttgcttttatggcagtagagttttcgtttcataccaatcaaaacattgtctctaaaaatttcaagtaatgctgaatccaactgattttggaaatcaacttctggttgtttcagatctttttctctgcgcaagaatagggaattttttaaaaaaaaaactggaaatgtatttaccaagtgaatacaaaaaatgggaaagctgtaaaaataataattaaaactgaacataacaaaaaaaaagtaaccttcaaattgcagtcaacagatactttctttttattcaacttcagcttcaaagatcgcaatagctcctcttttgatatctcatcacaactagttttagagtcctacaaaaaaatagtgaagattaatcatgtaattagaaaacacaataaaaaacacatataagtctcttgcttcattgtacaaaaaaaaaggaaaaaaaattaagacagaaatactcacttcactatcagaaataacatcatcattttcagaactttgagaataagaagaagtagaatcaacaaaaatttcatcactatcctttgcgtgaaccatctattaaaaaaaagaaatgtgattacacaatgggaatagcaaacaaaagcaggagcaaatattttaaataatgctaaagtaatcaaattacatataacaagaagactgcaaaagtacttggacaaaagtaacctatgtaacataattgttcaaacattaatccacagaaaaaaaaagtccgtatatagaataatgttttcagttactgaaaaagatgaaactatgttattaagtgcattgctggaggatagcaccaaatgcattacatgaaccttatatagctggataaactgtcacactcacacagcccccccccccccaaaaaaaaacactgtaaggactcaacaaacacgggaaatgaaataggtatagtactattggatcaaatattacaaataaaacctaaatagaatagaggaaatacagttagaacagattgaagtaatgaaaaaacttaaattaacttcaaaataaaactactacagattaaatcatttcatttaattatcatttgtctgtcatttcctgaatcatggtacatgcatgaatgtgagcttatagtttatagttaactaataaaaagaggtgcaaccacatatcaacccatcatttcattaagcatgttcagcagagatataatgccagctccacttgagatgacaaaaggttccaatccaaaacagacacacattaaatcatcaatttaagtgacaactgatgtcacggaggaaactgaggatgaactttcatcagtgcacacacagacacttcatccaaggtgaattaaaaattcggtacagctatgtcttatggtgcttccaatgaacacaaatcatataaccacactcacttaggatcacacaaatcattcttagattcaaactacatatctgcaaaactacagatctgagcatccaaacaaaaaaccaaaacaaaagtaaatcagtctagggcattggtaaacagatctacatgagaaatcaaactctattaaatccagttaaaaacaacttcagatcacacatagtgttctacataatttagtacattcattttcagatctacaccacatcaagttcagacaaataactaaccttaactgaatccaccagatcgaagcttcaaatacctaagagaaaattaaacaacatgatctaatcgcacatgaacaacatcacatcgttgatgaaagccaaataacacaatgtccaaagcaaaaaacataagcacacacaaaatactactactcatccaaaaaaacgagatcccaaaaatcccctcctcataaacatgaacaaatcccctcctcatcaaaagcaaaaacaatccactcctcctcaacagcaacaaccacccacctctccccccaatcaacagcaaaaatgccccactcatcaacagaaaaaaatccactcaaaacctcaacagcagcaacaacccttcccaccactccacccacctcccccccccccccaatcaacagcaaaaatcccccacacatcaaacagtaacaatgccccactcatcaacagaaaaaaatccactcaaaacctcaacagcagcaacaacccttcccaccacccacccacctttgtgctcgaattaacagccaagatcccccacacaggagacaggaacggataccccactcatctacagcaaaaaaatcccctcaaaactggttagcagcaaacccaaacgcaaacgagaaaactcatcaacgcatgcagttgagcagattcaggtgatgctccaaagggagaatggaggaataatggacgaatctaccaactaatcaccctcacgtcgagctactcaccaacgaatcgccctcacatcgctccgccagaatcgctgccccggcgaaatggccttctgttgacgacgacgaaatcgtcgtcgctctctgctctcctctcctaaaagcgttctctctctctatgtcggaagaaatgagaaaattcagcaaatgtgggacccacagaagagaaaagaaaaaagcaggcgcggatttcaaaattgaacagttgctatgggacccacgaggaatcaataaaaaggccagcccaatagataaaaaagatcggtagcccaaacagagaagtccatcccacaacccaattattgcacgaatcttaaacatgatggacggcccaaaaaacgaaagatggagcccagcaaaatctatcgacagaagagtagccaatccgtattaaaaatacttaatttgtttttttgttatgatatgcaaaagtatagttttaaattatatgttcgtgaacaagggcggagctagtatatgttagggggatcccagggctatactttatctattttcaccatgtatgcacccccttatgcaaacttagacacccgcatcagcttaaactcgatctaaagtggagtaaattaagcaagtggcaccaccctccattttgctctagcttcacccctgtttgtgaagtgatatatgacatattgatatgtcttcttaatttcttcgtagctatttaaatgacgtgtctctcaactgagtttagttatagcttcaacaaaaagttgaattcccctgatatatttggatatttttagggcatgcacaatttttattttacaagtaggtaatttttttaagataatggaataacaaaaacaagtgggtaacaacatgtgaccattgatccggtggtagtagttgttattgagccccacaatgtataagcctatgacgagaaaaacaaggtaggcccatacacaaaagatacctatgctagcttggagaaaatggacatttggccacgttaaaaaagcggtttcgctggaatgccatccaaaaaggcgtttcgctaaaatgccaatatggagcaggcgatcatagccactttgtcattttcaccattttcaattctatttcgttggaatgcggcttgatgagaccaaattgccccggctcaccgagattttccgccctttcctctaggtcatccgcccaggccccgtcgtcggaggtggtggtggcgaccacatcatcctcgacgcacaggagcatgtcctgatccacgccgtccaacctcctgacgtcatccatgtcctcgacacgcaggagcaggtgctccggcaccacgctgtcatgaggctagacctcctggaggccacattcctctccaggctctgcggcgacgtggccgggagggtgtcggtcctcgtccccgacgtccccaccacgaccagcctcgtgaaggcgctggggagttggtccggtaggcgcgtgcatgctctgccccgtcccggacatcgtcggcctacgagagctgccaatcgtgccgggatttctcgttgggctggaggtggccgagtggatcaccgtgcgcgtgccggcatatatcacgtgttgggcagggccgcgctacgcggaggtgctagtggccgccccggacgccgccgcgcccgacaccgtcgtgtggaaggcctgctcaaggggctagacaccatggggtggagttggtcacggcttccatggtgtctcgacgctctcgcctcgatgaggagctccgccgcaagtaggtcgccgcccatgtcgaggagctcatgggaggaggaggtgacagaggagctggatcttgatcccctttcagctagtgaggggcaatttggtctcatcaagctgcattctagcaaaaatggaattgaaaatggtgaaaatggaggaaattggcaaagtggttgtgatcacgcgctacatattggcattttagcgaaacgcattttcaggatggcattctagcgaaactggtttttgaacatggccaaatgtccattttctcgttagcttgtgactgaactataattcatttttatttaagcaattttacagtccttgagaatgtatcatgagatactactttttctattgtaaatttggttcctctcggtatctagatactatgaggtacaaaattttatacttaatttttggtacctccctcaagtaccataaaattgctctttttatttacttgttgcgtgtagcaagctatgaccgggtaacaactactaccaactttcacagtgtatataaccatatgttgaaaggaagcattcgatgtcttattgcctgtttttctctcacattgtagtgagtaaatttatatatataataaatttatacttcaactatatataataaatttatacttcacagaggcgtgcaagtttcgtgcatagttgcatgccaccagtggggcatttgctctttgtgttaattattggtggatcgccagcaaaaggggaggaaaaaaaaagaagcaaaatcgggtcaacttgaatcatctgttaatactactacgactgtcacgtcaagtcgattcattagaggagattccaaagtccgtacggagaagaagccgtcataaattactccaaaacaatttaatttcgtgcctgttgatacacgttcgcctcatcagttgttttgcttgggtacttccgacttcccatctgttcgtcggtaatagctgtctttatccactggagtactctgatgtgagacgttctacttgtccttaatattagtattagtactactatgaaaaataaacggaactactagctgactttcgacagttttcatgagtgtttagccatcgattccgcgctaagatttgtaatgagatattttattatcgaatctaaaccctcttttcacaagctagtcccatcatcacatgtttatggcagattttttcaaattacatcaaagtcacattctagttatattgtagttacaaaactataattacattacattgtaactatggtgtaactacactataactacattgatatctctatataaagttgcatatattattttaatacatatatacaagttattattattatagtatagttctagtaaaattatatactatagttagatttgaaagttttccctaaaaagcactcgacagtatttttagctaatcccaaaataaaatactctcataatttattcgagtacacgttttgttacgtactccctttgtctctcttcagatttatttatagaaaacatcgtatcctatctgtcgacgtttgatgtcgcaattctgatatttgcatggtatggggatcgtcggtgctaggctatacgcaagactgaggtaaaagagatggagacagggatttttatacaggttcgggcccctaagttgtcaggtaataaccctacatcctattggccgaagccatcctgttggccgaagccggtattgctcttattcatgataatcacaccagtacaatatttgggtagccaatctaactgttgtcgacatggcagtctgacgatctgactcgtagtcgacaacagggtagccttcctcctcgaatccgtgcccggcgagatcagagatagcgctttcgtttctcctgacagtatccggagacaccgcaaggtattagccgtgcttatccttgaagtcgatatccggcggcgtgtcttggcgtatgtaggcttctatgttgattgtattgggtgttgatcctgtcgtgtgttgatcccgttgggtgttgattgtcttttcccatggtcgttccccctctcctctccaggggccctgtatttatactcataggtgtcctcttgtccaagtagaactagggaaaccaatatggatacaatctgagtagtccttgtcgttttcatgtagaactctggttgtctttccttatccagaactccctcgaggtcagtttccatataagacatggtatgtagtggatcctgccgagatttagtcaattactattaggtatgtggtatccataaccctgacattatcatattttggttttttataggacggagtgagagaagtaattatcaatttactactataaaaaacaaagtaaaaaaagttaaaaaccaccctttcagaaaccataaaagggacattttcacaagaaaatcaattcataaaaaaatcagtgtctctagaaaaaaaccaactagaagataaaataaataaagttgaacgtataaaatcatgtatatgctactggcacatgtatatgctaatatcactaaaatacagtacaccaacccatagaaattgtcccttctcaaaaaaaaccatagaaattgtgattagcaaaataatatagctagttgtacaccctaaactcataaagaaacgatagtccaataatctacgtttccaaagcccgacaggttgcatactttgcataacattgacatgtttgtccacatctcgtgtcacgctccagaccaaacaataaaatacttaaaaataatataaaaaaatagttctcactttatctcaaaataagcttagccattagtttccgtgtacaactttaattgtctgtcttatttttttaaaagaaaatatgagtcattattttatatcattaataactattaatgttttgtcattaataatagtaaaattactaatcataaagaatatgatttatgatgaacaatgtgaaactgcaggagtgagggagtaagaaagaaaaaacagtgaggatcacatcacagagcttcataattagcctcctaatccaccccaatcccccgccacgtgtccttcctccctctctcactctctctctctctctctccattaacgaggcagagccagtccgaatcggagctcgagtcgagatggggcagcagcagcagcaggagaacctcaccctcctccccatgtcctcctcctccgccgccgccgccgccgacgccgcggctgcgtcttcaccggcggcgtcggctgggaggctgttcacggcggggctggtggcgtcgtggtacgcgtccaacatcggggtgctcctcctcaacaagttcctcctctccacctacgggttccgctacccggtcttcctcaccgcctgccacatgtccgcctgcgccctcctctcctacgccgccgccgccgcgtccgccgccgcgccgcgggctgcgcggccgcgccgctccagggggcagctcgccagggtggcgctgctcggggcggtgttctgcgcctccgtggtcgccgggaacgtctcgctccggtacctccccgtgtcgttcaaccaggccgtcggcgccaccacgcccttcttcaccgccgtcctcgcctacgccgtcgcggcccgccgggaggcgtgcgccacctacgccgccctcatccccgtcgtcgccggcgtcgtcatcgccaccggggtaaggcggccgcgattcctcactggatctgccttgattgctctcccaacctgcaatgcttgaacagagacgatccaattcttgaacaatctcaacaatttcagggtgagccaagcttccatctgtttggtttcatcatgtgcatcggcgcaaccgccgcgagggcgctcaagactgtcctgcaggggatcttgctgtcatcggaggagtaataattcatcacatcgcaatcctttatgaattattgtgctacccacattttggtctaactaatttggtcagctaattttattccctttccacctaatttgatatgcagggagaagctcaatcccatggagcttcttggttacatggctccggtggccgtcgttctgctgattccagcaacgtttatcatggagcgcaatgtgctcactatggtgactgcgcttgcgcgggaggatccgagttttatctggatactgctttgcaattcctcgttagcctactttgtgaacctcacaaacttcctagtcaccaagcacactagcccactcactctccaagtaatccaaccttccctcctacctgcactgttagcatgatgctttgatgatcttcaatcttcctaacattcaggcacatgtcgatatgtttgcagctaacaatgttcaacgcgttgcttgattcttaccaggttcttggaaatgcgaaaggggctgttgctgttgtggtttccatcctgatattcagaaacccggtaaccttcatggggatgctaggctacgggataacagtcgcaggcgttgttctttacggggaggccaagaagaggagcaagtgagatgagcccaattaaaaaaagagtcacttgacctcatcagtttggtagctcctgcactccagggacataaaatgctgctgataacattatgcatatgcacctcttacactgccaacctgatgtgttctgatttaatcattgatgggatgatgaagatgacaatttgcaatctttttctacatgctccagaagtccagatgcgcaatctgggatcctaaagtgtaggcattggtgatcgtgctagctcatcacacactgttagatcagatgtattgatgctttgtagtaacaatgatgtgtactgtaatcagtgagatgcaaaaaatcattgtaagtttgtgcttgcatgacaatttcagtgttatgttaactactttcagatactacaatctagagttatatgaacaagaacaattcaaccaacaatttgtagggaaagagatgaacaaatgtgactgatatacgattacttgcaaacctgtagttgacatagcagtgtcaactctcttaagtgttctgcaatctgattacaaccgagagcgaaatccttatcatggcatgcgatgtacagaaaaaggattttacactcaagacataagagttaaaacaacacatgccagagaaagaacttcagctgcaattgccttccaataataaggatgtatcagaaacaaccagcataccatacgactaaatccctctacaagatcaagaggccaggtcggtggcgtccccaagagaaatggtggacaatctctggcaaatcagatcaactgctaacgaaccagcgccatcatttggctggatgttctgatgcagagccggaatgttctcctttgctgtgtctgctgctgctgctgctgctgctgctaccactgggcagggctggggtgtgcacacttcatgttccatcgcctgggaaggctcaagttctatctgtacaacttcaagggggagtaaaggtgatgccttgctctggacactgctttttttctcatgaggtgaggctgcgagtctcgattccggctgactcaagatagacgatgctgggtcccccatttgagcagaagatagctgaggtgaacactggatcttcatgggctgcacttgcatatgtgcaccaatctgttggtcgatggacttctggagacaaacgcatacgacacagattataatttgtaatgccatcaattaagaatactttcatgatcacaatgaagaaaatactaaatggaccagacaaaagaaaacactaaatttacttacagcatcaaagtaaccaattttgggtgtaggcatacgcagaccagatggtttggaaccttttccctgggtgtctgcatctgctcttgttggagcgtggtcattgctatttctgagggaaggggataatgaagaagaccgtgtactgaagctctcagatgtatggctcatcttccctacagtggaagctgttgaagccccagaaaccacagaactcaagctgtccacagaactgctaggcgaaatgcttggagatacacgattacttttgcccccagttggaatattatttctcgatgctcttgctgggttagctttgttgacatcagtccttgacgttgaacgaacaggaatcctttgagcaattctgctcttgttgcttagggttgatgatttaggtttttgacctagcatattaccaattgaagctgctgttgctgctgctgatgatgataatgatgatggtaaggcacctgattttgaagttgaagtagattttgtcactccaccaggcctagaatgtgcgctaactgaattgttgacagatttaccaactgtctgcctgttgaccacacctcctacaagagaatacatgttagtcttgccacctataaacattatagcagatagaatctatattgttgacgcaccagtgctgctccttttgtctggaattccagaagccacagctgtattagttggcgctctcattgtagcaactcttggtagagccctcggaggtttcaaagatggttttacttctgtagatcctgaaataggcttctcaagcagagagttgaaatgaaattaattccagaatattgcataactaagataaggaaatggggaagctagtgaagctacatctcgcaaactgaaacatcacaaattgtatatccatcgctcagatttcaataaataatagtaagaacttagacacttagaaaacgattcagcagaccatgttgttctaacaagcagcattttcattgttaagataagaataccacataatttcctattcatttaaactagcacattctagttctttgtgatctgtttgtgtctgcctttggcttaaccatcatacaatagattcaaggcaaattttgctacaggacaatcaaaatatgtgtaatttactgatagacatcgcaaaaacgtgtcacggctgaaagacaccctaaaaaattggtaatttggtagaggacactttcgactcaattggagagatgaattcttaagaagggcgagaatgcccctagtaccaagcttgagctcaaaagcttttgaccctaggggcattctcgtctttttgaagaatttatctttacaattgagccgaaagtgtcctccagcaaattttttgtgatgtctttcagccgtgagtctaccagcaagttacacaaattttaagtgtcctgtagcaaattttgcctagattcaaaccattgagaaggattcatagccccttaacttttaaatgttaagggactatgaagaatgtaaacaactaaactacaacacatttaatgtaatgtatctgctagcatggaccataccactcttgcagttgtaggctctttcaaggtagcttggatcctttgttttcctccagcagcaccctggcttgtggaaataggggcccttatctgaacaagcatcgaaaaattttggtcagtgatggacaaggactataattttagatcaaaccatatatgaattgtgctatataccttactctgaggcatcagatcaacccccttccttgctggaagtagcaaaaagaataactacatcagttacaaacatgaaaccaacagataataaaactcagaagaagcttcttacctgcaacacgaggaacatttgccttggacttcgggggttttgagataacagcagtaacacctggggcttttccaggattgccgtgcgatctctggatcgaagcacggacgttgtcaaacagctcagtctccagattttccatcacccagctttcgctttcaagagtcgaagttgttgactcccctgacctcctcatttcctcagcgattccaggcaacctggaaccctgtgccttgcggaatgtgctgtttacaacagccaattcctcagtatccagaacacctgctcaaaccagaaaacattaggaactgatacatatctacattacgatatttgcctactgtaataaggaatgggaacacatcagacaggcagggaaaaaaaacagaaagggaaatgttaggacttcagagctgctatcaaactgcctcaaaacaagtgaatgctcaaagactgaaaggaattggtagctttgcaacggaaaatggatgacaggctgacaaaccaaggactagatcaacagcagtacgagagcattttaaaaaattcactgtccaaaacattgggaactaggagtggttcttctataatgatgcagcgtgtgaccgaatattgctgttagtgcttgtgaagaaacacagattacaggcatgccatctggtgctgggcctgtaaactgcagcctggtgctgtttttccctctaagattctgtaacccttctgtttccatcatcacgacagtgaggaatgggagagatccctaaatcgaaatgtacatcaaaagatgcaggagtctactataagtctacaacaagaaacaaatactactgaacaccagcaatttcattcatgggtggggaatttggttagtgcacaaccttcgctggtgaagaaggcgctgtcccaagccaagctcttgcggagattaacgccggccttcgctttcctccgcttcggagactccgactgctcaggggcctcctccgtagcgccatccggatccacaacccgcctcatctccggagaatcgccggcgggatccaggcgagaagcctcggcggccatcacctcatcacaccctaaaacgaaaatcgcagcacgaaaccgtcagatccccagatcgaagcaaccccacagcaccaatcaaccccgagacaccacgattccaccccccaaaaatctcgatcgaaaacgaagcgcaagagacagcaacgggcgtgcgttcgttcgttcgttcgttctcacctgcgtggggcggatcgggatgcagcggcgggggcgaggtgaggtcgagcaggaggtcgtcctccgcggccacgtcgatgagcgagagcgcctccatgagagggagggaggggaggccgtccggccgggcgcgggagacagcgacggcggcggcggaggcgggggtccaaaccctagatcgccgcggggtgggggagaggcggcggcggcgagctggggagagagacgttggcggtgagaggttttttttctgggaataataagggaaagtttgggaattgggagacgcgtgcggcagtttcggggagaggctgacgggtagggcccacgcgtgggtttaggctcgagccgtgttgattactgcgtcctcgtttgagtcaagggcggtgattgtttacatgggcgggatggtttgaattttgggaggtctttctttcttctttttttttttttgccttttgggggttgtcgcgggcttgcagctgcctgttgggttgttgttgggcctttttcttgggctggttcatgggcttgctttggagttcttcaaaacctcttgttacgtactactccctccgtcactaaatatttaacgtcgttgactttttaaaatatgtttgattgtccgtattatttaaataacttttgtaaaatatgtaaaactatatgtatacataaaagtatatttaacaatgaacgaaatgatagcaaaataattaataattacttttttttaataagacgaacggtcaaacatatttaaaaaagttaacggtgttaaatatttagggatggggaatccgatgttctgagctcgacggcatctcactaagctaagcaagggaagggaggcagatggagtaccatgccagggaaagaaaggaggtggtcccaagtttgtcaatgtctttgttgagggatgaggaagataggtgtaggacaattgggggactcgtcgggcctgtgtaatggttgggaggatgtatggtggagtggtgatacaccggatgcgagatgcgttatatgttatattagatgatatccagcgcgttgatgcgggatattatgtattggcatgggtttaaaacatccatgaatagattctaaattgaaggattttagctgcacaaatgtctagagcaggatgaatccaggtgacaactaaagaacagtctttatctcttgtgtgactgatggtttacataataaggggtgggcatattgattaactaaactgacagtacctatcatatgagaaaatggaaatgaatagttgaaaatttttatacaatataggtgacttattcttaagtctcctcaatacataataaggaagataaggaaattcaaaaaaaaaattgagatcataatatcatagtttaaattatgaactcaattaacatttataaagaaaaaccaaaaggagggacctgcgcggcagtatatacctttcacttacatcattgatcattgtgctgcatatgatgaaaattatctccaatcacaaaaatcctgtgacctgtgtgatatcacctgctgcctgtgagatgatatttttaattgtaaagtttcacctcaaataattgtccgtagttgcatataaaataattacttcaccaacctgttcagctcactgaaagaaaattaggaattatatgcagggacgattcatcagtaagtaagtttacttagtgttttgtacataatactaaaaccaatataaaatataaggtttatggacagttgcaaggtaacataaaatgattttaaaattgagcataacagaaaatgtattgtttgcaatcaaatttagtgatgtgtacaccataagaagaaatttgcgccaatttatttattattcaacattgtagggtacttaaatccagaaataaacctgcaatcaaatatgtgcaaaaattgaagtagggagtaagtaaaatgcaggcacaaatactgttgtacgaaagaaaagagggcaagtttggatattaattgaaatttgtcaagaacataatagctgaagtggtgagaaacgatgtgcatcaatcaatgttgattagaaagagatatttacctgaaatgctggattagggatgacctgggaaaaatagggatcagcaattcaacatgaaaggggaacaacctcatccctagcagatggatccatgaacctgtgtaatcagagcgggcagcaacacaacaaacagcaacatgtctgtgacatatggagaagacacgaagagatgcaacaaaccaaataatgcaggtcattagaagagggatagacagaaactgggaaccgcccataacttcccttgaactggtacgggtggtatggctcgtttccgtcgcttggcctactgccggcgatccccttctgctgatgcactgatgctggcggtggctcgctcatgttgctacgggtggaggcttttgatctgatgcacatcgcgaccgagtgggtttagggtatttattgaatcattggatcagtgcacgccatgaccagagctgagggggttgaggcgtttggtgacctcgtcgcttgtgtgggggaggagaagcggcgccgcggctggcggacccactgctggtgcgcgcggtggatgggggaggagaagcattcgcggtgcggggaggagaaacgaccgcagcttccagatcagtctcgcggggagttgagccgtcttccagatcaggcgacgctcgttcatctggcgcgataactctcccaccaccgagcgctgtccctaccacaagcgcgcgatggaaagggcgacacagcagacgccgccgcccctctgagccggggaaccccaccgatccaaataaaccctaaaagtcatcctgcgatttaggtgggccttaccctggttgggctctgtttcatttgagtatgccgcatttctatccaacggctgagaaacaatctaatgtattaatccaacgattcacaactgatgatgacgtggcttaaccacaacgtagctttgggtcttaactatatagaaagaagggatgagatatcacaatgtctggcatgatcgcatgatacaatatgataacttgtagtgatgacaaatgttattattacctttgtgctataaaatttatagcgtggtcttggctctggaaggataggtgtcaaaatcataatttacacttattaaatgggacgtcggttatttttttatgtctatgttatgcccaaattattatggtactgacaacatctttttatcatggtaattttggcaatttgtttgatgtcaagtttttagaaacgatatagtctttatgtcctttttgccaaattctgtacaatgtcaatttgttaatcgcaaactaaatgttatttattttgatataactagtttaggcatcgaaccagacaaggttttatattaaaccgttgcgcctaactcaacaaactacaaaaatgctatttattttgatataaatagttcaggcatcgaaccaaataaggctttatattaaaccggtgcacctaattcaataaactaccaaaacaataccacatagcatggaaacaaaataaaacaagatattcgaattcgtccccctaaaatcatctcctatccaatccccatatctctcccacccatcggtgatcaccatggtgaatatactggtctctgagatgcagctacccccaactcgcccacctcctcgctgtacgttgcctcactgccacaatgtcagccccatcgcttgaaaacccctcctcttgctccaacacaaactgtcgccacctgtaaaccccgctctacctaggatgtgctatcgctgatgaaggtggagctcatgggcgtcctcgaccttgagaaataaggatgaagaaggaataagaggaagtcaatgtttcgagcttgatggcgtctcaccgaagcagaggaaggggcggtagatggagtagcatattaggggaaggaaggaatgaggcgatgccaacaaaagaaggacggaggtgattccaactctgttggagtctaaaggaggaggaagacaattttaccataatttgggtggaggggtgttggccctatgtaatggatgggaggaggtattgggagtggtggtacaccgaatgcgtcatgcgtcacagagtatgaggcaatacaatttcgtcggattttcatgcttggcatgattcataaagtgctccatggtgacgacaaatcttatagcttttgtgctataaaatttatggtgtcgtttggatttaggaacgatcaatgttaaaatcataatttactcctattaaataggggtggttatgtttattaccatgtctagccctaccaaatttatggtagtggcaacattacggtatcgtcaaaactttggcgagttgtttgatgtaaaaaaacactcgagtttttattgtctctttcgtacaaactttaacaatgccaatttattttggtactataactgatttgggcatcaaaccaaaccagaccgtactaaatcgttgcccctatataaaaaggaaaaattagaaccatgccattataattttacaaaatttaagatatgtcatcctgatccacatgtcattgactcacgtgggtactacatgtcattgactaaaaacatataaaaactaccgaaacaattccaaagagcgcggaaacaaaagatattcgaaatccatcccccccccaacaaaacccgtctcccatccaatcccccgatctctctctccccccacacaacccatcggcggtgatcgccatggcgaacaagctggtctcggagatgcggctacctccccacctcgcccacatcctcgccgcgcgccgcctcaccaccgccaaggtcagcccccgccgccgccctccaaaacccctccccctgctccaacaccaaccgccgccgctaaaccccattctacccaggacgtgctgtcgctgccggaggtggagctcatgggcgtcctcgacgccggcatccacaccgcccgcgccgccgtcgcccacgtcagcgagatcgcctgccctccgtaccaaacggtaccctccccccccccccacttcgccgtcccccggtttcgaggggtttggattcgattcgagttactctcgtttggttgatccgtgtatgattgggacagtgcatttgcgtttatgatcggggtttgttactgtgcttgttgatctgcaggcgcttgcgctcctcgaggccttcagggcaagaggagatgggcggctggccaccacgctccgcggattggatgaggcattgcatggaggaatccccgcagggaagctcactgaggtcgttgggccctcggggattggcaagacccaggtgagcagctcagcattatgcaatgatgctttgtgggatttgtgtgtctgtgatggatacgaaccaattattgtgtctgcttgacttctgggatcgcttggtgtcgatagggaaccaaaagcaaatggatcttgtgaatggatgtaacagggtgctgcggcattacgatttatggcattgctgtgtgctggttactgcattcttatttcattgatcaaagataggaactgagcctagcacttgaatcccctttgacattattcgtgtgctatcttatcgattaaagaaacccttgttactactcctaagtattatcctcttttattattccagccagcagcggtcatggtcgaacctatttattcggggctggttggttagtggaaaatttccattttcataataatgcatgcttttgttgattctgtctagtgcaaaggcattcactgagccaattaatggatcttcaaatggcacttgtttaatagtcttctccgtgtagagaatatcaagtgcttctcttatactccctccatccaaaagtcttgagcatatttcattttttggttttcccaaatgagacggtcatatttgtagtctccatatgctaaattaaattgttgatcggaacccaagtaaccattttaatactcattggttgcatgcatgtaaataattccctggttttggtacatggggaatgagttaatttctccttggtcttggtgacaaaagaaatatgccttagacttttggatggagagagtattacattgagtaatttattatacattcagtaaaattttataaagagtcacaaactttgcagttctgtctgaagcttgctttgctagcaacattaccagaatgctatggaggcttaaatggtcgagttttgtatattgatactgaatccaaattctcttcacggaggtaactgaagtttctgcttactattacgttctcccaagcacaccaattgagaactatctgtaaaatgtttgcatgatgtatctaggatgatcgagattggtgagaaaagctttcctcaaatatttcgtcaagaaggcttggcccaaaaggttcttatgcttcaccttgtacatatacatcgacactttgaaaattcactgcggtgttgtacttttgttctcatagtattggacttcatgggctgttatcttgtattttttgtacagatggctgggaggatcctagtcctgcgcccaacatcattatctgaatttaccaagaggtacatacatatttgtaagagagaattccttatatgccaattgacagggaattactcaatcagcataggaagttgacagggaattactgtgcctctaggagggctatttgagggttgaagggtcaatttacaaatctttagacttccggtagcacattttcaaaatacctttattctacccaacaatgtggttgctagtcaatgattagaactattccccattgcttccatgtgcaaaaattcagcagaatatgcatgaaacactcccttcctttttgtttctttccaatctttctacagtttggaacagatgaaggtgactcttcttcagcatgatgtgaagctacttgttgttgatagcatggctgctcttatgtcatcgtaagaaatgcatgatagtacatattgttttgtctttcatactgccttactttcaaacaatgatagtcatcatgatgagtaataatcacgttctaagcatattcttgttttacttatttagaaagttattttgattaataaatatcataatgtgaattttggattgtcagatccttaatatgtggctacatgtatgataaatgttactcccatatttattttttagcagatttgaaaaattaaacttctaagatattctgaaatgtatggattttagtgggcctttaaatacatctatacaatgagctatgagaggtaaactttaatgtattgcagtattttctatataatgtgtataagtttcagatatataaaggatggtttccattatataaaatattggttcttcaacttgctaagataatttctatgaaactttgcaccttaaataatattgaggctgaatcctgaaaagggataacttgttgggggaggtggaatcccaagtgtggtagcagtgggtgcacgatgttatgtgttggtttcaattagcaacaccattgttttaaatatcttgctgtacccttgcactggtagctctatagagggctttggcctaatacagttactatgatgtgtagtctgtaacgatgtctagcacaaataggttccatgtttccatacgaactaattacatgtgggatttgtctactgttaatactgtccattacttatgttatgagaattatgaagatctcatctttatctttttctttaagaataaactatctaatattttgaatccctgtttcatcttatttgcttatgtgacagtgagattgagaaaagcgcaacaggtctcagacaacaccctctaagatgggccctttcatttcttaagttagtgacctagaccctagtatttcatagcattctactattatttcataatattgaactacattggtttagtttacatttggctaccttcctttttttttttctcaacatgcagatctatagcagagttctcacagattcctgttgttgttacaaaccaagtacgcagccaaagtaatgatgatggctatcgttattcatttgaaggtttgggcatccaagaaaacaaattatcttttggacactttgttgagattgagtaacatttctattactctattgcagttgagaagaaatacgatagtaataatgctgaaggctttgaatctcatcttgttgctgctctaggaatccagtgggctcatgctgtaactatacgtctagtctttgaggctcactcaggtctgtctaattatttttatatttcacaatgaaacagacacctataaatattattaacgccattttcacccaccatctgatatgctgcatgacaatgcaataggaaagtctcaactacatttgatttcaatttcatctatgtacacgcattatttatctccttacacctttattttattatcgtataccacttttgatatacactttaagtggcataattaaacttgaggaaccacaacaatgtttattgtcttttgaacttgctctgtgtaagacctgtacgtaaggatttggtatagctttctgcattgaatgcagtggtatagcatcagtattactagttctttcattatatgtttaacaaatcaaatatctgttttatatttacctgccgtggtagttttgtatgagttatacaagctgcacttgtataggtcacaggtacatcaaggtagctaaatcccctatgactccagcggtagcttttccctttactgtggagtcatcaggaataatattacttagtgatgagggcattgatgtgccatctcctgaaataacctcaatccgttgtcaaggtatgaatatgaattgcaatttgtattttatattatttgcgcataaagagtttatgcctgcaatgttccttttgttaatcctaacaatgaacttgtttcaggagaaaatgtcctggctcaatgaccatttgaatgctaccacatctacagttaaggaaaaccaatttaatctcagcgcactctgcatcaacttcagaagttatgttgcataccatgtatatttatttagagagtagcttaaattgtaagtaatctaggaaagagtgtaatagcataatctttaatttttgctactgaattgcattccgactgtaatagacagttaccaatccatctttacgtaattattatggttaacatcattaacttcactggttatgtggctctttatttgcaatgagctgtattacaatgatttacaagcttgatccatattgatggatatgtcaaataaggtcattgtgggtaatatagtttctttgttgctgcattagtgggagggttccgccggcgctgtatacttttattatgtatataaaccacactttattcgacttttgttcttttatggctcccttgtaatttttttaagtgaagacttctataacaaatttatcaattatcttctggattctgcaggttgcaatataagaactgaagatatttcttcagtccccagggatggcacaaatggctgatgatcaagctcatgcaggtaaaaaatggttaactatgaacaaaaattacttgcaacaggcaaatacttttctaacaaaatatggtaatttcccaacaaaaccgttaaactaaaaaatgctttggaaacagataatatttttggtatgagaaggttgtttatgcaaattcatatgggcattacaagataagttaaaactaagcctttttctggattaatattagtaatgttagggtaataggtattatagatagctctgacccaattggcccatctatggcccagcccatatgctgtgtattgctgttctcccttattacaatgaaactcagatattctgattgcgtctcaaacttcacaggtaaaataccatttctttttgcaagaaggtaaaataccattttgttgtcagtagctgaagaaaaatggcaaaaataccattatgttgatcatcagttaattggcacaattctgatattggagttacatactacagcctaaatatctacaagtcacctcctgaaatggctgaaatttgcaggattccatccttgatgacatctgataatgtggtgtcgaattgaggtacaggaaattattccttgaatttacgtgttaccttgtttatttacataaaaagtaaatttgtttctgtttctgcgtttccatatgcttgactctgctgtctgatgatcgcttactaggcaacgtacacagtattataaaatccttgatttggacatttaatattttttgcggaaccttgaattattagttagtgggaaaaaagggtctgacccgtttagtctggagttgtggactttctaagaacggataccaatcttccacgtcttgctataccattttatatacctacattacctcgtatggtgcgtgtgccagatcaggtcctctttccacctccacccacagaataaaagaagccacagcccacagttgctaccttgtgggttctcctttccctctttaaaatcctcaactatgactaaaccatggcttgtttaatcctcctgagggcgttgtttatcaaatctaggagttgagctgctcatccatttgccccccctgggcagagttgtccccctaatcactccatcctagagaaataaaaccatttatcttgaaaatttctatcctcatcatgctgctattatatgcatagcatatactgaagaattagtgtatactaagcaacggtttttgcttttgtgagcttaaagaaacggaaccaggttctaggggaacctactgtttcgttcagaaaaaaggggagccaactgaggtgaagcaaccggactgtcttgttggtagacatgaagaatcactttactgggtcttgattgctgggcaattaaactaaaagtctaatgcttccttttgtgcgattttgatgggttgcatcttggatcgctagtaagactagtttactgagcagtttgtttatcatggttggcctaaaggggcatgcatctagaagcatcaaatttgggcatgaaatgattactaataggccatctaaagcactaacagaaataatatgcacctgccagaatatcggatgacctgacaacttatttgccaaatgcacccaaaaagcagaaagtattcaacatatatgctggtggatttcctcatttggtgattcggtatttgaataattgctatggctgctgccatttgaggacattgactttaattgtgcatcggaacataattatttaagaatataagaatgcatgaagactggattctgtccagggacagctttgctccccaggatgcgggttcttctaatggtgctttgtctaatagtagtacaaagcacctggcctggctgtagagttcggtatttgaacatgtcctcatgagtcatgtctcatcatgcagtatttttccctctataactcgcctttagtttagcacttttttcaattaactggccgtggacccccttctccacttctgttaagttgttcactgctgactcagctaaattaagttgcctttcggttggcacaacgggattggttcccgtctcagacataaacatggtgaggcctagtacaaaagaataaagagagaaagtgttactaagtttctaacctaggagtcaaacatgggtgtccagtagtttggctgtcttgcattggccattagttgcctggtccaaggtttggaaggtggcatgagagcctaagctagcaacgtttgttcgagagcgagatgccaaccaattagattgggttgttgcataggagctaggaccatgcatagagttactcctttttccataagagtaggtgttacaagtacacctccctgattcatcagttgcatcccccagctgcttcccttaccttatccgagcggtccctttgaaagctctgaacagagaagtatttgtgtgactggggaccgccatcctaaagcaaccgcactgcaagttgcaacccagtaacctgattgcctaagaaattgcccatatgatgcacaaaaaaaagttggccaaagtttaagttatcttctttaactaccagagtctgtattcatgctacacctactgtttttggcaattgcctgggtatacagatagatacttgtaatttatagccgctgccacttctttttcacacttttatatattctgttacatggcagtagtctttataattccttgctgaactgattttatccctgaactctttgacacaagacacctaaattgaacaactaatcgttttatagtggacatacacgacagagtgacccaacaaaccaaccatagcatcgatagaataaaactatgatatttttcatattggctgagcaagaacaaatcattttgacatttctttattgtatagtgtagtcagctagggacgatatctgatatatatttattgtgggaggccatttataaagtgtttctttcccattgatctgatgggcttccaatctagtctgataggggccggtggatgaaaagagggggcatcctagtggtggtccttttctctttgcatcacactgtgtcggcactaccattcttggttaccagtaattggatctactcctgttggcgtccaaaaagagtgatgctcataggaaaccattgataaaacatatttcagatgttccagacggtcttgtctctagttctggagtagttcatgcgctatatgttatatgttcagtgtgttttggatacgttgccttctgtccggacgatactaatcgtttacacctctactttctttacatggactttctgattctggttacttcagatgtgagctaggtagattggatagagcacacctttttatctgggtttataaagaacactttgaactttcattagcgatagattcctagagtttcttcgtatatggttgtgtgacgtgtcctttcaccaggacgtacgtctaaggataaaaaccaggtctcatgtatgtctaccctgtctatatagccatcatgtcttctccactagagctcgtgtagtccaacccacccgtgtaaaccacgtagttgaaagctacagtttctcaatgaactttttgcattttttttttcaattgcatgatgatgctagctagaccgccgcaatctatgaccttaagctccattttgaacttagaaaagactcatgttccaacttgcaactcgtgcaagtacaatgttctcttggcttttacaatactactattcaaggtttttagttgacggcagttgttatgtgccgtaaactgaacagtggtcaaattaccgtccttgctaggaacagtgaatcctagagctttcttcttgactcttcccggaattcgagcaacttgtattgatgttctttcaattttgttcctgcataacgtttgaaaacaggtctagaatcgtagcatctccttgcatgattagccaagtcagataatgacgacccttttggacttgttgatcctaaagggatactgttatactcgaggaaaattagctactggcggtgggcccctggatagatgcagtcagtgctgtctcctggcaatcgttaagagccaggccaggtcaaagttttcctcttatcgacttataactcagagtcagagacgaggaaataaatggtgcacaggaatgcaacctcctaggtttttcaataataaaaaaagagagtaagcagtgtaatggtagtagtaccaccaacacacaacttgctctcaatagtagcaagtcaagtggaggaaccttggatccaggccgtttgcttttctatattgcccatgaggctataatttgataatatttttccttttaaaaaaggaaacttgatatttgtctcatgttgccaaccctatgattatattgtactccctcattccctaaatgtttgacactgttgacttttttaaacatgtttgaccgttcgttttattaaaaaacttttgtgatatgtgcaaaactatatgtatacataaaagtatatttaacaataaatcaaatgatagaaaaagaattaacaattacttaaatttttttaataagacgaatggtcaaacatttttaaaaaagtcaacggcgtcaaacattttgggatggaggtagtattgtgcaaatgtggctttggctagcaagctgggtatcttatacttaacaatatttttctgtgtgttggcaacttgtagtcttgtactaacatatatatatatatatatatatatatatatatatatatttgttgatgtccaacttgcaggcaaaaaattatcctcgatttcctagaagattggcgtgtattgcaatccttgtaccatcagagatgctaacccaccacctcacccctagttgtgcaaggaggcccaacagccaatttgaccacggtatttgccagtactgctgcagcaacgtaagacccattcttgctattttaaataccaatgctttgcaaaatatataccaactaaacaacagtattctgcaacctttatgtgcacatgtgatatgtttaatgtatatatagatcccttgcgttagttagatggtatttgttgctttataatactacaaactcaggcctcgcaaatagaaagtccggtatgtgggagagagaagttacatatatataatatactatatatactaatcaataatggatgcgacgaagactatttatctgcaagattcttggtgcctttgaggccactactactaggtgactgccaatagtaacatgttagttgagagggacttaagattccagcgtgagctacacctgtttatcttcaatagagggcatgtttagttgttgaaataaaaaattttggatttcacatcggacgtttgaccggatgtcagaaggggtttttggacacgaataaaaaaactaatttcacaactcgcctgtaaaccgtgagatgaatcttttgagcctaattaattcatcattagcacatgtggtttactgtagcacttatggctaattatggtctaataagactcaaaagattcgtctcgcgatttacatgcaaactgggtaattagtttttcttttt

SEQ ID NO: 25597 - DNA, 14590 bp, Oryza sativa
cattttcgtatttttttccatgttttgtttttacatgtgcttcttaaaatcccgcgtttcgttggtactgcattccttttcaattcagtttgttaactggaattccttttcttttagtagaaccaattgttgtgggatttaataaacaacgagaggtgctgaagcgatactagcatgtgaagatataaaaagattttgtgctgctttcttttttccaattcagtttgtttactggaatttcccctttcttttagacaccaattattgtgagatttaaacaagaggagaggtggtgaaacgatactaagccattgtttagttccaaactttttatttaaacctttaactttttcatcacatcaaaacttttttttttacacataaacttctaacttttccgtcacatcgttttaattttaacaaaacttccaattttggtgtgaactgcccctgtttagttccaaagttttttttccaaacttccaattttccatcacattaaacctttcatacacacacaactttactatcacatcgtaccaattttaattaaacttttaaactttagtctaaactaaacacagccctaaacacaccctaggaagataattgaccctgagcacacgaagcgtgtggacgaggaaggtcctcacgtttcggatcgggacgaggcactcactcacacatatccttactcatactagttgtccgtgactgggacgggtgtatacattaaaaaaaaccccaagtacgggtgggccccacggctgcggccccctcttcactcctattgggcccaaggtccccgaaagcgaaacggaccatttccagtaccccccggtgtggttcaccggcggtagccggtcgccgcccacctccaccctttcccaacacggaagggaggctccgatgagggcctcatacgaggtcatgtaaacgggtaggtttaaggtttaccacatctggcaagcctagctagctagctagtcttcccaattccttttgttttcccttttttataattttatttacttttaccatgctgttcaaggtggttttcttggagtcccattggatcctttgctactattgtatgtttctttttccttggtgggccccacatggcaggatggttttttatctttgcctgcagctgctgttgtgtcctgtgtgacctgtggtcgtttttggagctgtgtatttgtatggttcctgtcagcttgcttctgctatcttcttctatcgcctttttccgtcgttgagagattcatgcctatcctccttggcctcctgtagctgccatccacacgatctctcaaaatgccatgcgcactatatgctgtgccgagttttatatttgttctgtgtctacgtcaacctcgaccacattagctatagcagcgagtagtttgaaagaaaatgtgaatctggagacggtattctgtctgcaccacacgaattttattttctgttttcttttttccttttcttttgttcattggggaaaaaaatatcctgtgaattgaattgaattgaagctgttgtcgttacgagttatgaaaattatgtcaggtagtctgtgagtctctgtgtgcgcttcttcatctggctttggtacgcgtgaagcacgccttgtttttgttgtcaggcggcaatagatagattggttggccaatgattgacgcattttccgtgggcttctcgaaaactttgggtggacgaaaccattgtttttaataattattgctccgcttcctcttttgagcaagtccctgtggtcctttttgtcggtaggcaattaggcattgaagtatctggtagcactagtgtgattttgttggatggagctaattaatataaaacctcgtttagctcatcattcgatcattggttcttggataactataaatatccgcaactactagtattgaaaatatagatatgaaaacgtatcttcctgcaaatctgcatagcaaatctttatatttgtttttttaatcatttttcagttatttaagatcttgatatttgattgtgcatagcctaggaacgctgtgaacggagagagtatttggcaggtgcacatcctcttcaaaatatataacatataatagtatatatgcgagtaaattattcatcgatccccaaaaatgttttgacttgaatatgtgaaatatcaatatatgatggccatgtatacacgagatagcttactgttttgaatcaggcctgccaataatctttacttggttgaacttcaacctactaaatctctaggtatccatcgatatatcatccattgaactggcaatcaacagctatcacaacatataggtccactatgtacactgttcaatagatattaactactattaattaattataattctgaggacacgtagacggaaaataacagccacgaaataaactaaacacgtatccttttcttttgttatctagacacggaggaccggatcgctcattgatggtatcattttgatctcttcgatccgttcctttttccggtaccatctatatgtattaactcaaccaagccggccttctaaagaaatgaaaatatcgtacacacacatatatatacagctactccgtatttacaaatacatcttgtatatataaacagttagtgtgttcgtactctcttatttatcaacgaaatgaggcagatctcttctgactattttcatcaaagaaaataaagagaccatgtgatgatcatgccgcgtgcgtgcatgctagctaactcctttctttccgggaaagaaaatctcttctttaatcgtcgtaaagaggctacagtgttaggataaagtagtacttttggtaccctagtactccctccatcctaaaatcacttttgtacttcaacacggttttcgagattctattttgaccaacgatatttataaaagatattttaaataaaaagagttatatactatgataatttatttaatgataaatctagtaacattaattttatatgattgatcttttttatttttttactactaataggtaaagttataaatatttgacttaatactatgctaaaaatacttttattttagtatggagggagtagtaaagggtacagtccaggtccagctcgagaaggcactatacactgtatagcactgtacattgtgtaccggcataggcagagagataagttgcaaattaaaccaattggattcgatcgatcgaacaggggtcccatgatcatcacatatatccatgatcatcacatatatctagccattgtatgattaattgcaaccatcttttgactgtagattttgtcatcctgaaatttaacaaattgttgttggatcggtttacggttggtagtttgcacgtccgtgtcacgtagaatacgacgtactgtacgtacatatataagtacttgcaaattaagcacatgagaaatatatatataaaggtttgtctagctacctaattaagatggattattgtaaagatatttcttacacatttatgattgggagagttcatatgtttccatttatttgcatgaggggatggaaggctagatatagaaagtcttcgcacgaaatatatcgtttggcggagttaaaatctgtatcaattctcctctaaaaaaatctgtatcaatcagaaaagaacggacatatacgggtatacccatttatgagtaagtacttgcaaatcaagcacgtgagaaatatatatgaaggtttgtctagctacctaattaaggtggataattgtaaaagatatttccatttgcatacgcatgattgggacttgggcgagttcacatgtttccatttgcaggaggggatcgatcggacgtattccggccggccggcgtccggcgccgcccgtcggcgcgtggccataaaacgcgacgagggggtacggcgtggtcctctacatgcacggtgttgggtcgccagccagccagccttatcttgctagctgtgacggcgaccacagtacctgccaccctgggggaattaatctagaggtaactaactcagatttaatttataaggctttgatggatggaagagaaaacgtgcgctcagatttagactttgatggagaacatttcttgtgctatgtctccctgttttccctcggttgatcatgatactgcactctttttcatacaacaatataagtatttatagattggtatgtactccctccgtaaaaaaacaactctggagctgtctagattcttgtaatagtagtggttggctttttttttttggggggagggggggagaggggggtagaggttaaggttagaaaaagcaaactttagtgcttctaagagtaagtttaatagaaatgcttactatttactctttatttctcttgctatgaatttaatgaatatttattggagcatttgtagaactgttcttacatgagagcatcacctcttactttttattgtctttttcttccatataagtatataacttgcttataactcactgttgtttttctctaattaaatgagagatgaatgggggtgagagaatagttagaggtaagattgaaagaaatttaaatgaaagatttactgatgggtaaaaatacttatattcctggacaaaattcaaatactttgtattattgaacgatggggggactaaatttgccgacaaccacctcttcattcttactgttcaagcgttcatcctttccctctcttatctgtgaccccacggcatctctcgccgagttgattgctattaatgcctcggccaacctcttcacctttttgctagggccatcggtggcgaagaagagcaactcatcggagagaatgaatacgtacgctaatatgacaatcatcaaatctttcaagatccaggtgacagaatcttaagcattctaacatagtgccacgtaaaggaggtaaaattgaaacctcggttggtccctttttgctgccaacactgatgctaatgctttaataatgaccgtacaagtggatccttttacagaagatctagttgccccctcccccatgtgttggtgtagcgtgtttagcagtggcggtaagtactccagtacactcactctgtcaaaaaaaaaaaaactatttccctttcagaaaacttaaccaataaaacgatgtgatcttttatattgtctagattagttgtactagaaaggattagattcccgtataaattaagtatttttagaatggaggaagtatttatctagattaatttgtcagatcgggttcttttttagagagagagagggggaggataaaccaaatgtgtatatgagaggacacaccggctcggccccacctgtcgtacactatgaccacatgccagatttgagcctgtcatgtgggcttcactcccccggcatctaaatctacctctcattttcgcctcttggaaccctccaggggcaggccagcaaaagactccatatgatgcaggtcgctctgtgattgtgatatcttagtactgtctccccatttctgaataagttcatttttcattcatcacatgcatataccaatacaaagttaaaaaatattaaattacttcttatcaaatttcaatataactattcatcattttataaacatttaatataattattttttattctcacaagctccgaagtgacgattattctgaaaacgaatttattttgagataaatagagaaaactaaaaatgaatttaatatgtaacggatgaagtaggtttcctctttattttcttctctctttcaacaaagttgtaggagaaataccagtactagtagtactatatctgatgggattaattagttcttcgttgggtttaggaggcgttgattacttgttagagcactctgtcctgatcaaacctatcactgtctggcaccgtgcctggaggtttgcctgtcgacttgtgattggctgctggtggggacacgtcacccttagaggggttaatttcttgaggtgacctgcagcagctggggaccgatatggaatagaaaaatggcaagataccacatatgggaggtactcccaccgtaaaaaaaaaaaagctaacctaagataataatgaaatataatttagaacaatgaatctggatataaaggttaaaacccgtgattcgttattctagattatatttcatccttatttagattggtttttttttaggactcagagggtagagggtagagggaagaaagcacatgattttatttaagagatttgacacacacacggacgatattggtttgttcgttggagaggaaaaagagatactgttccaatattttctcagtagctggatttggccctctcttttctcctcacatttctgccatgtttattctctttctggaactgggtactattatatataatatggattttttttgcaagaaatatatcatatggtttgtttaccacctgaaaataataagaggaaaaaacttaagagggtaattatactcactccttctctaaggctgtgttctttagatgatgttgggagctaatctctcgcgcacacaaaatagagtgacttattaacgcatgattaattgagtattagctattctttaagaatggattaatgtgatttttaaaattaactttcttatagaaaatttttataaaatatatctgtttaacactttgggaagcgtgcacgcagaaaacaagtaacttgagttggaccttgtctagttccaaactttttcttcaaacttccaacttttccatcacatcaaaactttcttatacacacaaactttcaactttcctgtcacatcgttccaatttcaaccaaatttctaattttggcgtgaactaaacacacctttggtaactgcagctgccgaactcagcctaagtgcactcttgtagttcaaatttaaattagaagagtgttcttattttagaaaggagaaagtatatcggtactgtttggtactacatctgctaattgatttctggcatcgtggttgggtaaaagtggacagaaactgatacctcacatgcatgccacactttttttttaactgcttgtatgtattatagtagtacaactgtctctgcctaagaagatgcctgaattggcaggtgactatgagcattccacccgtactggcggtcccaaccgtccaccagtaggaagagggcatgtattgtattcctagttgttgcatctcattttcgctgttgcttttattttcttactcatttgtactatttattccctagctagatagaacccttttgtatgctccacaccaaagctaaagtaataaaatgctttctctctctctctctctctttatggggaaaaaaatgtatagaattgagctccattgtgtatgtctctggttcagcagcaagaagaagatggagtgatggacacctgagcatatcctaagacatggtatctttgcctccattcctttcaccagcaggtcagtgtcttaaaacaactcacatttgctcaaaagatagcattcactaacctgtggtagcaatatatagagatattcatatttttttgcctgtacaatgatttaagagtttatgagatgctgctgtgaatttggatttgcttttcgaagcgcatttgttattattttcttctactaagactgctagtcaggcagtactggagttagctagtacaagtgccgtacataatgactcttctttagttttcttactaaagtgggaaattgaaacattacatggaatatttcgtgggtggggccaaccaccccgaaatggaaatctggggccctcaataatttcgcgcatcgcaacataaaaatagtggctgtgctgtgcgtaggttctccattggatggaactgatgggccaaccctagttttgcatcttctccttttgtttttgcatcttttctcactttacttgctgtcaatgcaacaaaaaagataggataactttgcctcatcaatcccccaacagttccttgtctccattgctatacagtccacacttcctttcctgtagtatgcatctatcaggaaaaaataaaagaagtttgtctccactaaagagagatataagaatgattcaacaaggagtgatttggtctatcacaatatgattagtaataattaagttgtgttatactccatcagtttcaaaatatagaaaaatattgaattctaattttgcaccgcaatatagtacttctacgcgatatccatggttctcattccactaatccaaagccaaccagatgcctcgaaagggaattcaagcaatccaaaattcaaaaattgacaactaaaatgactaaaaaggaatcttttgacataaccttagtatctgccaaagaacctatagcaatccttatattttagtagaacggaagaaatatatatatagtaatcttgtttagtactgtaaatgttgtaaatgtttttagacgtccctagtttggtaaactagtttacaaatgataataaaatacacaataatcgcgagagacatattataggtggataatatatttctgtttcaattttcattttcatttaataaattcccgatgggattggttgatctcttgttgggcgacaccaatcgtatatgtactatcgatgaaaatgcaaccggccaagcaacacgagctgagttgtacgtgttgctggcaagacattggcctggtagcaaccaatcacttgcacacacgcggattacagtatcttattctctccaatagtcttgtctatatgtacaagacgtatcacagagaatcaccggtgacagcaatgttgatgtgcggcctagattaagtagcttgtgctatatacgattccttttgtttatccaatgttagtttcactttagatgtcaattcaactataactagctaacccagtgttttagtatgcgtttggttggaggaataggttaggtcggattgggtcgaacccctttttcataatgattggtttagggatgggtgagatgggttagttcccttagaatattcaccttcgatccgggtccaaatcatccggcaaaaacaaacaaatgagttcgacccacctgggttgggcgcacggcgtgagtcgcgtcgcttcaccccgcatgcttgcgcgctcggtcgcctgcttgctcacaccgttacctgctggtcatgctcctcgacccaccggcttgctcgcctgcctacgctgctccttcgcccgtaaatgcaagctcctccgttcactaggccatcgtcacacacctccgcccgccgtcatccatcttgcaagcccgccctcaccgctctttcttttgctagttgttggcttgcttgtccgcccaccggcctattttgcataccgcttctttgcatgcttgcgaattacaccggcttgcgtgctcgcaagcctgcccggttgttgacggtggttgcaaacaccatccatcccatctctcccttatccttttaataaccaaacaaaaaattggaatcgtccgatcctacaaaccaaacatgtgagtgaaatcatcctaactctaaaatcaggggatgtttcatctcatcctatctagtcccgaaaccaaacacatgcttaagtagagatgccatgaagttgtaactgaatggtatcataaacattttttaactgattaatgttggatctcgatgtatgcaatggctggtaactgttctcttatgtttcttatagtttctagctagttctcaaaacaagttcgttctagctatatatgaaactaattcgatcgctgattttatccattgaaacgatgatcctacactacttttgagatattaaaacagcagggaggcccctgatcgatgatcctactttcaggcagccgatcaatgatcaaaattaattaaaaaattcttcccttttttttttggtactgaaaggaaccaaatttggtcaaattttgtacaaactcaaatgacgaaacctcgtgcgttttccataattggcgtgcattgaccttccgtttgggggtaggatagtgcatcactatccgtgcacggttactgtgtgccgaaaacggcaactctgtataccaatttctgccctgttcaaatccaactaagaattggtcgacccttttttttttaattccaagtggttgcatgttcacgcaaacacaaatgcatactattatatgatttgaaattaattaataagaagtgtttttctcgcagattgcgatgtctgcatcactgcaattaagccattagcatacgtgtattttgtgaacaggtttctgctagtgactcatactgctattcccagctaagcatcatcaccttgcagaaaagatgagacaaattaggatgcatgcgacaggataatgtaatgcctttgtcagctctgatagggacgattttctcccccttttatctctctaaaagaactgataaaagggacaatcttttgtgaatgtttaatctacaaagtataacatgcaaacactatggactaatattattactgaattgagaagtacaagatggtaaatagtattatgtttgacttaccatcgttaataggggtttgtgaatccgaaataatctcaaaaggaatgcaattgtagcattttttttgttgattttataatttatactccctcgtctcatattataattgttttgactcttttgctagtaaaatttcattaagtttgatcaaatttatagaaagttatagcaacatttcccatataaaacaaacatattaccaaaatatatacaatgttatattcaatgaaactaatttgtatgtcgataattttttctataaatttggtcaaacataaacaaatttgatgcaaaaaagcaatttttttaatgtgaaaaacccttattggaagaaacaacaggtgtcgactgataatgatcattaggcataggttagtttctctggactcataagtctttctagcttcgccactaaacacaacaaaataagacgtcacactcttctcgtgcggcctacaaaagatatataaatagaataaaagaccaagagtcctaatagcaaagattagaaatcctactagggaactaatctaaatatattacatgctgaaattcggatgacatatttaaaatatatataaatcaaacttaatagttttggataacaattagtcaaattgcaaatatatttggtgtataactttaattagcatatccatatttcaaagtactttaataagttgttgattttaatctattcaaactatatatattagcaatcaatggtaaaagtttaatttgaatatgtttcccaaatatattaaatacatcccataaaaatcgcggaggtaatttgtgagcggagattgatttcggttactatatattcatgtctctaatacaactattaatttggctagatttttaatactatgttataacaagtttatatattacaataaataactactttgcaagaaaaatccaatgatcttatttctcaatgccaataaaaaaacacgagtttcaaattgatgtaataacgataggtttgatacatcacttcttagcagttgctttctcttggccctatattaatcattcataaacaggggcggatttaccgtgggggcgggggggtcttgagcccccactaccatccttgggaccatggagacccccctaagcccccactaaaaatttcttccatggatgcgccgtttgtgggagttgagatcggctggaggagaagctggaggttgaagacgatgttttggcgacttgggccggctatgaagagcagcccatgagcttaatcttccaattttggcccggcccactcctccaacctgtagctcaagcgcggcacacggccagggtttcctctccctctcccttctctgaattccccagccgcccagccgccgttctctctccctgtctaccaaatccctaacactagtgtagtagcgtttgaccggccatggacgcgggccgatgggcgaccggcgacgggaggcggccgtggtggcgaggcgcccgacgcccggtggcgacaccggctgacgagggcgggagctaggaggcagcgtggcccgtggccccgtgggcgtgcggcgagcggcaagcaggcggcggcggcggctagcgagccatgagcggacgaggggcccggagggcgggaagccgggaagggaggcggcccgcggccaggcggcggtccagcgccggcgcgcccgccggggaggtggcaagacgggccagggcgccagccgccaggcggcggtcctgcgccgacgcgccgacaggaggcggctaggtgacggtccagctccagtgccgctgcgcgctcgcgccgacggggaggtggtgacccgcgagccagcgaggccgcgagggcgcaaggacgctggtccgctggacgcagcttgcagcagcagcagccagcagccagtgattgaatatttgaagttgaaattgccaaattggtaacctatttacctctaatactaatagacagtctaaatttgtgtctcaagtgaggtagtgattaaaatttataattgtttctacatttttagtttgtcaacatgccaaaaggaataatgcttatgtattattctagtttaaacaacacagatgccagtaatcctccacgcaaccacgagaatataagtccgctaaagaggtctagggtagagtctgttcagccccacctactattttttcctagatccgcccctgttcataaacaattaatttacacattatctccttccgtacctcgttgatactccctccgtttcataatacaagggattttaagtttttgcttgcactgtttgaccacttgtcttattcaaaaaaatttagaattatttttttttgacttactttattatccaaagtactttaagcacaacttttcgttttttatattgcacaattttttttaataagacgagtggttaaacagtacaagcagaaactcaaaatctcttatattataggacggagggagtatatgattgtcatccaaaggcatgtagttattatgcgtccaaccaacagtattttctgtcccaataatgaagtgattcgcccctagcatagtgcatacatatatatgtcgatgcactcagcctatagtttaactaaataaactaaatatttatgtgcgccagaaaaattgcattttaattaattttgtaataattaaactagagtgggtataacagttactccgaaagtgattcgtgcccatctctatacctaagctacttaattagctttgctataacaagtgtgttcgatcgaaagcaatgctagctatatacagtatgaagcttgagcagttaattgttgctaatgtttttcacattagattgattaattgaaccatgtgcaggcgtgcagcctcacgtgtcctaaaacctaattaagtgtggcatctttttggcgtatatgtacatcatattacttctagaatagcatggcctatcaattacttactccctccgttttttaaatagatgacgctgttgacttttaaacatatgtttgacaattcgtcttattcaaaaatttttatataaatgtatagatataaattatgcttaaagtactttgagtgataaaataactcacaataaaaaaatataattacgtaaattttttgaataagacgaatgatcaaacatgtgataaaaagtcaacggcgtcatttattaaaaaacggaggtagtacttatttatgtgtgtacgtacgaatcatgcgtgtatttttaatgaataggcggagtatatgtatacatacatgcaacttggcttatatgtaatattttgtatagaatttgtagcaaaaaaataaattatgtgcgtgagataattccaagatatatgcatgggaaacaatatgatttgagagttgatagtatagcttgttcattcaataggatattcgagagtaatcttgctatatatagtggtgttctgcattttgtgcttatgcaatgagagctttgatttttttaaggttgttaattgataccagtgataattgacccttccagctagctacatcctagtacccaaatgttgagatccaacaggtaatatatataaactatataacaagatcgagatatatcagaatactttctcaaggactaaaagcatttcatgccgtaggagaccaagttaaattgtccgtgtatatgttttttttttcatgcgaggcatgtataatattgatgagttaatttaattagtatgcttgtcatagctagatccagtgatcagtagtaatatcttggaagaaatagtaataatgtatgccataactcataagcaacgtacaccttgccaatatagttgcaagtggtggcatgtaacccttttttttttgttggctagagcaagtggttgtatgtcataatgctctttatgtatatattacctttatgtatatattactttcatattttaatgtatgacgccgttgactttttatccaacgtttgaccattcgttttattaaaaactttatgtaattatcatttattttattgtgacttgattaatca

SEQ ID NO: 25598 - DNA, 37025 bp, Oryza sativa
gtcatacattaaaatacggagggagtacgcaccaatgcgaccaaaatggctcatcaagtaaagtcagcatgtgttgatcacccccaaatggcataatatacaataggcaaataataaattcattgaatgtgttgaatgcaaccgtggcatatatatcaaccaagggagatcgatcgagagagaagaaaataaaattagaacaagagattaattaattagtatgaacttacaatagtgctcatgagtagtcctcctttgctactacttggataaaaattccattgttttttatgaaagatggtgatcaagttgttgggttgaatgaattgatcgatcgatcgatcaatcgagggcggcacaggaaacctaggccgtcagcctagataactccgacgcgtactacgttggatcgatcacttgcttaattattagctatatggatggttaattagatcgatgggtgagctagctagctgtccaattatttaaacagtgtactacgtacatgtgcacataatttatgcttgtatggcgtcaagttggcaacaaaataagttaataaactaatctctgccagtaattaatttagtactgatctccatatatatgtttgttaataatttgagatgtgctaagtatgtatggcgcttttgtgtgacgaaaaagttgagatttcaccgataggaactaaatcctagtgttatagtagtatataattatgaacacggggcatatatattcttatattcttaattgtaatagaaattcaataatatgttatgaattttaaattttttttagataatgaaaatttataaaatccagcttctacaccaacgggggtccacaacttatagtcgacttctatctaactataagtgtgaattaaaaattgtaatttattggctcttgtaacataaaaggaagcatatttgtgcactgttaacatgtttgcgtctttcgtgtaatcgagaacccgagaggaaaaaaaaacaaagataacttatctgcatatgcatcttgatgcgtacagatatcgatggatcgaacggtggaacagcaagtggtccgtgcaattaggccacgcgcgtgctcctcgtggtccattatactaaaacaaaaacgcacttactaggaaaacaaaattatttgatttaatttggtgatatatagtcgtacttgtacttcctccgtcccataatataagggattttaagtttttcttgcaacgtttaaccactcgttttattcaaatatttttgaaattattatttattttatttgtgacttaatttattatccacagtactttaagcataacttttcattttttatatttgtaaaaaaaaattgaataagacaagtggtcaaacgttacaagtaaaaactcaaaatcccttgtactgtgggacggagggagtagctaatatagggcctgtttggggagttttagattatgagaagcagctgtttggtagccaacttctgagaatctggataagctccgaaacctagcttctccagcttctggcttcttagttcattcagcttctggctttttagttaatttttcagaatctataactacagattctcagaagctgtggactgtttggggcagcttatagcagaagtagcttttggaaaaagctgtagctaggacaagctcccccaaacagggccatagtatgcgtttagtatgtagctaggagaggtccacgtcacccctctggctaatttaatcgccatccacgcaattgggctctatttttctccgctgctgctctctgtgttaaatttgcatatatttctatgcgtgtgcgtacggatgacttaaatttttctgtgtacacaagctaacctactcatcctgttcctaattaacaggagttatcatctcctccttcctattcttaactagatgaacaatttagttcatctaatgcatctaaactgttcgacaagtctatttagtataccctcatttacaaaactggttgcctgatactattatattaaaaaaaattttgggccagcaaattagttcacaccgggtattgagtgcttgtttgtttttccgcagcgggatagatctgtggtgtggctgtcactatagtctcttaggactatagaattatattttcttaattttgctatatcaaaagaaacgtctctcactatcttatacgtgttgttcaaaaaaaaattagtacacaccagactgcactttcaatggtgattattttattgacaaaatctaacatagagtggctgtaattttgctttgctagtgaggaagcaccggctatatatagtgatagagttggggcctcgtagtcgcatatctctgcgggcctcgtagacgcataatactcaatagttttaaatcctggtactaatgagtattacacaagtgagtgcattttaaataggaattcattaagaccatgattaattaccatcagtctccatctatttaaccgtgtgtagtgttgtgtagagtattgtactcaatctaattgtagattcttttttataatgttgatggccgttttgatgtgttttctataaggatattaaacaagactggggagaagagggcgacaaaaaccagagggtagattcataatgtggtaacaaaaagggtcaacaataatttaaatgtcagcatgcgtgcccactcatcaaaactcgatggtatgaccatcattatgtcaaaagaaagattttattttggtcatttagtatcagtatgtcatctaagaggacacacgagtacttactacactctgaaacccttgtcaagtaaattcatccaggattgtacaatagtggtgataaagccttggatatccccttgaaatatactccctcgttccctaaatgtttgacaccgttgatttttttaaatatgtttgactgttcgtcttattcaaagttttttgtgaaatgtgtaaaactatatgtatacataaaagtatgtttaacaataaatcaaatgataggaaaaaaaataataattacttaaatttttttaataagatggacggtcaaacatttttaaaaaagtcaacggcgtcaaatattttggaatggagggagtaaatcctccttaacgactatgatatagcgaaatatacatcgtactatatgcatttttcattctgttttctatcttgtccttgctatgttactataataaattacattttttccaagtgctataaatgaaagtaactgaccccattaaggtcctctcgaatgtagaatttttttagcgatttgtgaactgaattaatatctaggaaaaccctacaaaattcatgtgccgttttgaaatggaaagtaatatacgctcttatatcgtctgcttggtggcctatcggctgcggacaaaatttaaattgtaaaactaaaatttaaagttgattttgatgttttgttcatcacagtctatattcgaccacaagattttacaccataagttagtatttttaattgatatttctacagcttatcatcccgagcccaaccaattagaacaatagactcttttgagccccatctattgccctaaaaagaataagttaaagccaaaattcgaattttaaagtttaaattttgaagttgactttaagatatttttaatatagcttcttctttagcattgacttttaattttttaggatcatatatataaatattttatgcacaaattatgttttggtcagtaataagccattacggcttataataaacttttggtcaaccgacaagtccgtttttccacgatgtatcgcaccaatgaaattcatgtgtataagtaaaggatgtgaaattcatgtgtttaagtaaaaggatgcttttaattaaattcatgttatcaacctttgaacataaatatcctaaggaaaaaaaatcatgtgtagtaagtctaaaggaggagtaattgatcgaaagaatcaacgcccacgtttcgtttatttggggaataagccaaagccaaacgatatatttgcaagcaaaaattaatttgtaaataaaatttgtatatacatgttcttaacgatctaaaagcaaatagctaaaaaataaacttcaatgtaaaaaccctaaaatcatctccaaatttaaaatttaaaatttatattttaactgataagtacaagcataattgaaaagatgagaccgcaagagtaccataccttaccttacatacgatggaggcagccacgtagcttcatatttccaagctactcctacccttggccttgggccctctgtcaggaaagatattttgagcccagagcaagcaaccaatggcaggcgcacgcacacaccaaatgaggctaccatcaaatggcctaatcaatcaaagaaaaagtcaaattttaaattttccagcttaattttaagatatttttaatgtagtttctttttcaatattaacttttaagtcaccaaaagcatatttataaaagtttcacctataaatatatttttatttcctaataagcccttttggccaaacgaggacctgagcaaatgagagaagagaagggaaaaaaaaagaaaaaagaaaagaagaaaaacggggcgcccaaatcgggaaggattttaaggataaccggctgcccaccggctacttcccgccttctatctatatatccccccctccctcctttttctcctcctcgccaccgctcgccggcgccggagaccaccaccaccacctcacctcacccacctctgcttcttcttcttcttcttccccgtggtgtggtgtggtggtgaattgttgttctgttcccttcatttttcgttgattcgtgagcgcggcgacgtacgtacggtggtaagcatcgtcgtggattcgtctccggcgacgggggggagtgggtagggtagggatgttcgtcaaggactgggactgaggtgatcggctaaatgtaccgccagaacgagtcggccctctcctgcttctacctcttcctcctctggttcttcttcttgaaatagactccacgccgcgccaattcccagcccgagcgggagccagctgctcaatccgtcgttgagattggttgcggtttgctctagcttgtgaactcggcggagatttttggttttttgttttggttttgggtttggttgggtgagtggtcgatcgatcggaaggtgttcgatcgattgcttgcctgctttgtgatggagttggatctgaacaacgtggcggaaggggtggtggagaagcatgagacggcggcgaggagcgactccggcacgtcggagtcgtcggtgctcaacggggaggcgtctggcgcggccatcgcgccggcggaagaggggtcgagctcgacgccgccgtcgccgccgccgcctcccgcggcggtgctcgagttcagcatcctgaggagctcggcgtcggcgtcgggcgagaacgacgccgacgacgacgaggaggaggaggccaccccctcgccgccgccgcaccaccaacaccagcagctgctcgtcacccgggagctattcccttccgccgctccctcgccgcagcattgggcggagctcggcttcctccgccccgacccaccgcgcccacacccagacatcagaatcctcgcccacgcgcctcccccggcgccaccgccgccgccgccgcagccgcagcctcaggcggccaagaaaagccgccgcgggccgcgctctcgcagctcgcaataccgcggcgtcaccttctaccgccgcaccggccgctgggaatcccacatctgggattgcggcaagcaagtctacctaggtaatttcatcgaacacatcatcttcctcctctcaatccaacgcgacatcgccatgaacaatctaacaaacaccttcatcttctcccaaacaatcacaggtggattcgacactgctcacgcagctgcaaggtaaagaacacatcacatcattcatcagaacatgagctctgtgtttgtgaaggagattgagagaattgaatgatgatggatggatgcagggcgtacgacagggcggcgatcaagttcaggggagtagaggctgacatcaacttcaacctgagcgactacgaggaggacatgaggcagatgaagagcttgtccaaggaggagttcgtgcacgttctccggcgacagagcaccggcttctcccgcggcagctcaaagtacaggggtgtcaccctccacaagtgcggccgctgggaggctcgcatgggccaattccttggcaagaagtaagaacaccatatatatatatagctctctctctctccatcttcttcttcctcatcttttcatttcaacatgttcttgatttattgtgattgtgatcatccattttgagtagggatgatagtaagtagagatagggtgtgattagatgcatagaacagataagagttaagctagaaattaggcagtggatagggaattcctcaccggtgggaacgccatgcttggctgcaggtacatatatcttgggctattcgacagcgaagtagaggctgcaaggttatcatcagcttggattctcttctcttgtacaattgattcaaaccaaaaaaaagtcttttcttttttaaaattttactttctcgtgttgttgattttcgatggaccttgtaccgactcgaatctcctctctttttttttctcttcttttttctcttctcgttttaaacatcagggcttatgataaggctgcgatcaaatgcaatggcagagaagccgtcaccaacttcgagcccagcacatatgatggtgagctgcctactgatgctgctgctcaaggtaacatgcgtgctgaatctgatttgattaaattttttttctgtaactgattaactagctgatgaactcagctctgaacagatttaattaaatccgggttcaattgtgatttcttattatttttaggagccgatgtggatctgaacctgagaatatctcagcctgcagcctcacagcagagccccaagagggatagcggctcccttggcctgcaaatccaccatggatcatttgaaggttctgaattcaagagagcaaaggcaagttgcaattcagtcaaaattcttccgatggatgatttgtttgcatgtcaagcaagttgcagtaatgcgaaagaaacacaaaagcataaataatcaagattcgctttcaccgtggtagcgactaaagtatgatgtgcaaattgcatatgtagtcttctacctagtgtacttcatagaccccatttctattgctaccgtctaaatttgatttctctattgtcggacccaccatacgtacaaattggccccaaatttcatcaaatagtaacaagtttctctttttcttcctgattacgttgtaggagcatctctttcatgaaaactgtaaatgatattcaggatcactgcttagttgatatttcaactgaaaaacttgtgctttgctgtgcagaatgatgcagctccctctgaacttgctagccgccctcatcggttccctcttctgaccgagcatccgccaatctggactgcccaacctcatcccctattcccaaataatgaggtgaaaattttgtagctttcaacactgtatttagcttcatccacttgcatttcttgtgtggctatcagtttagctcaagtcttacatcaatgtgcttcatttccttccggcctgtcgacttcagtagtattaatgcctggcacaagtttcatatgtaggttcttgaattttcagaaaaggcctaattagggtagcagtactagtctatatgcattataaatatgtttgattttttcttcaaaaggaacttcctagagagttgacgatttcgcgttaggctttttataaatcgtcagtccaactgttcctctcaacgtgctaatatcttataaaattagtgtcggctgttgttcaaaattccccattgggaaagaaaaatgatactctgccatcttgttattattcagaatgattagtatactacatcaattggttattaaaagaggttagactggtttgccgttagacatttggacctgggagttttgttcaaatttacctctgagacttcaaggatagcttcagttacgtccttctcttattttccttggacggaaaggtgatctcgacgtctgtagctgagatttctgtccaattgaatcgtcgcaaatccaatccgataatcatattttatccaaacaaaaatacaatataatagttcttggcaatttgtacacctgtatcttgatggatggataagaaattcagcaagctaagctaagtacaatttttcactgtttgatgatgcaggatgcatccagatcatcggatcagaagaggaagccatcagagggggtagctgttccaagctgggcatggaagcaggtgagccatcatcaccctgctcctcctcacacgctgccattgcccttcttctcctcctcctcgtcgtcgccgtcgtcgtcctccgctgcagcatcatcaggattctccaaagccgccacgacagcagctgctgcccaacacactgccaccctccggttcgacccgacggcgccgtcgtcttcgtcgtcaagccgccatcaccaccaccattgataaaaaggaaagaagccatcaccaccactgtaaattttgccgggaagccggcaaatttttttttttcttggccgtcgccggcgtttcaacgttttcgtctttgcgccggcgggccggccgggtggtttcttgtagtgattagttaattgggattcatgactgtatttgcatccacacataaaacgcccaaaaaatgttccaaatgctcctagtctctttgccccctgatctcagagaacagatcatactaacctgagatgtattgatccacacaccttgttgtagagaatttgttatatcagttactgagattactaaacagtacaggcatcaactctgactttacttagaactcgttcttttctgattaagatatagatacgattttttacctcggttttcgttagcatgttttttcaaactgctaaaaggtacattcagtgcaaaaaaaatttctaaatagaaattgattcaaaatgtcagataaatctatttttaaaatttataataaattaatactcaattaattatgcgctaatgtttttaatgtccccccttaatcttcatttacgataaaaaacgagcacctttacctagtagtttattgtggatagggaaaaaaattaaaggtttgcataataggagaattattcaagttactttcttggctgtcacttggtgttgttgtcctttcttagtttggtgccagctaccaagttgcttccagagcaaacactagggatggcaattgtgcccgtttgcccgtttacccgcgggtaaaaaccctattagggttgggtttgttctccattttatacccatgggtatcttattggttcaaaagctatgcccgatgggtaaatgggcatgggtatgggtaatcactacccatgcccgctttgcccgtttacccgcgaaatctaacttacatgtaggctaggagtaaaatccactagaatacataagccacgttctttgttttctacgatttcccttttatttcccttattatttctctcctcttactctatcgccgccagaggagagacacgacaccgaggtggagaatatttgatgttttaagttcgattcgaagttagtagcttgtagactttttgttccactgcttttgttgtggcgggtaaacgggcacgtccgcgggcaatgggcatgggcaaccatccttacccgtcatgtagtaatgggtatacccacgggcacaaataatctcacgggcatgggtatgggtaggcactacccgtgcccgtcacacgcgattgccatccctagcaaacactgttcgtttgttcgttctgcactgtgccaagatttggccataatggacagggaagcatttggtacttgtaagaatatatgcatgtcccttacagtacatttggaaccacacagttttttctctttcctgtactggagtagattagatttgtctgcaggaactttcactctctgatggctagtagagttaaatttgtgaaaagaacactgaaaaattcaggcagatttggtacagagaccgggtagaaaaaatctacaaaggacaagaggacagtgaaaaggaaatacagtggcgaaattttgacagattttaacatgaaggatagtttatggagagagatactactcacttttagagttgaacacatgtatcaaaataggtaaaattaaatgtgaaaatattgtgattgattgagaggaagatgcaaatataaaatttaaattatggaagattacgattgattgagaaaagaacgtagatgaataagtgattattatattctagaatggacggagtatattgggggaataataataactggtgcatgggtgcgacctcgtctggtgttacgtcgatgcgatgctgctgctggctgcgacttgtgaagctttttcaatgttttgttcgtcgaatttgacggtgaaattaccagacggacggcaggcagctgtcggcatcgggtcacccgacggcaaaaagttggtgccacatgaaaagaatccgtcacgtgaagggacatatgtaaactattttccatgaattccgactgctactagctagtatctctacactagtaaaacataatataagttttttttgattgtttaatatttttgtcttaaaatataagtatatttgatcagggccatcctagggacgtgcggccagtgcgcccgcacagggcccccaattttcaggggtcccctaggtccaaaacttcaacactatatattcaactcagtaagtaaattggtagcctaactagtcctgaaaatctgttatttttcttgtcgttttggcttcgattacgcctttgccggttcacacagttgcggcggttcgcaatctttaatcgcctcccactgtggacctcgccaatcgccaatcgtaactaacgagaggagtaaacgatgcctcacctttttctctcgtgcggtcataccgcctgacgcctgccacgcccctgacataattctttctagtaatttctaatccggtaatccctaattttagattatcattttaggccattctagatttctatgaaatatattacggagtataaattattttcatattatattatcaattaagtttttatccttcaactttgcacagggcccccgaatttaacgggacggccctgtatttgatcttttaacaaaatgtatggttctggaaaaaaaagtttttgtttgagacagtcaccttagttgattaaattttaaatttttaattgtttatacttctctcatgattggctgaaaatatatagatttaccctagaaaatacttataatatgatacaaattttaaatcttaaaaattcttatacttaatttgaaacggagaaaatgtctttgaaaggtatgtaaatggaagacatgcgatcgatacaatgaaaaataattaaaattataagtagataggttttaaggcaagcattatattagtggtgccttgcccgccattagttctccggcacatgactataaacatattggcatgaagtataaaatgcatccacaactataaaaaatcctcaaaagaagtagagtactgctataagtataatctaattgtacaactcatgtacaactagagacatgcaaccatagatgaatcaaaggagagcatgttcatatgcactgcagccgtttataaccattggtcaaattcaatcatacgtgagccgcatagttaggttgtatgcatagcaatttccaaaatagtaaatgatcccatgatggtaaacaggtcagacgctagtagtgcacttggtgttaaatagtggatatcttatgtgttgagatagattctctcttggattgtgaatgactgtaccaagaaacgtgtgagcaattgattctatattccttccatcatattggcataatgttattgatgtgaatatgagagatggtggcaagctcatccatgcatggtaagcatctcaacatttcaacgttcaaacatcaaactttgcaatctcgaccagtgataaccagtaacccgtaataatatagcctctcataattatttgattgttagccaaccaaattttgaattttagttgattttttttatcgttgtatatttttcagccttggtttttaaactgcggataaaataaataaataaataaataaataaataaatatatatatatatatatatatatatatatatatatatatatatatatatatatatatatatatatatatatatatatatatatgcttataattttttttcttcgttcataatataaactgacattttttttaaaaaataactgcacttatgtacatattataaagggctctgacgcactcttcctattatagacattaacagcatattttgaaatcaacttgaaggtgcagtttttaagatcataccttataaaaatcaaaagagatgtaccaaacgaccaatgctagcaaaactcttggttatgatgaacatgcatcgttatattggtactagctagatctactggtatcctccaatcccattgctcccttcctttaattgttctttaattacttgcttccatgtaaatgcctctgaatttgtttacaaggcacaaactgcagcacaagttggcaattgtttgttgcttcgatcaggagaacgatggtggttcacatatattttactatagcagggaaccaacatgagatctgaaaatgccaagaatatatatgatagcttagttattttggtctcagcagaagcagacttacttcatttttttctattttctcaaaaggaaaagtagttaatattgcttaatttttataccatacatagtgatattttaaatttaaaaactgagcatgatttgaccaaagttagctaggtgtacatcagtagtactcctacatagctagtggatcgatccaattatatgtgaacatcaagaaaagaatactagatatcatttttttttcatatggaatatcatggtagctaacacctctgggcaacatagtaatagaagaatacagagagtacttttctgaatggcaatgagaagctgtcgtacaggtgtcgacgtgtaacattatagtagttgtgttgatgatgcctccccagatgagattattattattaattattattcctttcttgaaagtattgcatgcatgatacctcaaaatattcaaacaaacagctccattagatcaccgacaaacgaccatcaggtcaggtacgtaccatgaaaaagataactaacaacactgaaaggacaaccacccttaagcaaaaaccaagacaccacaacccccaagcattttaattagtactgcaagcattctgataattaatcccttcatgtacctaaaacaatatcttcttttcttcccattaaaatattagatttgaccccatattattggtgtagatatggaattaagaaaataaaggtagatctgatatggacacaatatataggcaattatatcaccaggaggtgggcctcattggtgaagtgtatatgttgttaaggtacccatgtcaatgatgattcataatattagcttctcaggataaaaataaagtttccatctctttaggggtgtatttgtgagtacttcagtttgtaatggcgtgcgtagtaatatatgtacatatatgtatttcatgcaatcgtaaaaaaatacacacacaacgatagtgatgctattggtagacacgtagattgagaaatggacgatccagattacgtgcagttgctattattaattaacaaatcacaatagcaactgcggcggatctcaattggttcgtaacggtctcataagaggaatcatccttatgcatgatggcgataagaaaacaaagtataaataatacttcaatttggattttttaaggattgaggccgtccttttttttttcttctaccatgtggtgggtctctctctccttttggcatgattcctcgagagcaaatatattgctatttttatttcgaagcgcctatatacgtcactgcttacgttaattccctgccggatagtaataatctaagtttgcatgacatggatcagaggagactaatataaaaaatggacaagaaaaaaatagattaacaatgggtcatcgtactagtactatattgggactaatcacattgttaatgctggagattgattccttgtattagttgtaatcgaacgagttctttataaaagtggtcttattgtttgtactctgctttttgtttattggggataatcttttatactatcaagacgtgtagttatactatgaacacatgtactgcttttagtatgtcctttattaaaaaaaaggcattatttattttgtgtgtagcttaatcatcatgacacacttgtcttgatcactttgattatatattttggtttagcctaatcttgatttttttattccctgccagattattcacttttagtaccaattggtttcagtaattattttaagttaacaagtggggcctgccctgtctgctaagataacatgggcaagcaaaattcaacatatatttaaaagagccagatgaccatcgagttgaaggaaacagctgcatgttaattacttttaatttgattagatttgtcagatccaagcttatttttctactagctggttacaatttgttatctatttagtacaacaaatcatgaagggtctggatgtgtgtacagtacctattgccagctccaataaaatttctccttttttttgcttaatgataatataatacaagagcctcgacaagcacaaggaatccgtaccacatattaattatgaaaattttactagtagtatattggtagacttaatctaaaccaagtaataattaaacaatgagatgatatcaaacaccacagctccatccactgtaaattatagtaaaaacagagcgtttgtccgaaaccagctagctgtcattttcgtttagttaaaatacgtgggaattaattttataatattttaattcactaatatatgagaagcattaaattttagtacatgaaaatgatatcagtatagttaatactactaatatattttataaaaggaaatagagcaagctactgcgttgttgtaaaatagacgtccttgcaattaaattttaagattttaattcacaaatatattagaaacactaaaatttaatacacgaaaatgataccagtatattaagatagttactttgatgtggttataaatttaacagctttaatacaccaatgttgacaaagtaactgccgaaaaacctacacattaaaacccgtatcagtatatatcttgattgacaaataaaaaaggaaatgaagaggagtaagacagtactatcattgttagtgtcctaattaggacgatgacgaaattggatggagcacattgatggcgacgcaacaccagcaagctagctagcactgctgattgcttcatccatcaccatcactcgtgccagctgatcatatcattgagttcacacgtgtagctagcttaattagcttgctcacatgttttaaatttcttttcttatgtaataatataagatggtttaaactctccgttcaacgatcaaagattcaaattctttcaatgatcaataaaagtcgtaggcagcgatggagctagaaataattccaatcctgaagaaattcaactatatcaacaacgaaaatttgaagggagtatttgacggtgtgcctgggaggttgtctaggatagccgggcttaaataaaatctacaagaagttatacaaatatgaaaatatctcgtattttaagtcttcctttagtaaggacatcgctcgtgtaaaaatcctataaaatttatgtgttctgaatcggtagatggtaaaatcagccagtcagtcaagtgttagaaaattcttgggccttttcttgccatcagcaataatcccggggcctgttattaatgataaaaaagtctactgactccctccaatatagatcgaattttgagagagtcaaattggactttttacttaatgatgaccctgagctctagttgcacaacaatacacagaacggcccaacaaagctcaattcagcccattacacagtgttaagctgctggtttgggcctattcggccttatttaggaataagttcactttgtgacccttaaaagtgatcgaaatctaattcgtgaccctaaaccacaaaaccggatatctcgacctctaaactcttaaaaccggtgcaatttgactccctcggctgttttggaggacggtttcgctgacgtggcgcctacgtggcgatgttgactcagtcttcggtccacatggagctgacgtggcgcttatgcatactagaattgaaaatatatatgcagaacccacttgtcattcataccaaaataataaatgtatagccattgacatgtggggcccatatgtcagtcatctttccttcttcctcttcctcctcccttcctgtcccttctctctctcctatttctcttcttcttcgtctgcaggaggtggtgggtgctcgagggtccgagtggccgcggcggcgagcgggagcggaggcggtgacccgacggcggcaggaggagacgccgctcaccgggtgatgtgccatcccggagtacaacgccattgagctcctcgcccaccacgacacgctccacctgcgcgctctcgtcgagcggattcataccgccgccgcatgccaggccgatgccgcttatcctcaaaagaatcctaccgtcattaatggcattcctagccttcttgtttttgctttgacccagcaagcaagaaactcctccagcgtctagtcacctcaaccacgaacttgaatccgttgctctgctactgctgctgtaacggttgcgctttgagtgtgactacagtgtctgctgctactactactactactctgctttgccactacttggttcgcaggaaggtggtgagagggaaagtgtaaggatgagagagggagagggattgggatggagttcttggtggctcaagcgctcctcctcctcgtcgtcatctccaactccctcccgctcccttccttgggtcttgctgcaaatggtggcacgccgccgccgccgctgggtcgccgcctcccctcccgctcgccgcggccgctcgggcccgccgctgcctgcagacgaagacgaagagaaatgggagagagagaaaaagagagagagaagggaggaggaagaggaataaggaaagagggcccatggccccacatgtcagtggtcccacatttttttttgtgtgagtgacaaatggtcccgcacatatttttttaattctagtatacataagcgccacgttaactccacgtggaccgaagactgagtcaacattgccacgtagacgccatgtcagcaaaaccaccctccaaaaccgctgagggagtcaaattgcaccggttttaagagttgagggatcgagatatccggttttatggtttagggtcacagattagatttcgatcacgtttgaggatcacaaagtgaacttattcccctcgtttatatggatctcatttcaggcccatccaacttgaaagctactagtaatatttcggcccactaaggtgacacctagatgggttgggccatagtccatggatgagacggcccaatgggctgaccagtcttcttcaaccctactcctccaaggcaaagcaaagaaaagctcctcgtctccgcgttgccgcacaagggaaaccctcgccgccgccgccgtcggggatgacgtccgtgcgcgccgtggggtccacgctgccgtcgatccgcgcggcggcggagctggcccggcaggagctgctgcggcgggagctggtggagtgccagctggtggcgggcatctggtgccacgggttcacggtgtcgcagctgcggagcatccgcgccagcctgccgccgacggcgaggctggttgtggcgaagaactcggacgtggcggcggcggtggccgggacgcggtgggaggcggtgcggccgttcgcgcgggggatgaacgcgtggctgttcgtccgctccgacgagatcccgccggcgctgcggccgtaccgcgacttccagaaggagtggaagctgcagctcaacgacttcactggcgccgtcttcgagggccgcctctacagccccgacgacttcgcgcagctcgagtccatgcccaccagggtccagtcctaccagtacctcgtcggctgcctccagatgcccgccgtctccgtcctcgccgcgctccgcgctcgccaggaggccatggcgcagccgccgcccgccgacgagccggctccaacgccaccggcggacaagtgatcaccgcatctctcttctcatttttttttctcctgcaaatttgtgttgcagaaacattggtagcccataaaaacgcattgcgttgcttgaatatgatgtatcatcttccaatattacatgttgatgttttgcaaacaattgcgaattcgcgagtgatgccgcatcgccattgctccaatctcacgctcaccatcgttttggcactggttgatcgtgggttttaattgcactgatgcatgtgagagtggagattaacggtgtttgaagttgcttggaattactgatgtgttcatgagcttgtgttgcagtgaagctaacactgttactggtagcttgaatgcttgaaatgccagtgatgtgtagagtttgctgatttttttttcttttttcaaaagttagttttgtacaatcgaaagatcatgaattttgaaatatgacattgaactttggtggttcactttaatagcaccgaaagattatgttgcaaagaagacaaggattacttagcattagcagcacgccaacactgacggcgaaataacaaacttcaggaaccccaagggggttgaagcataggaggttgatgccttcaggcttcattcagttaagaaactatatccagcagaattgcatggtgagcaagccttactgaatatagcggctttaccaatgcaatcttcaggtagatgagtcggaacgacgagcacgtatttacactgtagaacaaaccaaccttgataaattaccatgcctgtcacaagacattagggtctactaaaattcctttcacttttcctatacatacaaaaagagagaacgttgctacctaactagcacataaacacccttgagcatataaagatctggcgtttctgcattctggacttctggtaacttgatgtctgagacagtacatagaggtcttatcaaaattacttccatgttttacctatacatgcacaaaggaaaagaacgttgctactagtatctcaaaccatatcaacacccttgatatccaaagatctcacatttctgtattctggttcacgacgaatcagcctgagagaagccatctcaaatactcagttccatcatcacaagctggggcatcatcatcaggagcagctaccctcttccgcatcaaactctccacaggtatggctttcctcttcctcccacctgcttgacgtggtcgttccccgtcaatttcttcgaaattagcctgcacataatgatgggaaaattataatcatcttaagggtttaacaagaagaagataccatcggtcagctatttcatagcagaattgttgtttgtgttacctgaacgtacacatgagcactagatttctcatggttgtcccttacatgcttgtacgaaaaactcttgccacacccagagaatccacatacaaagggtcgcttctgctcatggactgctttcacatgcttgtccagattggatttctgcagttcaaagtcccccccccccccccaaaaaaaaaaaattgaaaaggatggaacgatttgcaatttattggaaagaaataaaaaaattctgtgaaacagaatcaaccctgaaagattgaaatcctacctttgaaaatgacaacttgcagtccttgaggtggcatcgaaccctctcagtaacacaggaaccttcatgcattctctgatgacgtttgaagttcttcttcagctgtttggttccacagacatcacagacaacatgtcgatgacaagatttgttatgggccttgaggcattccaagttggtaaatgccttcatgcagcctggttcacagcagataacttcactataatccaacttgactgcacaagtaaaacaaggtatgtcacggcacaattaaccaattctcacttctcaacttctcacaggaagtaaaagcaggcatacagcgcatgcacagtataagtaaatcatgcatttgatctgaagagataaatgatctttaaaagaaacaggagtatcttgcaggatactttgaagagtttatatcagtattctagctcagaaatagaaaaagtcagagtgtcagatgacataaccagtctatatatgataaaattgatctaggagggttgctgagctatttaaagacagtaagaaaaatatggcacacaagtatctcaccatgtgattcctcatgcttctgtaacttagaagcatatttaaaagtcttcccacagttttcctcaggacagatgaactctttcttgctttcacaaggagagccatctttatgcatttcctgaacatgcctttggatattaccctttatagtgaacttacggttgcatccttccatggggcatgcaaatagctttccttgatgtgtaagtagatgccggttcaaatggtccttcctgctatagctgaaggggcaaccatctacatggcaggaaaagggcctctgcaaaagcatataccttaaatgttatactgaaagcagaactttatgatttacttgacataaaataagtaggtcaatgtacacacatatccattcagtgcaatatgctaaaactgttccgataatcacactactatgctgcaaatgagacagctgcatgaatagtcaaataccagtgacaaatatacatgtgtatcttgactgagtaattgcatctaagacaggatccttaagtagcttgagaataacaatatctcagtacgtacatatcactgtaagtaataacaacagttggaacaaaatcaagtcttagaatgagcaatttgaaatgaacaagcaaacctgaaaaagtgtgtgaacgaggcattcttgatggagcttctcaggagagtctccccatcctgatactagtccattcaaagccttcacgcattttggagttctttgggatccaatgcttcacgcagtcatatatagtctgccaaaatcaaaatatatcagaaaccacaataggccatgcactaatccaacgaaacagagagccaaatggcacctatacctatatacttgaattaactttcaaatgagtaattgttttggttgttgtgtagaatattcactgaacaggacagatacacgtcttttacactaaaggggaatacgaggagctggttattccatcacaagcatagctatctcttcagtgtacatgctctacctacttggttaactgtttgatcaaaagaccatcaagtggtgcttgcattagatacaaccaacagcgctacgcatgcagttcttcaacagtagacttgcgcgtaagaaaagatccttcaatagcttggaaaaactaagaatgcagcgcacgtaacaataacagcagtagcatagagcaagcagttttttgcaacagaagaaatcacctgaagaagagcgtgaaagaggcattcttgaaggagcttcccagaagggtctccccatcctggtactagtccactcaaggccttctcgcattttggagttctctgggatccaatgcttcacacatccatatgtaacaaaatagtgaaatagtctgcaaaaatcagcatagatcaacaaacctacccaaccaaaaaaggagtgaaacgacaactattaactgtccagggaaatttgctgtcaacacagcataactatcaccatccctagtccctacataggacagagcatctatcacagctattgcaagtaatactctgaacagagaaacacatagcatctatcacatgcgccaaagaacttgatcatttcagtgaacatgtatcgaaattcagatacctcaagtgaatggctctgcatgtgttgcctcaaatgggccggcttcttaaaactagcaccgcacaccttgcaatcatggtccatctctttgcacgtctcgccgccaccacgtcccaagtaatcatccaaatcatccacttcatcctaaaaacacaaatagcagcaccgacaaaaccaaacagtcaatcattcatccatccaagtaaccaaccaccgtggcgagcagccaaagcacggagaatatgaccactagacgcatctgaggttctgaactatgaagcgagagacgccatgagcgaccttatggtgttcgaggacgtgggcacggatcaaccccttcttggaacggacgacactgcagaaatcgcacttgtaccgcctaatatccctagcaggaggcgccgcccccttgctccccccctccccgccggcgacctccctttcctccgctccgagctccacgctccccatctctgaccaaaccaatcccccaaaattcgcgtcacaaaacacacataacgagcaaaatcacaaccaaatcaaccaaaatcaccgaaatccgcgctacacgcggcgtgaataagcagaggattacctctaattgcagaggaattcgctgaatcagcggctccgcgaggctccagatgttggcgacggcggcgcactgggagaaggagaaaccctcgactcgaaccaagcagtagaagcggtagtggagtaggcaagtcttagcgggttcgggtttgagaatgcgggtgccgggttcgggtaccaccttaaacccgcatgtgtgccctcattctcccctaccacagttccttcacgtgtgcccggggatggcaattttacccacgggtccgggtatccgcggatacctggcccgatgggcatgggcatgggtgtaatattttgcccgtgggcatgcccgcccgagacccgagaacatagcgagcagcggccgggtattattttttgcccgcggataatccatgccctactcgatacatatgtatttgctaattttggcccatctcttatgcctcataccctttcctcttggcccatttggcccactaaccagatacatatatatatatactcaactaatagaaaccctaacctaattccccactccttctcctacccaatccccacagcagctggcggcggtggcggtgcgagctattggcggctgcacggccgacggcggcggcgacgtgggctattggcgtcggtggcggctgcgctgccggcggcggcagcaacgcgggctagcggcagcggcgcggctggcggcggcgcataggagtaggcggcgcacggcttaggcggcgttacacgacggcggtggcggtgcacggcacagacggcgtcgcacgacggcggtggtggcgcacggcacaggcagggccgatgggtacccatcgggtatgcagtgcccgacgggcatgggcacgggcataggattttgcctgatagccctttcgggcatgggtcgggcatgggcacatgggtctcgggtcaggcatggaatcgctctacccgtgcccgacccgacccgttgccatccctacgtgtgccctcattagtgtggtgtgtttgagaaaaaaaaggggaatgctaggtgacgggataccgtcccccaacgggatagctcctctccacaacgcgattcttatccatatactcactggccgccgtcgctgtcccccgccgttgtcgcgcctgtccaccgttgcctccgccgccgccgccgcgcccatccccaaccgccgcagcgcccgtcccccgctactgccgccgtcgccgcgcccgtcctctgccaccgccatcgccgtcctcgtctacaagggacggctgcagggggcgaccgcgcgtgtcgaggtgctcctcccccaacgggatgcccagccatatctagtaggaatcacctgatacctggtaggtatcatccgatacctcgcaagtatcacgtgatacatggtagaaatcgtctgatacctcgcgagtatcacatgatacgtggtagaaatcgtctgatacatgataggtatcgcatgatacctcgtgagtatcacgcgatacgtggttgaaatcatctgatacctgacaggtttcacatgatacctcgcgagtatcacgcgatacgtggtagaaaatcgcatgatacctgataagtatcacatatgatacttgcaggtatcacctgaaacgtgtgtagaatcgtttgatacctgataggtatcacacctgatacctactcgagatcatcctgttgtgtagaatcgtctgatacctgataggtatcacacctgatacctactcgggatcatcttgttcgaaaacgggattccgttatatagcagcccaaaaaaatgaaaaacaagattgggaagatatgtaaaataaaatagagcacacatcttgaagtctatctgaaggacgaaaatttgagtgtaaacaaattttttttcacacgagtgatgtgtagcaaaaacaaaaaaaagtcgaaaatgctttcggacggatgtccggacactgtaaaatatcgaacgtcggctttatccaaacattctctaccacatgttcattcttctctctctttcttctcttgctgcttcaccagcattgttggctatctccaccacacgaatcattggtggccacacagtggtagcgacgggggcaagacgacacggggtagggggaggcactagagcttgctaggagccacacggcgatggaggcgatgcagcaacgccggcggggttctaatgctaaagcgattggtcctagtcgaggtcacctacctcgtgtcgttacttgtccgagggcagtgcccggagttgaagaagaagacggaggtgtcgggggacggtatcccggagttgaagaagaaaatggaggtgggtttcctcgggggtcggaaccggagttgaagaagaagaagacggaggtgggttttctcaggagccggcgactggagttgaagaagatggaggtgggtttgttttgttggagttttagggatgttgcatcctactattttagcttgttgcattctattgtattaaggtgtttcaatttgttttgatttgatgttgcatatattgaatcttcatgttacaatcaatatgtttcgattgcatttggttgaaacacttccgttgaagcgatgaaacaattttccttgattgatgaaacatctaaaactttttcagtgaaacatttttcatcgagcagtgcaacatgtgaaacattttacaataatacaatgcaacaccttcctagattgatgaaatatctgaaactttttcactgaatcatttctcattgaggagtgcaacatgtgaaacattttgcaacaatacagtgcaacaccgtccgatgttttgaaaaatatcaaatgtcctatttgtagcactcctaaaaaaagtatgtcccgactaaatgaaccaattctcagttctctacttctcacaggaagtaaatgcatgcatacaacgtgtgcaatgtataagtaaatcacgcattggatctaaaatatctttaatatatacaagggtatcttgtaggatactttgaagagtttatattagaaagagagagtcgagtgtcagatcacataacctagtctatacataataaaatttatctaggaaaagaaaaaaaacaatctgagttgctgagctatttagatacactcagaaaaatatcagaccctaatttctatcggcccctgaaatgtcaagaccggtcctagcaatgacgaagaggtggtgaaggttgtgtcaatggccttcgtcgccaataactcaccgttgctctagggcaagaggtcatccgacccgtgcggaggcaggtggcacggcgtgacatgtaaaagagctccaaggagcgtctcgcgttgtagggatcaacatctccgggacgaaactaaatggtacatttccagcaaccattggcgagttgaccatgttagttaaattgcaaatagtgtacagtggattgactggaccattgccttctctggcaaagctcgatcaacttcagtctctacgcatagaagggaacacctttgtagggcctgggcttgttccagccgatttcttcacttgtctcggtacaatgtcatacgtcagtctaggcaacaatccattttcatcctggtcctttctagactcacttcagcttgtggaacctcctctgataaacttcagcgttgatttatgcattctcaccgggcgcattccccaattcctagcaacatttgctcagctgacatatgtcccagacaaataataagcttacagggattgttccgttgtcattaggggttaccccttcatgtagtactttgcctccataaccaaaccctctctagcattatagagtttgccgccaacctaggaaatgttcaaactttaagacttgatggcaaaaatttcaatggtcgtcttctcgacttattaaatttgacggcggagctggaggaactatatcttaacaacaataggtacatgcgtatgtatatatgcaggtacgcttatatatacttgggttacgtatgcatcttggtccaacatatttttaggagctagctcaattgcctcgttaattgtgatgccatcaatgcaataggttcactgggcttgtgcctacgtcattgctaaaccttgggaagcttaccaaggttacgctttcggagaacctgcttcaggggcttgtgtcgtccttcccgtctagatttactgacatcgataatgctctattaaccaatagctgcctaccgcctaccgagtattggtgactgggttacactgtagttgctagctacaggctccgtggggttaccatagaggtttgtagttaaatggcaagtgaacgatccctgtgaaaatcgttgggatgagacatcatgtgacaaaagaggggtacactgtcgcagtggtaaaagtgcaaggtaacaaggagttgaacaacacgaacacctccagccacaataacaccggtcggtccaaatagtagcactgcaaagtgacagacaaggacgacaacgccacctgccggtgtggttctagccactacctgctgttgtggcaataatcggcaccatggggattgtagtcataggtgttctgatttaccgccggtggcacaagcctacgacaagggaggtggtcaaggtggagatgattcaggtgccctagaaccctccggctagtccagttctacaaatctctttcgagatcgtggaaagagccaccgggggttcagcgacgccaacttggtagtcaaggacgggtgcggcaaggtctacaagggcgtgctccccgtcgaaggcgactgcaagagcgtgtgtgcagttcgaagctgagcttgggtgtgctccggcaccctcgcatcgtgtcactgttgacgtattgcgtggagaaaattatggtgtatgagtatatgtcataggcggcgctatcaaatcacttgttccgttaggagtaatatggtctgtgaagagatgaaggagtgtgaagattgcatttggtgtagctgagggcgacgtctcacatccgctgggagggatagggcctgcgaagaggtgaaggagtgtgaagattgtagtgtgtgggtggaggggcaaatgcccccatgtggtgtggctgagggcgacgcctcacaaaaggagctcccctcacactcacacaatgttcagccataaactaattgttgttttgctacagtagaaacacgttctacatgaaaatgacagaaaatgacctgctcggaatggagttgcatcttcacacaggaaactgaaacaaaataccaattctcacaaggcctattagaaaaaaaaagtttcatgtaaaatactatgtcataaatatgcagtgtctatacatttgttgtcctccattggtggagatctaaactctacttttatgtgatattcttgagagcaaaaggttagaaaggggttcctacatcttctcctgctagtgccaaagacaggcctagcattattcatagttattcacatgaatacacatttttcattttttttataaaaagtatgtatatgcaatatatattacgtatgtgtataaggaaacaacaaaagtgccatattaaacattaaacatatgctatatattgtacctttagtgctatgtgatattatatatgccaaacatcaaacttttggcatttaatctttttcttacttttgaatacacaacttcaaaatcctaagtccacctctgctcacgcctttattattatgaaagagaaggaaacggctccgataaaaaagaagaagaagaagaaaatggacctggtgatccgctattagacgagaagataaaagatctagaccctatttaggggaacttgtagttctcagccgcagctggtgaaaagctaatcaagtcatcatatatatcctagctagctgcatatataattatatccatgcatacacatttgtcatgcctaaggagctagtattcactaagctgatcatcatcataacaatttcaaaagcaaaagctgattagctctgagtaggcagtacgtcctgcatacaactgtggtattgtttagttacgtgacgtactccgatcaaccgaactgcccagcggccgcttgttccacatggccagcggtggaggaaggttttgccacccagtgttgccgctgctcctcctcatctgcttggtggcggcggcaactgacggcaacaagtaagctactcacgctcgctcatcctcttgatatctctctttatatggttacaaacttacactctacactacatggttctccaagaaacgtcagtgttgatacatttccacctgtaattcgcctccaagataatttatataattaacagaatatacaatccatatttacatccaaaaatccccaaacatatgtacacatatttatatatgttgcatgctcaattgattttgctggaagaattaccatgcatgtatatatggacttcaatttcatctctacataacacgacttgcttatgtttattacttttttaagttatcatctattcaaagtacaatttatattgtacactaccagactagcctgtagaaaaataggatttaccatcagaaattatttttctatgagtgaaccgacaggaattgccgatagaaaaatcaagaaattcaattttcctatgggttccctacagaaaatcaatttctaacggttctttcatgtaggttaatgtcaatttttcgttaagtaggaccgtcacaaaaattagttttactgtaggacaactgcggggccatcagaaaatatcctcgcccacatgatagatcacaagtatggtagtggtacaagatttcaaattgtatgcatgataaacttattaggttatgggaaccaacgtgcgctccaattccttgtcttttacatccactacaccgcaacatagatatagaagcactcaatctgtcggtataaacatctattaatggcacattgtctgtcaggaaagagttttaccgatagtcattttgccatgagcgtctgctaggggttcagcagtcggcaaaagtttttaccgacagatatcctttttactggcagaagagtgccggcaattctttagttttcccaacagacaaataattactggcagacaaactattcatggcataaaatattagtcatggcagattgtctgccttcttataacactaccggcatatagttagatactaagaactacattagctttttttaaaagaccatataatatattgcatcgaatgtaccattgccaagtgcaccaattaaattaatgatcatgaaacaaacacatctatttatgaaagagaaaaattaatttattgttgatgactttatccttcacaaaatatatctgtttacaatcgaagaaatataggtcagatgcccacaccacaaacacccaatctagtctagagtgccacctgcaaacacaaaatagctacttctgatggctttgcatgtacaaaagacgatgaccatccttccagtagatttctccatccaaagcaagctatcctacatgcagttcttcaacaagatgtgaaacattgctagaattggttcagctatcaaccacatcccacctagaaaagatattacacataataagcacaagaggaatgttacatgatcattttgtaatactgaaagtaaaacaactatacataagaaaaagggtatttgttttttgagtaaatttcataaaactacacgttttgtggtccaagttatagaaaactatacacactttgacacttgacgtttaagtacatatattttggtagtatagtttcacaaatccacactatcaatgaatgtattcacccgtgatatgacatggctgttccacttaggacgaggatgtggcatcctattatcagtcattgcacgaaattaataggatgccacgttctcatcctaggtggaacaaccacgtcatcttataggtgaatccattcattgatagtgtagttttgtaaaaatacactaccaaaatatatgtacttaagtgccaagtgtcaaaatgtgtgtggttttctgtaacttggaccacaaaacatgtagttttgtgaaatttactcttgtttttttttaacagtgtagctttcttgtggtttgcagatcaaagataattgcaatagtagcattgatcaacttagttgcacattagagaagctagaaaaatctagactgtttagggagcttctagcaacttaagattctaaaagaagttgcagttgccagaaactccctcaaacaggccgctagtacatgttgctttataacaggagattctccttagactcatcagtagtagtaaacgagtatatgagtctgatgacgaaaaatccactcttggccgatggtgccagatctgtgttggcgcgaactaagtcgataaacacaacggcctaggagatctgcttagctctagtgcaggttcaaaatattgatgagatgcgggcgtgccagttagtttgatcctacaactgacaagatatataaataaaagggtcgatcggctcaaaagtcgatagagcgatattagccgatgccgatactagtggatgttgatagagttttgatcaatcagctatgtgtccaatatagagtttgacacttgatataagaaatgacataaagacaatcaacgatgacaatgtaataaaataacaatataattcaatcgaaaccccgatgaatgatacgatagagtgcgtgctaatgcgatggttaaagcatatatcggctggaggtccgatgtcattaaatccaaacgattagataaacagtgaaacctttattgcgatcagctcaatccaacttgtatgtaatccttataagccaatgcaatgtccagataactcattggctgaaaccccgatgaaacccttgttggcaatcaagaagcttgctggagattatggttccaagcacgacttagtagatcaaacttaactgatgtaatactaagtataaaaagaaacataatatctagacaatcaagcatttgattgattttcagggtggtagatacattatataatctaagccagcaaagaaatctagctaatattgacaaaaccctagatagagatcggtcgatgcaagtagaagacactgcgaatctatattatataatgtatatgataactcgacgtcttacatggacaagattagagtgtggaagcgatggaagcactaatcccaacaatgcaagccgccataacaagcctttatctctcgccggagattgaagccgatgcagcccaacttgaaacaagaactcgtcgaaaagtaaagtaaaaagggtggcgacgcatcgaagttgtattgatcgagagatagattaaaataaccgcatatgtacatatttatacccatagaccgacataagtccctataggacatgacatacaattttataaagataaaagaaaaacataaagtccttattgaaaactaaacacacttttttaaaattaaaaagaaactaaatgagctctgcctaattaatatatagaattaagccgccatgacatggtcttcatgattcctttctaaacttggcctcaatcagttgattgtgctttttacttaaccgaatctaccagataatcttatcaaatttttacattaacacttgacgggtttggttttcataatgcggaaatcggattcgggtctaaacccgcacgtgagcccccactctctccttccccttccaccccactcgtgtcgtgtggctgagcaccgtacgacgcctcccccgcccgcctctccccgacctcgtcgccggcgatggcctccgcctccaccgccgtggccagcgccaccgccgggaccacccgttccttcgagaagctatctgccccatggatgataggccggggacacgtggcgctccccccgtcgccggggcgttatcccgcggtcacggtggccgcggcgtcgcgtcgcaccggcgaaggtgggaggaggcggaggagagccaggggtgctgatcaggaggatggcctctccctcagctccggtgagttgcgtcgtcctcaccgtctcccactctccagcctctcctacctgactagctagctccatgtatccgtgctaattaagtatagtaccaattaaccttctagttgaaaccttgagcttggaattgttcgacgactcatagagagtcaaaggtgtgattagatgatttctaatcataaaacgcgcaacgattttgtttatacctcaccgagcatatatttatctgtggtgaaattaagttttctggttccccttatgtataactgtgagcagaaattgaggcaccaagttccactccccccgttcgcactaccgacaaggagagcacgaaacctgcatcagaaaccggaatcacaaagaaaggatcagccattagaagagttactttggtggttagtgtttgacgatataacgcttcatcagttgattttcagtgctgcgcttgattcagtaaattgaccttttgcaggtccttgctgcggttttcttcggcgttagcatcgccctgagggatggggttgggaaggcatctgaatattttgctgggtatgtgttatgcgtcacaactgaatttttatactgaaaaatgttttatggaactgtcagcatttacccatccaccagaacaattgtaggattcccgccggcactattatgttagcaaagccatctaggaaaagagttggtgaaaattaaaaatgtatgggctcattcattggtttgtgcaagttagtttgcccagttgcgattttgaacgtctcttacttgcttatttacaaatagttaaatgattatttctgaatttaactatgcttcttctttttgtcctcatctcctgtcttttaaattttatgtgtaacaatttgatatgtttctgttgtataacagatatttattggaacagagtttgtcagtagacaatctctttgtttttgttctggtcttcaagtattttaaagtgccacaggaataccaggtatgatttagtagttagtttggtatataatgcccatgtctatttcatccttttcttctcacatttttgtggtattcaaaacaagaaccgggtgctctcttatggtattgctggagcagtgatcttccgcacggtgatgatcaccctaggagcagctacgattcaggttgtttttttctcacatgttaacatcacttatcttcttagttctatgatcttgcagtaattcttcttaacttctcttttcctgtagaggtttgaagcagtgaacctattattggctttgatcctgctattcacttcatataaggtggatcgatcaatgcttcttttcttctattctccttttggtgtactaagttactttaccatgtttgaaatggacatatatgatgctattattgctcacccaatacttccttttatgagaatgacaagttctcactgtcattttacaaaaatctacctgttttatttcctgtgaaatttcagtcccatcactgtctctaacaacaatatactctaatactcaaccaatcctggactccaggtgcatgtattacattattaaaaaagtatttggcatataccttccatcagtcaatggctaacagcatgatgacttgcatcttttggggattcttgtttgttccagctatcttgttatagttcaacctagtccttccatcatttagtgagcactaagttgtcacacttcaaaaatattatgttttgcttaattgtaatgaatggcacctcaacatgttaggcaaagcttctttcgagtaacttcaagtgcattaaatataagtgatgtttacggatgctaatattcattcttaacatgatggcagttatttgctgaagaagatgaagaatctgatctatctgacaatttcatagtgaaaacatgccaaagattcattcctgtcactggtaattaacttcattcgatgattttcagtttctcttatgacattacatttatattatttggaacgaaaccaatctccactgtgagctccagatcatagccatactgaccagatactcactgaaattttttccacttccttcacaagtgaacttcttatgagtagaagttaatatacactcgcttgcagttgcggttaaactcactcttatgtttcttttgtcagattactacgatggtgatcggtttttcacaactcaagaaggtttatggaaagtaagtgtccgactgttgtccagtataagctggatcattatcacaagttcacagcagcttgtacacgcttgttagtactagacatgattgccttcttagtattagaaaactgacctgtctacatattaaagaatctgaagtatatctatttgtcagtacccttacaacttctgcttgtgcagaaaagattctaactacaatatagatgaaattgggttgaccattcaatacaataatctgacatcaagagctaccttttcctgaagatacattttcttttgttgttaatatctgcaggccacacctttgctgttgactgtggcagtgatcgaactaagtgatattgctttcgctgtaggttcctttgcaatctttttcctgtgcaaagtttcattttctattttatgatcacatgaatggggattgacatttctgatttatagattgactcaataccagcagtttttggtgtcacaagggatccacttatagtgttatcatcaaatatttttgctatttctggtaatccttctttcttttgtgtttatgaacacatcttacaacaatcctttctttttattcatagcacatatcagcacttaccaatgtaagaaattttacaagagaacttttaccactagctaggaacttcccgtgagcttgctatttatcaatgaatatttctgcagcctttacttttgttagcacctgcagcctgcattcattcagccagttgatgctcagagttagttttcacaattttgcagttatctgttccataaaagtactgtttcttgctgtaggtatttgggctgcattcagcttgattgtttcatataaaatttaaatatactagttatatatctggatattacagacgatggtctaatgtggcacacatgaccctattatgtcctctcgataacgccaactctaggtttctagcaatctttgatgtttatacctcagtttgcagacaagtgattgatttggtaattgagtaacttctaatgatgtaattgggtaaatgataaattgataataacatacatcatagttacatactgaaagttgaatgaagcatgaaagaagacattagatatcagctagttttgatgctatatattttatatgtcacacattttatgcactcttcacacattgttaagtgcttaccttgaaaaattactctataggtttgaggtcactctacgtactcatttctgaaagcatgtctgaattggactatttgcaggtacaaatccacttgctcttttaaatatagtagagttatttacctatttatgaatactgtggtgtacctaatacttatcaattcctttagctatttcatagttatacttaataaacaacttggcattcatcactattgatattcgttgtatagcagtgattactagcaggtgttactgaaccccatggacattagcatatatccatatatttctcaattatctacttcttgttcctcttattgctattggcttttttttttttgcagcctgcaattggtatagttttgggcttcatagggacaaagatggtctttgacttttttggtgagcaactagaaaccacattagtgcacgcaattgtcaatactttcttatatacattgcggttcaagctatgttttggtttctccattagcaacaccagatgacaatgttgatctgtggcaggttatcatataccaactgaagcttcgcttgctattgttaccacgtgtctaagtggtggagtaatattgagtcttaggaaagcatcaactgaagaaaaggacaagtagccggcttgctggagaggaggtaaaagggataaattaacttggtgtttctttcacaggtagtcatactacaacaaataaattgtatcaatcatttaataagctagaaaaaagtacatcttttttccgaatgttacttgtatgcctatgtcaaagaaccagaccgacgaaacatgtaataagtcatgtatgtaggattaattcagtctt

SEQ ID NO: 25599 - DNA, 16696 bp, Oryza sativa
caagcaatgtcaaattttattgcaacaaaacatatggtgtatagctgaccattatattttggttcgtttagctactgatccttattatgtggttatattaaactgttgtgattcgtgggtctgagagcattatctgaaatcccttgcaacatatgagttctctgcaagtgttcaacattttaaaaagaatggtacaatcatccagctgcttcgatatggggttcccgaaggttcagatttcaggatgctggaatcacatcatagaaaaagaccgcaacatcacaataacaattaataatagggcaatttgatccacgaaggttactagcgaaatgaccatactgaagaatgctgttattgtttacagtgaaagatgcagtcagcaataaccttatataggccgtgtttagtttcccccctattcccaactttctatcacatcatattacatcaaaaacttaaaacttttaattttttttctaaactcccaactttcttcaaacttccaacttttttcaggaactaaacacacccataaactgtcataacatatatcagattttggagctaattagaccaactttgagccaacgccatccacagcattaatcctaatttgcctatgtggatctcacttggcgcaacaccttcaactagacaaacagtacttcataaacatatataattactggcctagaaggtaaacagcctactacttggaacattacagcagtgactattaagttaacatcagcactaacatactattggacaagctgttggttagctcagtggggaaacacaagcactggtttcttcagcattcctcatcagaatctccatcaaagtactggcaccgagtgctactttgacctttctcgtagcctccttcagatgggtgcttgagctcattaacaccttggtttttgcatgcattgcaacaaccttcaggaacagaaaacatcaataataacagtggtcggaaaagaagagagcaatttgatttgatgtgaaccgtgtatcacgcagtggataacaataatactactactggtaaaaactaacgaaactaaggttcaatatatttagttaagaggaaaatagggactcaactcctcatcaagatccaaaaccaatgtgaaaaccatgtataactagactaaatgcaactaatactgctaacagacatgccttttctttcaaatacaaccaacaagagtaccaatttttgtgaggacataaaagtgatgatatggaaaattatatcctgatcatcctaatagcttacactatagggcctgcctacatctccaaatcaagtactcacaacgtacacctagttttatgttttcgaggcacggtttccaatagtgaggtaaacttcattgtatttacaatttctgctatgttaatcatgtatggatttggcttgcacaaaccatttagatgtattcagtacttcagtacacaagtcttactagttatttccgactatcttcttcatcatcagaaagacgaatcgcatattcaagtggggactttctattacttgctctaaggttagtgtagatatgatcaatacaaatcagatatacaacatgcatgagaaaacaacttaatactatttattcacatcgcaattatcatactcaagtatttatttgagcaatatgtcagtgaaacattcagtagcaaatcctacatgtattgtgcatcttaaaagatttttctattcttaaacgaggaaatcatatttcctttaccagcatcaagtggcaactgaaacccacaatagtgttataaatgtgtaatgataatcccaaatgaaagattcatggttcacatttttcactaatttaatccaaacagtggagtaattataagatgatgctttgctttagataaaaaaaaagaacggaataaaaagaagaccggtccctgctgaagttttggctaaagatgtgacacagagtacagtgttagattataaaagaacatgccatgagtacagtgttgtttgaacaataaagtttaagtagaaacaggcaagaacacataccatcatcagttgcctcaagtggagtgcaaaaataatacttgacgccatgcatcagctttgtttcagcaaaataaagcctagaggtccagcattcctcatccttattcttcatctcaacagtgaaattatagtggcaataaaccttcctatattccataacactaaagcagtggtgcaatatttcaccaaacttgtaatcaacttcctaaaaaaatcttaaaataagaaagagcgataacaatgataataagatgaaatatactagtaggttttatgcaaggtcgcaaacctcaaaagcatccttttctgcaatatagtttctgaacgctaagaatgcttcctcggtcaaatattgaagtccattcgcaattgtttctttccgagaacgttgcttcaccgggctcaccctactaaaaaaggcctttgctttcttgtctagcagatcgatgtactcatcagacatgcaatattccactggtttgtttaagctgtgtttcattccaaaaatagtctgttattgtaacaatcataaagtttagcacgctacaaatatcaaaccagaaacatatatacaaaacataacacttatttctgaacaaataatcattttttttggcttggaaatcaaagaaaaaatcatttataataatattagataatgatgacaaggagttcaatattttataatatatacttaaaatcgtaaataaaaaaacataactatcatttacaaatattaaattgtccgattatcagaataacaaaaacaatccaaatttccaaagatatattcgactcaagaatgagaaggaagagcatgaccagacatcttatggttacatttatagtatcaatagtttcttgcaagccattggagtcaagttaccagagcaaatagttgaaagttgaatggataattttttttatacatataaaagatcatgcaattaaaactatgttaacacattttacatgttcttgcatgagaatacatctagaccatgggtcaacataaatatagaagaaaattgtgttccaagagataaatcaaaaggactgtaatgtaactatagggaaattaccaaggaagacgtggcatttcagcctgttcttgttgtgatggtatttctgacaagtggccaacatcattagggtttggagtggcatattctttatcagtgtgttgaaaaggaccggcgtcacttggatgtagcactccctcaggctcctcgtcctcctcaaactcaatattcaacttcttgcatctgaaagaatcaataactttgtagaaatggtatcgaaaattgaaaagggaagcatctacttagtatttttcagaaacaaaatcgaccatgtcttgtaattatgacgacatagtttgtattggtgtgaaaaaagagcaattaatggggttaacgatatacttcatagaaacttcaactgtacctacaagaacaagacaacttgtcgtctttgtaaaacaacatagaaagtaatgatggatgaataaacagcgcagaagatgggagaacttagtgtgatattagcaaataagtccacatttgttggagaaggaatactacataaccagaaaatacaacataaataaacaagcaactttgtggtgcaaatacttgcaaaaggggtcttatacaatagagctattaaattttttttgtgtaaaagggtaaacaagtagtgtattagaaaccgcaccactgcatatataatttatgtacaaaagggtaaacaagtagtgtattagagaccgcaccgctggatatataatttacgaatgtatcgtgctacactgcgtccttgctcctccagctcagctttctttgccatctggtacatgattgaataattctgctgtgaggactgatgggttcctgcagatgattgggctctgaacctgaatagagaaacaacgttagcaattgagaatgcatttgtttgttaagcgcttgtaattaaaaaaaggaggaatgaatttcaattagaatagaaaaacgattacaagataatcattaatcagaacacatgtgaccagaagtcgaaacaatcagatcccaactgtttgtctcataaattaagaccttaaaaagaaccaccaaactgacgagtaatgacagaaagtatgacaagcaagattgatgaaacgcagaagtcccttctgtctcaatacccttggccaatgaactccagcggtttgtgggagagatctcatcggcatccatggtatactgacaagtcagtggcaatgaatgtgggtggggtgtcatggctgctagccaggtcaatgggtagggtgattcaagtggaaggggattgttggatcaggaagagagctcgtctggccatggtgtgccagcgcccagcagttagcgaggaggactgctaggtaggtccaaggggagaatatcaaggaaggaagcacaggatgagctcgactctcagcttagtcagcacataagacaatcattgtctctaattactactactatatgaggataaacttttggatactctatagttggccataaggcccgaggcccgaaggcccggcccacggcacgcctttttggcccgacccaagcacggcacggcccgacttgggtcgggcccgtgccggcccgacccgactgtcgggctgtgcctgggcctccccaccagcacgctgggctggcccggcacggtcgggccggcccggcacgatgggctggcaggccaggcccggtacacaaagtatagggactaaaaatagacatataaatgtcaatgtctaaagaatagggaccttaaatagacttattttagctatttatataccacagcacaaagaagagggaggtaaaatagacttttttttagctatacaatgtcacagcccaataggagggagaaaatttagacttattctgaggaaaagcacgatggcccatcgtgccttcgggccgtgcctgggctgtgagtgcggcacgtgggctggcacggcacggcccggtgcgtcgatcgggccgtgccggcccgacaagcctcggcccaggcacggccgggcctgggccgtgccgtgccgggcggcccacatggccatctataggatactcatggcacgcttttcaaactgctaaacggtacgtttcgtgcgaaaactttctatatgaaagttgctctaaaatatcaaattaatccatttttcaagtttgtaataattaaaactcaattaatcacacgttattactacctcgttttacgtgaaacacttaatctttatcttcatcttcatcttcaggagattcaaacaccacctatgtctacattgctactaatttggtttccagggacttattccaagtccctgtcacattggatgtttggacactaatttggagtattaaacatacactaattacaaaacccattccataagcttggactaattcgcgagacgaatcttttgagtctaattacgccatgattttgacaatgtgatgctacagtaaacttttgataattatggattaattaggcttaaaaaaatcgtctcgcgaattagctctcatttatgaaattagtttttttattagtctatgtttaatactctaaattagtgtccaaacatccgatgtgacatgggctaaaaagttttagccccatctaaacacccctaatgcaaaaggagagagtttctgtccaccagcacagagaaaactattcctgaagaaccaggacagaaaacccagaacacccatgtcttgtgtcttctctaccgctgcttccttgctgaaccgatagatgctgcccgtccatgccaaaacatctccctcccacaatctcccattaaagtccaattagaaattatgtatttggaagatgccatcctatttaatttagagttcattgtaatgataacaaaataataatactatataagacattttattagcaccacgtaaaaacattttctttagtttgtaaggtattccctcaatttcgtaatacagggcccgcctataattattcttttgcagttttttcaacatgtaatgccttataccaaagcttgttttaatgctatattatcaccattttatccctcaagtggtactactgttagttgttattgttgtggctaagcagtactactatagaaaagatagcaatgtcattttatccttttgtgttgtactgttgttagcttttaaaatttcttgatctatgtacccagctgatattgccatatattatgaaatggagggagtagaggatagaaacctagaacggtactttccattaattcagtctgttgctcttaagatgaaataaagttggtaataggcaaatagcaaaattagccaaaagcgcacatgatgaccttttaagaacatattccatgttctgcacattatgcacaagtcaaaatatgaagaataaacacatggaacaaatccttacaattgagacatctgatgaggtaacttgtcttgttcatgaaagccgacagtatcagccttgaccctaagcaaataccacacatcttaataaagttagcatgttgctgattcaaatcaatttaaaaagcatagcacgatattcaataatgaaaaggatgcttagtttgacagtaatatccacaatgttttcagcaggttatattatttgttcttttaccctaaaaagcatacagtttttttaataagttaaaagtattgtcctgacccctgatatatgagcacaattaatgcgagaaaaaaaacacttaagcctacagtaacaataagtcaacatgttagatgcagctcatggattggcaataccaaacaacaaagaatgcataattggactatgggagcagatgtaagcatgaataaaaatgagatgaatggtgcaggtgtacaatgcgcaattaccactgcaatctattctagcttagacatgggtacatgttaatctgttttggtatacaagcaagtgattgccaaagttaataaatgactggaatactcatgccgccataggagcaataaaaatgaggggacaagacatgacgcggtacattacttattgatgctctcttagataaatgcctgtgtaatgggactatgggagctggactaaactatcgggaacacgaggcaatcagtgtgacggttgtgagatacgaaggctgtgtttagatccaaacttacaacttttttcatcacatcaacttgtcatacacacaacttttcagtcacattgtaacaattttaacccaaactttcaactttggaaggaactaaacacagtcgaaacaatgaaggcaaaaccatgaaactaaaacatttagtatcctatatatctataattctatatatgaagttcatcctcactaactgtagttaatgttatttttctcatctctcattaagccacatcactttaattatttgtaatccttggatgattgatctatggtccaaattatctccctcattttctcctcttatgaaatcatatcacctcagttttgcctttagatgattaatctatattatctcccttatttcccttctctcattgagccacatcatcatagttttgcttttaaatgatcaatctatacataattcaaattgttataatcacatcatcttaactgtttattgtttttttttcaatagtcagtcaaagatgaaaattatataaagtcatctagctatcttacatgttatttctactattatcatacaaaattcccacaacaatgcgcagtagttattaataagatcatgccatcaagcacagcattttcgaaagtaaaaggcatagaaggtttcacacataaacaagattataacgcaagattgaaagcataggaaactgcaagcaacgttatcaaacatctaccacttccagcaggacaaaataaactaaggaagacatcatacatggttgaatcttcctcctttgactggcagatttctgcaggtggttgggatggtgtggtatcagcaccagagtcagacatttgttccactcgactgaacaaattttttaagaatgcatggtactagcaagcaaatttttttaattaaaaaaatgcgatatttttttattaaccaatatataaataattgatatagtgtactatgcagattgaaaagatactagttagtataactagagaaggcgattggatatactaattaacatagctattgtgaggtagaaatagtcatgagagccgattgctcatctggtgccttggtagaagaaactaagattatgcagaagtgtcctcaacatgcaagatttgcaagcgcagcagcgatgtgattgtagcccgtcgtacctctggttgtctaagcgccgcggcctcctccgatcctcctcatcatcagaaggtcgcaattgaatcagtggctccagaaccggagaagcgctcttccgggttctgctcggtggatggagctcctcggcttcgcgccgccggagaatgcgtatcatgctcgagacctctgttcttgggaagcggtgtgggcgtcggatttcttggtccaacatcggccgccgcgcccgtggatttgggggagaagggctcctgcgccaactgggctcggcatcatcgccggcgtccatggagtggaggggtgtccgacttgcgagaggtgagtagggctagcgttggcaattcgatcaagaggatggggagcttagtgccgtcggaaagggtttttggacacgaataaaaaaacttatttcatagctcgcctggaaaccgcaagactaatcttgtaaaaaaaactaattagccagattatctcgtgtaatcgaatgtacatgtgaacgtgagaacgtctatgtaatcgaatcgaatccaggatctgcttggaggagcttttgtggcaactatagcttttgctagtatcagaagcatctcagatagtttagaagctatatagttataaaagaaaataaataaaactaaaaatcttaagctctccaaacatgacctcgatccgtgtaggattccgcatccaactcccactattttaaacaaccggaaaaaaaagtacttcatttatctttacctatctatatatctatacctcccacaatgttagatttatacttcaagaatcagcgtcacagaaaaacacagagtaacaccagaaaaattaatagtaggacacttagctccacggagattactaacagacggaccatactgagaatactgttattgtttcacaacgtaagcttaaacgtgcaatgagcaaatacccttatatatacgactttgcaactggcatagcacatatctacagattttagagagctaatcgaaccagctttgtcgataagataatatagctaagtgacactaaatatgaaaccctgcccagtcaaagcctcagacctttgtgccatcaacatcagaagcaaaaacctggccataatcgcccttgtcatcctcatccagatagtcagaccttgcattgagagctagcatctggcaaacaagccagaagagagcagcatcaagggccaggaaagcggctcctccaaagaggccagtcttcgcagtagggcactgggtatccaggtcatggtggatgttgttgcttcggtgaagaccctcggtgaccgttgcccagagcaacattgcaaacgccagagctgagacaagcctgatttcacaagaatagatgatgaaaatgtatcaatggagttagcaggaaaacaaaatgcaatgtcgagattctcaaatatcagcagaattaagctagtcccactaaaaattttgaatacaggtaattcttttgatctgaaaaaaaaatgtgtcattggcacagcttagcattaatctatggaactgtacacgactaatagaactactaacacctttagggtccatctaaggcaatgattccacaaaacaaatatgtattttttttattaattaataattttgtagctaatcataatcaaatgaaggctcgatgaggtggatccgcatcaatgccagatactactgcttcaaatgcacatgaaattgttagctgcagatctgagaatcacttactcagcaataacgaagaacgcagataagctggcgcttcgaaataatgctccgcgaggaacagacttgctcttgtatggatagaagatagcggcatgccctacgatggtggttaacacaagtgacaccacggagaggcttcccattgcaatagttgggtcacttgggaacttgcagatgacaacatcctttcctttgataggagttccataaggaggctgcatcaaagaccaaataaaattcacaacaagtaacaattttcaaaagttcataaagagtggcagttgatgaaagatatagcgcagcagaagatgtgttactaccctgcactacagttaaagtgtatcgggaaattgcaccaagtggtcatcatagtgtctattgacaaaaccacagataagccttccataataattattattatttcttaaacggtactagtagaaacctttcaaagatgtgtacaagacaaaacatcattaacaggaacgagtattttagtcagtgaagtgatgcaccttcttgttttctgcgatgacaccaagtaagaaggagagaaggccaaagaaagagacagtgagagcaatccgttgagccgaagtgagagccatcgcacctgcatatgccaatttgagatcagacaaaatcagtaacacaaaaatggagttttaacagcatggcatcgagtaatttaatttcttcgcacgacaatgacacatctcgatccaggcaagcgaagctatcacaattcaaaagactaaaacaacatatttaatttttcaaaagtccccttgcgtcctcccattcgcttcatctactgacgcacgcaatcttaacaatccctctcaatcaggacgacacctcttctcctagcccgaattgggagggaatggagttagatcgaactcccaatccatcgcatcggccgatctattcctcctagcccactcccctaccagcatcaccccaccaccaccagccaagacccaacaagttcactaaaacagtggggattttccctcccggtggtgacgacagatcgtcaccaaactgagcacgacgaatctggggaaggggacgatggaggaggagagagattaccaaccaacaacggcagcagcaaggcgaggcgggcggaggagcaggaaaccctaggaggaggaggggatcgagcagatgggaaatcgcgtgctccactggaatcccttcttctctccgcgagctcggcgaaaggtagttaagttggtcaactcaactcctaactaaccgataggcttccccgatttatacggaagagatggtggttgggcctagtgggcccaaactaataacaacctgggcctagttgactaaagtgggcttgtaaggcccacaaccatagtaacagaaattgcatcgtccaaaaaggtctagaatatgcctcgtcacgcaataataacagctctaatcgcgaaaagatttgagcagccaatctatatctacatacaagctaattgttgacagttttgcttagtagtagttgcatggaaattgcaagtcgctgagaattctcaaggagcagttgatcgaatggatattatgccttcgaacgacatgatcgaagggttggtagagatgcaacggggttcggagttttaaactgctgacgttttgagacactcaatctgcaccgcgcagctttgatcgaacggttggtagagacccggtcgggttcggaaaaaaaggattgattaccagaccacttcagtcttcagataaaactccctcaatccaagatcaatacaccaccttcaacattgctggtttggtttcaggatttcatttacatgaaaagatgacagtgtaacacatactgcagagatatgttgcatctcatctcgtctgatctgatcaagacgatcacaagttcaccacgagatcgagagactaaccgaaaaaagaaaaaagaagaagacttcattgagccgtctcctgctcctcgcactctcctccctcctcgagctccatctggtgacacagacaacgcatgcaatccctttgggtcgccgaggatctgagaattttctgtcagctgcaagctgaagtcaatctgccacttcatttttcaaaatttcaggattaaaagagaaatgattgttagtcgtggacagcagctgcagaagtgccaattattctattcttcctttttttttaatttcctttttaagacagatggaattcagcggaggggatgatgtgcaaatttcagtaaaacagctgatcatctgggaggccgacgaggatcgtttgagggtaactagcatgtaatcaggacgtaacttgtacaattctatcatacatatgtggcttgcgggtttgatccccgcaaaaacatgtgtgaagttttcctctccctctcatgcacgaatttataagcacatctaacggggtttttttttataaaactggcgaatgttctacagcaattccgaagattttaatgacaataaaacaaatcaacaaaataatgatattacctttccttgagaaaaccatgagaaactttagttttttgttaatagaacttttgttggatccccgcttctgacatattcccaattgcataagttcatggaaaaaacaatctgactaaatggggaaaaaatgcacagccatgttactagcaaaagggaaaatcagggagttaattttaactccgctgggaacaatgacagccatgtgtgatcatcaacgtgataggtaacgattggagttagaaaagagtaccgtagattagtaatacctccgtcccaaaataagtacagccatagatatccgtgtccaacgtttgaccgtccgttttatttaaaaaatttgtgaaaaatttaaaaatatttagtcacacataaagtattattcatgttttatcatctaatagcaataaaaatactaatcataaaaaaatttaaataagacgaacggtcaaacgttgaacgtgaatagtgtaaaactacacttattttgggacggagagagtactaggttagccttgtgaatatgtatgcctaggaagaggacatgtcaaatcagaaaatcatcttcttgtacttctactactactacagtactacaatctacaccaaacaaaagaatttctaactaaattcgtcgtaattaagcaaaagttccggattgctactctagtttgagtgagtaggatcatgtgggtttaattatttttaattgcatttgtattattgtatatatcacttgtttttgcttttaagtgtcactattatacgtgaactgtttttatactttttatgccaccgcataagcgtaatatacacacaacacttcagcacaggtcatatgaaagagagcaaatcaagtagagttaattacgcgatatataaattaattagcacatgagcctgatctcgaatcctcgtcgaatctagggcagagtgggcaaatcattatgttacttaggtgctacaacattcttctcttttgctacctagcttgaaatgaaagaaggccagtgaagaaaaggtgttaggagtatcttgtttaattagttcctaagtacaaggttcacaggctgataggaatacaaaattagtatagtaatagtatacattattattttcgccttgtcattgatcccgaatcctggttagaatctcaatcttatgggctcaactattatcaaacttaagctacacctgacaacctttttccacaagaactaaacaaaaagttcgatttgcatctctcgctgttgttcgagtctggagacgggtgcacgcgtttatgaattcatcgtgccttatcttgataaaggggaagtgcttcacgtaatcacgttttagttttgtttatatcttgaggacagaggaaaaggatggctagaaaatcacaccgagagatgtttacggtttacccactagaactttggcaatttctttggatgagcatgaatttcagttcaattttctcaccattgaaggccatgcacaaatacacacacaataaagacacacaggaggtgggaaatcaaacataagtgctatacaatgcttaaggcctactttggaaccaaggaattttatggaaaattttcgtatgtagtcctttgaattatagggatatattccaaaaaatcgtataggatttctttgagtcctccgctttttaccagacaatcaatcaaagttaatgtttttcattttctttcagaagtccaaggtaaatatttctttatctatcctcttttatgtattctaataaagtgtgtaatttagaattcctatgattttctatcctaggccccctttgattcaaaggaaattcataggaattttagaggattttattcctataggaatttttcctacaaagccctttgaatcaaaggaataaaccttatggaatcctatgaaattccaatggaatgtctctttccatacaagttttggaggaattttaacaagaggtagaacctaatggaaaaaatcctttgagtcttttatctctcttcaaattcctgtgtttttcctgtggtccaatcaaacgatcattcctatgtttttcctgtgttttgcaatcctctgttttacacttacatttctgtcagaatcctatgtttttcctattcctctattttttcattcatgtgattcaaaggggccctaaattcacatgtttctatttcctgtaggattgagctaaccatgacactctatttcctgcatttccatattcttgtttctttttcaatccaacaatcccaaaggaacctaaaccagaatcttttttgaaacaaacaatgcttaaacgagaatcaaaccataaccaaattgagaagggcacccatcctaactactcttattaaactcagggtttatttgggagcttaaaattccgagaagcaactggttggtagctagcttctgagaatctgaagaagaagaagctgagaagattctaagaagcaactggttggtatttagcttctgagaatttaaagaagttgaggcttctagtccattttttgaattctacaatacaaattcttaaaatctggacgaaaagttatattgtttgggtgaagttctgatcctggcagaagctgtaggtaccagaaactctcgttcaagctcttagattcttactctctccgtcccaaaatatagcgatctaagatgtgatgagacccatcctaggactatgaacctggacataaggtatattgtaggatgggtatcctaggttgctatattttgggacctattataggttgctatattttgagaggtagtattaaactcaaggagataaatggggcaggtaaagaaatgggtttttgcacagcatgtgggagtgaggcacaaccaactgcacagtgcacacatacctatggccccattgggttaagagctgagctcgctctcactgttcaaagtttttagagctccctttcggaccaaagccaaaggctggtcaaacaagctacaattgccacccttgtgactgaatgaatgccatcatctcttctgcactgccttctctctgtaattaccaccatagagtatagtagtaagccactgtaagagcagatacaatagcaagctataagccagttataaccatatatcgagaagaaaagagaagagagagaagaaaacgggatacagatttatagccagctgtaacacaaactctaagacgttatgtgtgtatgaaaggtatgaccgggtattaatgatgtatatttttatagttaactattatatgaataggctattagattagctatagataatttggagccagtagttggctatactattaaatttgctctaacaacaactactagctggagttgtactagggtagtagtaagagccaatcatcttcttgagtgagataaagagagagaggggaaaaaaaggagagcagatgatcatatctgtccagcattttatgtggtgattaaaaagaagggaaatgctgagcctatcaatgatgctggcttggttggtgtgttggtaggctttggaaaagagaagcttattggagtattactagtattttttttagaagcaaaagagggagattatatattactgtacccaatggggttgggtgtgagtgttactgctggtcagttactacttccacagccattgaagtcttttgttgactgcttttatcctgcatcgttagctttgcttgttgctccggcctacgagcactctactccttttcttttttctttattttaattttttttctttggggtttgcagaacagaacggaaaccaaacctgcgttgaattgaatggcgacgttccaaggcgttgttgcgtttgtgtctggattctgcagagcggatatgacttttcagctggaacattttacttcttcccctgcttctgcttcctgcatgcatgagcaaaagattctgaaatctgaacaaccaagttactactgtacttatgttagttcaaatcagagaatttcattctatatatggagtttatcctgaagctgaaacgctgaatatgaaatgaacctccttgtta

SEQ ID NO: 25600 - DNA, 1260 bp, Oryza sativa
attagtttacccatggaaatcattgaaatgctgaaggaacaatagaagagttcttcagaaatgacctactttttttcctcttggagcaaaccatacatatatgctgatgaatgtgccttcaaatagcaccccaagtgagctgatgctgcagactgtcatgttctcccacccatagctcaccacaggaaaaccataccaactgtatgtgaggcagctgaacaaagctaagatatatggtatgcacgagaattcttctacactggccttctttatcactcttttaaatgtcaatctaggaaacatagtaaaaacaagtgtcaagcaatgcattatatactgcgcaaacatagtatagcttatgatgtatagacatgtagttgggtacattggtgctgagtagaggagcatgcaagctacagatcctgcaggagaaagagtatggtgttatgaacataaagaaattaatcgaagtagcttgtgggtgcaaatacctataattcccacaataaaacgtatatcaggaaacattcttttgtgctgattgatgaagctattttgttgcccctggaactagatttttggatagttcattgtttacaatatgggcaggctatttataatgtgcaatggctgtttaatgtgggaatgtcgagatattgctcaaaccactaaggtagaatatctgtttttttttgttgctatgagatttaacacagtttttttgcaaacatggagtaatgctggtattctctttcatgttattaccagcatctaactattttattgcacctatgtacctatgataataatataagtttcatgttaattttgaatctggtccgtcactggagtaggaactagcgaactagccaatcagtatctattgtacttgcaacatagttagatgtgaatatggtactcaacttctagattttaattgactacgaagatacggaacagcagggttggaaatttcggtcatttcggtcccctccgaaacgatattaatttggctgaaatttttgaatttttcaattttttcatgaatttgggtaatatttgttcaaattcaactaaattttgttcaaaatttcagaaattttggaccgaaatttcgggatttcggagacccccgatcaaaagccctaaaccgatatagtgaaccctgcggaacagcattagcaaaaatattagcttagaatcgttgctcttggatggcacttctgatgcacgatgaaaagcaaacatgaaaacaatcaa

SEQ ID NO: 25601 - DNA, 8886 bp, Oryza sativa
atatattttttaacatgtggtcattctgatgcggctagttagctctattctctctaaattaagttggttctattgagttgacgttactaattttcttctgaatcttctaaagcactattaacaaacttttctgttataggtacatgtcccctccttcaatctgagtgctgcccctcctccaattgttcagttcgacctcaccacaatcctgtgagttatttgtcatctactggcagcgcatttcttagcaaacacatggtgaccaaccctctcaggttcttttgttctggtaccaaaatagatgggatgtctgattctgcgtggggctactgaattcacctgtccagaacttttgcctgagatggaacatggcctcgtttgctccaatattgtgtggaggaataagttaatgtggccatgtttctcctgttaatttgggaataagtcctttggttgatattaactgcaaagacaacatgacaacccacagaataaagcttgtagaatcaactaacaaagtttgtctgccatcaaatattgttggctattttttttgttcattggtgcaaacatacctaatcatttatttggtcagcatttatttgacttattacaacttcatgcatatgagtcacaccatgcaatgtgcacttcaagagatttgaattacggatatggcaaacgaaagtagtatttggaagtttaaacacctatgatgcacttatattgcaatcattacttccactgagtataaactgactgttaaacttggatgtctaagctatttacctttccacagtatgcattgaagcaggagaggcaatctgcaggcaaccactacatatagtaagggatacaggcaagttccatcttaatttttaatccctcttttgcaacttataaggatctgaaacttttttgtcttattggtgtcctttttatacaattaagaatgctgtgaattatgaccactccttttgtgttccattagtgcagcctttctggcaccaatcgtgctgaaactatttagcactctcatatctttagttttacagcccatcattccataaactacattagttgtctggtggaaagctagattaactgtatacaagcatgactgattagctttagaggcgctagttttggtaaaatatttgagacaatctaccatgcttgcttgaatgtgttgctttcaacaccattaggaaaccatatgactggttaagttaaaaacctggtcaactctagggaataacttgccaacagacaactgatcctggtgaaggatccacgtggctgcctgggagtccgttaatctaaaaaagaaattccttttgttggctggctcaatggaacattgtcgtcccatgatatgatggtgatcaccatgatcaactaattaatgatgtgaaaccaccgaaggaaactatgaagtgaattagagcaatgagcaatctcgatgcgtagtgtcataggcagtgtctagatgagagagcacattaaatattaatttaaacctaacctccccaatacatagtttcttcatgttttttttctataaaaatagatataacaaacatttgtgtaggggtcaccgcatttctataggaggccatgacaagaaaactactagcatgtcattgtgcagttttcttgagtcgtcatattttactctcattagctcaggcgccacatcaaatttttagcttatgtggcagcataattaaatctatggaaactatcctacctagagcactggagcactaggactgcccttatagattactcgtttaggattcacccttcttttaaaaacaaatgttaagagatggccgaattcattaattaatatacaaagtttcaagttaaagttatatttttcgctcattactaagtccggttagtgctggagtagatatacttagttttgttgttatgttagttgatttacattgcagttcgtggaagctttgtccgtgatcgaaattgttgcttctgtacggtagccgtgatcaagaggaatatgacattatcttacagagcatcagtgatctataaatttccaggacaaactgatctagcacagaatgaagcagcagagaaaccaaaaatgagatatttggagcctccacccggagcggaccaccagagagatggcggagtcggcgaaagatggaggtcgcggtggacatcaccaccattaatgggaaggtcgatgtctcaggcttgcggttgcagctgagaaacctcacagagttttcagctgtgaccacatttgattgattgaagtgctaaggactaaggtaacgtgatttctgcaataacgctttggaattttgggtcgctgccgaggttcttcaaacccgaatactctgttcacagttctgagattatatttctttttcctagtatatattgcggttgtgatattcttctctcgatgtttgcaaaaaaaaaacagagaaggaaaataaataactttcttcttctgatgttatagctgcacgctatttgtttgaatgaaatagctgagtggacagctacgtgacatggtccgtatgtgcataagtttcataaatatttgaaacctcttccaaggttatatagtcatatggaattcttttttaatataaagcaactatattgttgttggaccattcattgtgttggcggatggcattgtgttgacggatggcatgaggcccttcgaccaaatctgccgaaacccgtggcgaaggctatggagcaagaacggcgtgaggcgaagagtcgtacgagtgtcttgccaggccagaggcgtctcaggcgaagggtgcaaggcgaagactatctgccgaaggaagacgacttcgccatggcaagttcgcccccgcgagggccgaggaagcctttccggcccaacaagcttaggggctatagggctagcgatcgccagacggcccatcaggggcccatgagcccctataacattatgtacccctgtaaatgtccctttcgtaagggtaatcatgtaaattcccctgtacaacctaaaccctaatagtaaaaacctgtaatggggctattaatagtctcctagggccatgtaatggggggaggggaaaaaaagaaagaaaacaattcaaaattcaatacacttcgtttccttccaaccactgttgagtaaccacgtctttcgacgtatgcagttgtcatttcgacaacagctggcgccgaccgtggggacctccgagcgaaaccactgagagcgaatgctaccgaagagggtcgtgaaggagaaggttgccaggcgaaaggaaagcgacgccggaccggacatggccgccgaggaaggagcagagccttcggcgcccgtggccgaagatggaggaggacaagcgccatcacaaccgccttcggcccctgcaacctttgtgcaagagccgaacgcggccgacgtggcgaaggcggctgcggcggcaagggcactccagaccagggcggagatcctttcgacaggccaactggtggtgccccaagccgctccatcgcagccggcagcggccccaactgcgctcgccgttgtgcaggcccaggtcagccctgaccccgaaacacaagccgaagccgacatggaagccatgcgatagaacatgacatggctccaagacatgcttcgccaaatgcaagaacaacaacaagcatacgaggcggcaaggcgggccaaggccacgtcggctccaatccttcagtattcggcaggttatgtcccacctcaagtccatccgcaagtgacgacccagccctttccgccacaagccacacaggcgccggtgtacttcgccgggcagcaatcggccgcagcagtgcatccggcccctcacgtgcaacagcaagctcaaccagtcgctgcccaagtacaccatcaaccacctggccaagcgccacaaacagtggcggaaggggcttcggctctgcaggcgcaacttcaagctttccttcagcaactcaaccaaccccactgcatttcaagtacaatcccatcggcccacccggaggggaatacaagtcaaggtgcgcctaattggttgccaccgattcagccgggcctgggagtttcgccgtggaatcaaggaccgcagctcgacttcgtcaacgctgctcaggcgccaaccgttcggcagcaagctccaactccaggcttcggaacaaaccaagcaccaatccaagctgccatgacgtggtcgcagccaatttttgacccatccatggcggctcagcaagtacctccagttggagccgggcagtcgaatgccacggcccaacctcacgcacaagctgcgattttgcccttcgccacaccgtacccgcagcaaggtgcggtaaacagggcgggaggcgaaaaggggctaccgctgagtgggggaatcaagactcgtccaatcccaccccagttcaagttcccacccgtcctgcgctattcaggcgaagttgacccgaaggagttcctctccatctacgagtcagcgatcaaagcggctcatggtgacgaaaataccaaggcaaaggtaatacatctcgctctagacggcatcgcccgttcttggtatttcaatttaccagccaatagcatttactcatgggagcaattgcgcgatgtttttgtccttaactttcgaggcacctatgaggagccgaagacgcagcaacaccttctcggcattcgccaaaggccgggggagtcgataagggagtacatgcatcgcttctcgcaagcccggtgccaagttcaagacataaccgaggcgtcggttataaacgccgcttcggccggtctgctcgagggcgaactcacaagaaaaatcgccaacaaggagccacagacgctcgagcacctacttcgcatcattgacgggttcgcaagaggcgaggaggattccaagcgacgacaagctatacaagctgagtacgacaaagcctccgtcgccgctgctcaagctcaagcaaaagttcaagttaccgaaccacctcccctctctgttcgccagcctcagccggcgatccaaggacagccgccaaggcaaggccaagctcccatgacttggagaaagttcagaatagaccgggcgggcaaggctgtgatagctgtcgaagaagtgcaagctctccgcaaggagttcgtcctattctttcgtgatgatttgtttttttaaaaaaaaaatcttaaggttcatgattgggtagggttagccccttttagttcaacaagttcagattctcagcaacggcacagtgtttttaggaacaaactcccaaatctagcacaatatgatgttttcaaacagcaggaaaccagtaagtgcagaaaaagtatatgcatctctggacgaaacggacactacgatggttttaaacatataccatgtgatgttgcaaaccactgaaatcccagactgaccttgaacactcaagaatgacatcaccacctcttcctccattaccacctgcatatttcacataaggaggatctgttctggctccattgtttaagaatcatgaaaaagaaaatcctgactgactgccgaattggaccaaatagcatgaattaaagccatgacagcatccctctaaatcaggtaactattctctccctaatcaatttcctacaaaatactttacacctcatagatcgatactgtttatttcaatctgtcatgatgtatgcctacacttatctccactcaccctactttatatggcgccaagctttttcatgttcccaggagtttgtatggcaccaaactgttcacctgagcaaatggtccaataatgaatatatgatatgatttttttgctttgtcatggtacgttgctaaccttctggtgcagttttctcattaagatattttgtgcagtgaagaaatgcatgtttgtgttgtaagatgcttttaaatttattttacaaatggaatgtatgaactacgaacaagtcaataatagtgtactgttaagtattgattatattttttattttaaaagttcagcgtgttaaatgaggtttcaaagatgctatgaaatttattgtgttatatgaaatatgttgccgcaacaatcctaagatatcaatatgcgtgtcatctaggtgcacttggctgataagctgttggagttgtccatatcctccaggaaaatgtgttgatgggttatgcggggtctggtacatttagacatgcggaagttctgatagtaaatgtatggagagatttaagatttatcagatgtatttgtatgcaaattgtggataaagaattgtcagatattcccttttggagaagaaatgagacagttcaggttataatgttataatatcggtgcatataccttttgtgcaaacattcaaataatttaccgtttgtgcatatgcataagatgcaattaattagtccatctaaatttactactcccttatacaaaaattaaaagttatatgatttttgaattattttgtattggtggcgtgcgtttgaccataattttatatttttcaacaagttcataaaatactataaatttaagaatatggaattattgttttaaggctaaatatgtgttgatcctttagcattcacataagaacatatacttcatatctttgcttggatatttgtatttttagacatatattttgatttgtattatcaaaaacagccgtagcgttagcacgagcagattactagtttggaattagtttgatttcttagatatatatgagatagagtaaaaattaactaagcgacaataatcggtagcttttgtgataacttagataaatgaaaacttgcaaaaaaatctaagctcaaaataacatctcaaaagagacttggctttgacgcataatgggccaacaagtaaaaacatattaatgtgctagaatacagaatgttttattcggtcaattatgtaaatgtttcacatgccgtactattaattagcaagtcttccatataattaacatttcttggagaaggcaagagccaactcttcgggaaaataaacgtgctagttggcatgctctctgtatggcttctataattgctaagggtaattaatgctaatattttgctagactttataggaattagctcaatttttcattgaattcctgtgaagatcgtgcacttttaagatattcacaatggaagcacatatgtttcatgattcacgataatcttattgtacccatggtagattttgtatgtcagctctctacctcttctatttaagtcttcttattttattaatgagtaaattgcgccagcgggtacaaaaattggcaggtgggtgtgatttagtgtaaaaaccttgtaaaataagcaaactggtacataaacttaacaatcatgtgcattttgataaaaacacggttacatacctatggttcatcgtattttattggttgtatttgtaaacatgactgctagattaattgttggcaatgagtatgttttacagtgctcatcaccgaatttgtatgatcagatggatcgcttggaaattttgttagttggcatgcacttagttttgataatcattatttttctaattttaaataataggttattttagtatttataaccaagcaaatgcaatacatctaaaaccttattcggaactcaagatgacctaactggctgctttttctttatatagctgaaaaagtatggtgtggaagagagatattttaaccaaaatgcacgtactaaccaagttgttacatctatataatcatttttcaaattcttgcactagatcgtacccacttactaagtttgggtactgtagacgcaatttactttttattaattaatattcctcagtgttttacgcttacttaaccatagagtaagaaacattaattacataggcacctatgagcccacttcacgatataatttactccctccatctctaaataaccgctcattttggtttaaaatttgtcccaaattaactactccctttgtcccaaaatataacaacttctagcctctagaatttatcccaaaatataacagtttctacaccaacattctctttttaaccaatcacaaccctccaccattcaaattttccacctacctccactttttatccaatcacaacccttctctatttaattctacatatttttttaataacattgtcgaactctaaaaatgcttatattctcggacggatggaattactcttagggtgtatttgagtgaagagaagaatgataagatacataaaatgagataaattattagcatatgattaataagtactaattattttaaacctgaaaaatagattaatatgtttttaagatattttttctataaaatttcttttagagtaaattttattttggaccatctttattgcttatgtttcgcttttgatcaccttttagccaatgtttttattttagactgggtaatcttgcctgtgttactctcttctcatgcatatgaatgacctcgagtacccctgttcttattcgtcaataatcagttatatgtagaccatttatatgatatatgacaatttagatgtagatggataaaacaactgacggtgttacaaaatgctactccagtataaaggtaaaataacccgatcaaaagtgtaaaaaaatagttaaagggtgatgcaaagcgaaacaacgccgataaaaagtggcccaaagtgatttactcttcttttcatttacgaaaaaaaacacacggtttatcattttgcttatcgtatgaaccatacataagaaaattaattatatagacaccatgtaggcccactttgcattctacagccccatcgttttgcttattcgttgaataaacgaaatggcatatttgcaaa

SEQ ID NO: 25602 - DNA, 3241 bp, Oryza sativa
tttgtcacaccatcgaacacaaattaaggtccttattggtggtcaatattctctaataagtaaaaaaaaacttatttagaaataaaaattaatctatagctaaaacatttatatatatgtattgctagcgacttaaaattcaatactgaaatagaaattacattgaaaatatttttaaaatcaactttaaaattcagtttgaaaatttaaattttagttttaacttattagggcaaccgataggatttagttcccaaaaacttttcacaaaaatatccaatcgaatctttggacatatgtatggagtactaaatatagataagagtaaattgcacccacggtataacaacttggcaggtgagtgcgatatagtgaaagaacttgagaattgagcgtccgagtgcaacaacttgacaagtaggtgcgttctagtacaagaacttgacaatttgtatttttgtgcatcaacttggctaggcatatgctaggtgagttttttttttcccgatgttgtgcatcaacttggctaggcatatgctaggtgagtttttttttcccgatgtcaataatgccactacatagtaatcctacggatattaccttagatattaaatttaatctttaataattatattgcacatacaatttacattcaattaccttaagatttttttcgttttctttaccttctcaaatatcaaccgaaataataatttttacatccagtttaattgacttcaagttattaattattataataaaaatataaatatgcttatacaaatccacactagtatattgtcaaaataattacttaaattgaatctatatagaaaatgctccaaataattaagttgtcgcataatttcttagtttattgtattaaaatcgtacctaccttgcaagttgttacatttatacgatcacttataaagttcttatactaaattacacatatttgccaagttgttgccactagaatgctcatttctcaagttcttgcaccaaattacacccacctgccaagttgatgcaccgtgggtgcaatttactctatagataaaaagaaaaattaattgcacagtttgcatgtaaatcgtaaaacgaatcttttgagtctaattaattagccataaaagtactacagtaacccatatgtgctaatgacggcttaattaggctcaaaagattcgtctcgtggtttctagacgagttatgaaattagtttttttcatccgtgtcaaaaaaaaccccttctaacatccggttaaacgtctgacgtaacataaaaaaaaattatttcaccaactaaacagatcctaagtcacatagggggcatttgatacgcatttttttttgtttaggtagtactccctccttccctaaatatttgacgccgttgacttttttaaacatgtttaaccgttcatcttattaaaaacttctgtgaaatctgtaaagctatatgtatacataaaagtatttttaacaataaattaaatgataggaaaataattaataattacttaaattttttgaataagacaaacggtcaaatatttttaaaaaagtcaacggcgtcaaacattttgggatggagggagtactctactagtatttctctatgttttagtgcagccttacagcgaacagttagaaataaaaaaaaagaacaaaaaagcagacgagaatagtagtagtactactagcgcgtaggaaaggaaagtgcagctttcccgcgagcccatgaccactcgtttcccagttcccacatccacttccacgcgagcgcggagagcagtgtgagcagtgcgcagcgaagatggctatagagtagagaccgcgaccatttaggagcgcgtgcgcggcggacacaggggccggtgggagcgacctccggcggcgcaggatggaggcgaggatggcatcgagggcaaggcccaaatcccaccgacgagcaaacccccgctgctcgactgctccatccgtcgctcagcctcaacatccagatcgtcgagctcagttttctctctcccccgtccctctctctcgcctcaccttagcagcgcatatctaatcggagcaggccgcatagatgcaggcgccagcggcgtggatcgaggcagggcggccgcacggtgagtacgaggttttttgttgcgatttttttctccaataatccggactcttccagataaggtcacacgttttgtaaaaaacccctcttgaaaattgcaatttacatttagatccgccagatgatttttgaccgtcgatgtaccatctaacggctgtgggaggggtgcgaaacgtggcgcattcttcagccgagaatgccgatggagctcaacacgcgatgccacgtggcccaatgggatgcttgggatcggaccctgaaatcgatttataagatatggcacggccccaaaaagagtaaggaaaaatagacttattgtagctatgtataagacgcggttcaaagatgagggacacaaaatagacttattgttatcccacccaaagaggagggaggtgaaatagacttatctcaaagaagcacaagctgccgacctgccgtgccttcgggccggcccggcacaacccgacttgggcggcaagggggctgcatgtaaattttcgccatcctcggtggccagctgtaaagcgagggccaacgaccatctgccacgtcggataaatcgtccactagactcccagagggcaatggggactagatttgtaaatttttcaaatagaaaattatttttgtaaatattttaatagatatgaaaaagtccaaatacccccctaaactttagatagaagtccgtctagaaccctaaactttaaaaccggacatccaaccccctaaacattacaaaaccgttcaaattaccccctacggtggttttggatggtgtttttgcatattttaaaagtttaaatgaacagctttaaataactaatataacatatttgcatatcatcagttgtaagtcattaatttatacttatacagggatattgtcgacggggatacccgtagaccggatatagatgatagtggggtccattgatacgaggatctacgtaatacgacatcaagcaaacagaatacaaggattatactggtttaggcacccttggaaggtaatagccctaatccagttggtatgggattatatgatagaaaccaccgattaccaaagggaatagcagaactcgatgatactgacgagag

SEQ ID NO: 25603 - DNA, 15630 bp, Oryza sativa
  unsure (1)..(15630): unsure at all n locations
tgttggcagcaatattcgataccttaggtcctgtccagggggtcccttatataccgcgggtcagttgatctccaagtaggactcgaagatatcgaacccctcacgatatggtaaagacccagtctcgtccgagtaggactcctcccatccgtatattttgtttctatcacgtgatagatttcctcatcgtatatggaaactatccgtatacgcgcgggtatgccatatcgatacccaccgtacatccaaggatagagagtataccttatccataaccctgacagatatcatactattattatgttggtacttgtttgtaagtgagagctaacaactagtaaaagaaagatttaagtgaagattttaatacatatgtccaatgtgtatgttacgtgatcaaactcatccaatttatatacaaattagataaaaaccactgtacaaaaccaccttagggggtaatacgtacggttttacaaagtttagggagttgggtgtccggttttaaaattcagggtgctagacagatttatatctaaagtttagagggtatttagactttttcctaataaataaaaataaaaaattctacgaaatacgaatcagcagcaagcggcaacggtgaaaacaaatcgtaagtactagcccagcatgggattggcccttccaacatttcatcttcctaggctcttgggtctgttaattatttcctcagtttcaggttataaaataggattgtccatattcatatactttctccgtttcataatgtaagttgttctaacattttctgtatttatatttatgtcaatgaatttagatagatatatatgtctatattcattaacatcaatatggatatgggaaatgctagaatgacttacattgtaaaacggaggaagtatgtgttaatgaatctagacatatatgtgtctagatatatgtctagatttattaacatctatataaatttaggcaatactaaaatatcttataacctaaaacgaggtagtggttgctaattaagtatacacaattagtactaagtgtagattttggggtcctaatttttgggggccctgagcatgtgcacatgttgcaccggcctatgcatgggcctgtatagtacagtagtagatctcgggaactttttaagtatttttgacaaacgaaatatgtggaatctaatttagtgcgttcatatgaaatcttctagtcattacgaactgaaaaaaaagttaaaaatgtgagtgaaagtaagcaggcaagttctaaacaacagtggtcaaaacataggcctactaatgggcttggatgtctggcccaggatgttgggcccagccagcccaagtatgcaaaatatgactagttcactttagatcagattcaggccatgatagtatactttctatacaggtggtatccactgacttctaaaactcaacatgtaacataatgtaagtataccacatcattacccactagcaattattatctagaatattttagatctcatgaaaacatgacatatcatatcatttgtaattttattgtatttttagaactcagcatgcaagcaatatcaattcactatcttcacatcattttcacattatttaaacatatacgtctatcattttaataatgtataccatacattcatccatatatcccatagcaaaacgcggggtatcaagtagttttcttattagaacaagtttaatagtatagccaactattggcttcaaatcatctatagtcaatttaatagccatttatataatagttacctataaatatatactacataattaatgtctagtctcacttatcatacacacatgtatcttgaagtctgtgctgcagttggctacaaatctatagcccgctgctcttatctctcatcttttatctccttaaaatatatttatagctagcttatagtctactattgtacctgctcccattgattgaagtccacacaactacttttttattacttgataaatccacacacacatcatactccataaatgcaagtacactccctttaacatatttcggaggaggcatgcatcgttgtatccataaatctcacttaatttataatgcaagtgtatcggcgtgcaaaatttgtaggcaccatagtttaagttttgatgggtaaattcatgcatacacaactccctcacaacaccctctagtacttcccctacatgttctgtattttggtgtgtagtgttcttctcctacggcctattggtgctttggtgctggaaatggtgatgcctagcaggaaatctggacaatttgtttaactagtcagcaccccacgcgttgtgccggggaaaaaggagatctaaatttaattcacatccaagtatttcaaattggcatatggtaaggtctatntgaattatgtaaattgagaaagaaaaacggacaccaaatattaagcatggcacatgaaaattcgtaggcaacagtaatgtttcatgaaaccggaaggtacaccagttcttcaattctacacttatgcaacattctaactaatgtttctcaaatgctataccacaaagaaagattgaagcaagagtaggtccacctacttaaaccatagcccatatatatagcccatatatatagctgcatacgtgcgattgagtttgaaataatgaaactacaactgtttttccttctattactgtcaggtcggcaaaagggaaataacatggctaatgaaaagtagtgttttctgaaaaggatagtttccaatggaatctgtacaaatattattatgcaaaggattgttttctggaagtaaagaaaccggtcaggacacatgtaaatagatgcatcaagacacgatacgtcttagaaaggtttgtctattagctcttgaataaaaagtgaagaatgtgtttgatagaaatgattttgcaggcggattgttcttcatgtacctgtggaaaacagaactggttagacatgtcaaaaatgccacaaaaattagcttacaacagaacatgggaacaaccattttttttatggacactggcatttgaccattacaatttgtggagcaaatcaacacatgaaaaatctctatgatcaaataaattcatatgaaatatacatgaaaccaagaatgcaggttgtaaggtgaacaaatgcacatgtgcccaagaatacagtataacaccgccacaaaaattttccctatatcagaaagcctaaaggtacactgcaacagtaaagagagaataactctaggcattatgttgatacacattcgggtccagctgaatcatctaggcaaataaaaagaatacacagctcattgttatcagttgtaaaatctaggcctaacttttatataagcaaaagcaaaaaaagaaaattaaaggcaagtaaaatcgatggatagttttaattactcgaggccacaaccaagttcactgagctaaccaacaacaaatacttgtagatactatgtatgtacatacatatgttatcatatataggacatgagcgtccagccaatttagcttctagatatttcaaagagttctctttttttatacgatatttcaaagagttctagacagctgatgctgaaccatgattagggtcatgcatcttgcttgtaagattattgcaacgaaaatgaaagcttctgaataattccgaaatctgcaagtacttaacgaaatgatataataacaaagctgtgtacctttgtttggttttagtataattggcggggttgttcacagagtcagtggacaaaaaaaatatatagcagaacacagctgcttatccaaatgagattttgatgactggaaaatagcttctgagcaatacaatgctgcagcgcaaaagaacagaccactcttcaataaatttaccttgtaaacaatgaatgcaaatcatggattgtagagtaaaggatggtgaaaaaaggcataccaaaccaagcattgtcatgggtcgaagcaaatgttagatgtgataggagggattaattttttttcagcagagaataaccaagctggagatggctgcatatccagcagcatgccattggaggagcgcagatggctggacagccacacacctaaatcaagcttagacctaatccatgacggagatgatgggggagatcacagagtagaaccatatctagagacattggttagtggagctgactctgtcatgcacattggccatcacacttgctctattccatacccaaaccctaaccgcagatcgcaaccctaaccacagtggcaactcatattgtgtatgttttacaattaatctatacagattggccattagcaaaaacaaatagaaattaaggtttactgttccatgacccagaactgacgattttatagccaatcctggagatatgagagttcagtattttcgcaaacttgccattaattagcatcaatctattttatagccaccaataataaaaggaaaatagatccacggtttaaccttgatgaagagcatgccatatacagtaatgaagagcatgcatatcccacactattacaaataacaacatgtaatttgaacagaatgaaatagtctgtaatttcctaaagcatgctaagtaatatagcatcagcatataacagcatgagaaagttgaaattacccggactagtggtcatagaagcatcagtgaaagtggcatcacatattcatttatgttagctaaggtccaatgtttgcctcacattgtggtatctgccatgtgcccatgcctgaaaacgaaaatggatgaatgtagtcagtgagatgctgctaaatacaaatattgcctcatgcaaaaaaatatatgctatagtttaaccgaatactaatttatatgataaaaaatagagtagggaaggtcatttatcaaaacaactaaataatgatcatgcataggaatataacgactaaacaacaaataagacatcccaaggaactacccaaaaaactgaaataatatcaggcaataacagttaacaggtagagaaaccctgaagagcaattgccaaccagctggaagccttgaacctgaaatatgaagggcataggaattagcaaacgaagccactcaaagaagcaagaacactattagaaacctataaaggtgaagaagatgtaacaatgtaaaatacctttcatggctttgataataataactgcatgcagcacccaccaaaagtatggtccaacattgttaatattatgataggatactctgcattcagatcaattggagaacacatctcaataacatatggatttagaatataataaattaacatgtcaatataaataattttgatgttgaactcatagagtatcctataagaaactttgatgttgaactcatagagtatcctatgaatataaataggttgtttccctatttttagctgcataagcaactgatagagaggattttgacattaaactcataaatccttccctaagaaatgtgccatcacttgccatataattttgcttgtctgatgcaccctgcatacattctatgatcatatatagacataaaaggctaatgaattaccttcagtcacttactcattgtactttgagatacaggccgatcaatgcaacaaacatttgctcaatcaagttaattaacatgtaaagcaaggcagaatgggtatgtatatccaagtggtgtatatgtatttgcaggaaaaggtagtaacgtacatatgtgatcctttcgtttgtgcttccaagaatcagtgaatgtgggcgacgaagcggcgcaagggagagatgtggaagaatcagtgaatcgatgttaccgatcgatgggacctctactgcactgtagagggggcgcgggctggctgtcgtcgagccgttcctgcagtcgagccgccgccgccgccttcgagctgctgctcccgcagtcgagccgctgccgcagccttcgatctgctgctgccgccttcaagccgccaccgccgccaccgcctcccaaggccagatccggcgaccttaaggccggatctggcgaggaggggcacggagcggccgtcgtcaagccgccgccggtgccgtcgagctgcagatggggagggagagcggcggagctggggaggaacagagcggtgaaggcggagcttcgggagccggcagccagcgagggggggcagcgcggaggaaggcccgccacgcattgtcgtcgccgccctccactcgggcctccgcggcgcccagcgccgtcgcctccgtttgacccacctctggcgccgccgccgtttgggctgcctcgtcacccggcgtcgtcgcctccgctcaaaccgccttcggcgccactgtcgctcgagccgggcggcccccaccgtttgcaccaccccgtcgcccgacgctgtcgcctccgctcgacctgcctctagcgccgccgcctccgcggcggcgcaaaatagtcctgaccccctccggattagttcgctccaacagccgtgcctcggtgagttcgccgtccggccatcatcccctcagttggcgacggctccgtggagcaaccgaagaggagcagcggctgcacaaaaggggatcgggagaggggcttttaactatttgccactcttacggatgttgcttaatgatttgccactaggcccacatgtcatagacacatgagggcccacatgtcattgacagggtgtggcaaatcgttaattgccatgtcacaagagtggcaaatagttaaatttcccatcgggagagggcaaaggaaggaggagtccatggagaagaaaccacacggcagggcagaactggtagagggagatagagggactggatcctgtcacgtggcagatcggacggactaagaaacctgcatttgctgttgattgtaaaacagaaaaagggcaaatgttgtagggaaaaacattaggttttacttcctctatttcacaatgtaagtcattctagtatttcccacgtatatatgtctagattcattaacaccaatataaatgtggtaaatgatagaatgacttacattgtgaaatggggggaatatatgattagttaattgagttatagttttggttgagctagaagtaaaaaacggaacaaaagttttccaatacaatatcctccatttcaatttgcagaggatatatggctgtgagcccctgactcgttttcttcggacacctaaaatccgaaagctgacatttttttttcggttgtcttcatttgctatgctacacatcaagcttgaatacagtgatccttgtttttgttgctgtacagagcacagttaacatcacaagatgcctacgttccaatcatccaatgtcacacagcagcgcatatcaggccaaaagaaaaaaagaatcgctaaaatacaagagctggtagctgttgtggtagaagtagaagtgtataactctatcaaacacagtaaaagagtagaacttcagtgttgaatatgctaggttattatataggcctcatgacatgtacactgacaattaatagttgtccatagaactgtcaactagatcaatatgccaatatgaacgagagaggagagaaaagatgaggcgagagaaacatcaatgttaagttcaacaacgattgttagcataggataaaagagaaaattgctactctctccgtttcatattataagactttctagcattgccatattcatatagatatcattaacatatatatgaatgtgggcaatgctagaaagtcttataatatgaaatagaggaagtattatataaggctaagaaaacgaatgaagggtatgtagtagcgaatttctctagatgacgtgtactgctaaaggctgcagaaaggaaggaatgataaacaaaatattttggtggattaaaggttagatcattaatttatttttttccttgaatacacagtaaaaatgggcatcatttcattaaagacggtaaaaatccaaatgaaaaaaatgaaaataaaaaacataccaaaacaaacaagagatacaagagatagggctaccaagaagcccagtgactaagggcctatttagttggtgccctagaagctgtgcttgagaaatttaggtgcctgagaaacatcggagaagtgcatgtgctttgcctggtcaggcaacctgagattttgcttgtttggtttggcacacttgcctgagagaaagaaaaagtgattgggcttagattatttatgttaattatgtgttcatgggaagaaacaaaaatcgaccaaactctatgcgcatcttagctctgagaaattaatagcatacacacaaagaagtgaaaaagaaataggatgctaagaaagagatccccaatgtgagttgaagcgatacccttcctccatgttcgcatacgtgttaatataggcgcaggaatcacccctggcgtggtgtttacaagtgagagaatcacgcattatctcaagataatagcgcgtgtagttacaacaagaacagaaacagaaaaactatcttatctatatcttctatccttatctatctatctcaacagaagacttaacagaaaccacattatctaacactccccctcaatctcaagtttcccaaattgagattgttacaaaacaactgtagttgccgaacaggaagaggcttagtgaaaccatctgccacttgatcctttgacgacacaaatcgaatctccagttgcttctgtgctacttgctctcgaacaaaatgataatccacttctatatgcattgttctagcataaaacacagggttaacagacaaataggttgtgccaatattgtcacaccataattgagatgatctgggatgtggaattccaagttcttccaacaacttgcgcacccacattatttcagctattgcatttgccaaagccttatattccgcctcagtactagatctagacactgtagcctgctttctagcactccatgacacaagattagtacctagaaacacagcaaagcctccaatagatcttctgtcatctagacacccagcccaatcagcatcagagaaagcacttacaatgctagagaaagacctgtcaatcctaagtccaagtcctaatgttccttgaacataccttagtattctcttcactgcagcccagtgtatatcagtgggattctgaagaaactgatagactttgttaacagagaaagatatatctggtcttgtgagagttaaatactgtaaagcaccaacaatactacgatattgtgttgcatcatgtactcctaaggtcacaccttcacttgctaacagtttttcagctatggacataggagtacttgctaacagtttgcaattcctcataccaactcacttaaggatatcaccagcatacctttcctgactcaacaacagaccacctcctagtttcttaacttcaattccaagaaaatagtgtagatcaccaagatctttgagagcaaactctttttcaagaccttttaacaatgttgtgactgctgaggtgctagagcttgcaacaataatgtcatcaacatacacaagtaagaatattgtgactcctttcttattaaagaagaaaagagaggtatctgccttggaaggtgtaaaaccaagttcttgcaatttcttacttaagagagagtaccaagctcttggagcctgtttgagaccatataaagctttgtctaacttacagagatgatgtggtagtcctgcctcttcataccctggtggctgtctcatatacacatcttcttcaagatagccatgtagaaaagcattctgaacatcaagttggcgaagactccatccttgtgacagctagagacaaaacaagtctaatagttgcagcctttactacaggactaaaggtatcctcatagttaattccatatcgctgcttaaactagcctagccttatatctgtctatagttccatccgctttcctcttaattttatacacccacttacaatctataatatttgtccctcttttaggtggaactagatgccaagtcttattatttacaagtgcctcatactctttatccattgccaacttccaatttttattacgtagtgcatcttgcaaactatctggttccctagtatctgtcagacatgcataccttatagtcccatcggcgtatttcttcggcttgcgggtcccgtgtcttgatcttgtgactcgaccaggagcaggagcttgcgttgtggagctgatttcctcgttgctcagcacagatgatccggactggtgtgcagaggaatcttgtgcatgcacgggactgtgcacagcaggctgcacgatgggcgacgcacccactgagcctgtgtcttgctcgtcttcggactcagcaccacctgacggcgcctgcatgcttgcgtcgggatcagcaccggtgtggtgtccgccggaaccttgcatggagccgtggtcgtccgattgcacgaaaacatgatcatctgccgccgttcctgcatcattttcatcgctgttttctccgttgttttcagtattttgtcctgcagcatgctcagtatcctgattagtgtgattagtgtggttaggatcatcaatcataggttgatcatgtactatattgccccctggatcaagcaatgatgatggtggaagcaaatgtggtggcagcaagagaacttctgaacggagacaggcgcccgcattggagtggagtttagcaaagggaaaagatgactcatcaaacacaacatcccttgagatataaactcgcccggcagatatgtctaggcatttaaaacctttgtggagagtactatagcctaggaagacacactgttgggagcagaaagctagcttgcgagcattgtacggccggaggttaggccagcaggcgcagccaaaagtacgaacaagagagtaatccggagggagattgattacttttaacggggttctattaatgagataaacagcagtggtgaaagcttcatcccaaaacttgagaggcatggacgcatgggctagcagggaaaggccaacttcaaacaatatggcggtgtttgcgctcggcagaaccgttttgttgatgcgcataggggcaggagacatggtgctcaatgccaatgcgctggaagaaggtatttaagtgctggtattcccctccccaatcggtttgcatggccttaattttcctgttgaggaggtgttcaacaaggttctggaaatcgcgaaatcgctcaaaaacttcagatttgtgcttgagtaagtaaatccatgtaaacttactaaagtcatcgaggaagctaacataataaactttattgccaactgaacttggtgcagggccccatacatcggaaaaaataagttgcaaaggtttggaggacacactaaaagacttggaatagggtaattgatgattcttgcctctctggcaagcatcacacacagactcctgactagaatccctagttaccggtagattattcttgctaatgactcgatcaacaataggaagagatggatgccctaaacgactatgccaccgggacaacgatggtttgacaacaccataggcctgcttatgtgatgcgctggacaacttgtcagttggcagagggtagaggccgcactcacacttgcctcgaagaagcggcgtcctcgtgacctgatccttaaccaagaagaaatatgggtgaagctctatgaaagctctattatctctagtaaagcaatgagcggatatgagacttttatatgcacttggcacatgaaggatatttttgagaaataggtcacgttttggggtgcgaatagtagaatgaccaacataattgatgtccatacctgttccactagccgtgtggacttgctcattgctggtgtacttgtccttcaccgccagcttttccatctcgccggtgatgtggtcggtggcgctgctgtcgacgtaccagttggtgtcaacgctgtaggagcttgatgcagcaacgttggcgttcttctcttctccagtgaaggagtgatcgaagcatttccagcacttgatgacggtgtggccgatcttgccgcacagctggcatgtcggccttggcttgccgtcgccgcgtccacgtccaaagccgccacgtccagggtttccgccttgaccccggccaccgccgcgccctcctcgcgacacagaattggccaaggcagatgaagagccttgaagaagttctagccgactttcaaagccaactagcagtgcataggcctcgctcatggtgatggagtcggctcggccagcgatggaagacaccaccgagttgtagtcgaagtcaaggccggcgaagatgtaagacacaagctcctcatcatcaagaggcttccttgcagaggacatgtcatctgctaacgatttcatcttaccaacatattccgcaatagtgcgtgttcccttcttggtggacgagagcgccattcggatgttgatgatcctagcgcgggactgcgacgcaaagaggttttcaattgcctcccacacctccgtcgcctttgtgaaggtagcaacttgagtcagcacctcacgggacagagacgatagcaagtagctcagaacttgctgctcctgagccctccacagcgggagagcaggatttgccaccttcttggtggtctttccatcatccttggtgatggtgatggttgcatctggcgctttcgtgctcccatctagggagcctgccatctgcgcgccgcacaaagccgcaaggatctgcgccttctagagaacgaaattgctcttcgtgagtttctcagaaacagcctgtccattaaggacagatgcaacggtggaagaggatgatgccatctaatctaaagattggtggaggaaggattcgggtggagggagaaggctctgataccatgtgagttgaagtgatacccttcctccaggttcatgtacgtgttaatataggcgcaggaatcacccctggcatggtgtttacaagtgagagaatcacgcattatctcaagataatagcgtgtgtagttacaacaagaacagaaacagaaaaactatcttatctatatcttctatccttatctatctatctcaacagaagacttaacagaaaccacattatctaacacccaaatccaataactcgcaaattaaactttcaattcccagtcgcatgcaaatcaaatcaattaacgaaacaaatggaggcagccatcttggtaagacggtagatccagctagatagatgacaggggctgcttcatgcgagaaggtgagagatcgcactataccgcacgccagcttccgttggacctggcgatggctccgcacgacgggcgacggccggaggcgggggcttcgcgcgacggcggccggcggcaggggctttgcgcgacggcagccaggacaggggcttcccgcgacggcggctgacggcgggggcttcgcgcgactgcagctggcggcggggggctttgcgcgacggtggccaggacaagagcttctcgcgacggcggtcgacggcgggggcttcgcgcgacggtggccaggagaggggcttcccgcgatagcggccgatggcaacgataccgatggcggtggctttggcttcgtgcagcgctagctgagcatgggacttcgcaagagattaggctggtaatcctcgagtgatgctacgcctcgagctcaggtgaccaaaatgggtcgcctgactcaggctaatgacatgccaggtttcatcaggccaggcaagtggaaaaggggctgagggtggcaaccaaacagagggtaaaataactcaggcttgtctcaggtcaagcaagttttcctcagggtagcaaccaaacaggccctaactccagaaggtgtgtttagcccatgcatacagcacactgcacaccacaaggcatcatctctaactgcccttaaaacttgatttatatcagggacaaaaaaaatgaaaaggatgtcgcgttgtagttactactaaaaaaacaattttcctggacaaggagctcccattttcgcacacagaccgtttttgcgtgcatacgcaaaaatcagactcctattttcacgtgcggacccttaagaggcccgcacgcgaaaatcgattttcgcgtgaggcccgcctacaagtggtggcctcgagcgacgatgacgacaaagaggtggccgggagtggtgccgccggccccgcgcgcacaccggccagatccgcatcgccccgaccgatgacaactgggaggcaatgttggccgggagcggcgctgccggccctgcgcgcaagcgtgctggccggatccacgccgcccctaccgatgacgacgagaaggcaacggcggctgggagcggagcggctggctccgcacgcacgcgtgccggccggatccgcgccgccgccgctggattctagggtttccttttttgaatttttattttttttctagaattttatttttccttgtgggcgacataacatgaccgcatgcgaaaatccaattatcccgtgcggtccacttaacccgaccgtacaggaatatagattttttcgtgcggttgggccgtccacacgtgaaaatatttattttcgtagacacctgggtgcagacaggcaagacctccgcacggaaaaaccctttttgactgaatggaaaaatcgatttcgtagtagtgagtgcttccaatgctcctagtcctaggcaactaggatgaccaaagaattagcctttcttagttctcacagttgccaggggataatctttagatggcgtgtattgcttaagagccaataccagactcaactactgtacttttgctaagaaaatctccactctttataatttaagctagccaaccgtttaatattagtagttattctagaaaatgcatggtccttgtctcaaatgtgcaaagtataacttggttcttggtttagtcataattaccttcataaatcacaagtgtcatcagccgttactgtttaccgtccgacaatggtaacacagcttgacacctctgctctggtctcagagccattcaaagtacatttatgtagtgcctgctatatataatctccatctcaaatattccctccttttttagttttcacgttggttagctcaaattgaactaaccaacataaaaaatttggaaacggaggtagtacatcagatgggtaccccccctctgctcccataatcatgccaaatgcaattacaaatgtccagtatctgttaatgatgaaatttgataaatcatgcatcggatttggagttaaggccgaagcggatttgggaggaaatcgataacggaaacagggtatgaatcggcttcggaaccgcatcggctacagtgtgcatcggcagttaccgaatcggacaagacaagccgatgtagctgattccggcaagatgatattggaatcattgtcggattgagttgacgtgcttcatgatgattgccacgtaaggatcgagtccgaagaaggcagttgtatctattaattaggaatagtatgttagtttccttttatctttaggaaagtgtgtttagtgtcctataaggactttatcttttccttttatctttaggaaggtttctttcttgtccga

SEQ ID NO: 25604 - DNA, 1327 bp, Oryza sativa
ttgatggtctagatattatgtttcttttcatacttagtgctgcatcagttaagtttgatctactaagtcgtgctaagaaccataatctctagcctgcttcttgattgacaataagggtttcatcggggtttcagctggtgagttatctggacgttgcatcggctcataaggattgcatatacatataagttggatttagccgatgacaacaaaggcttcagtgtttaatctaatcttgtggatttcatgacatcagacctccagccgatgtgtgttttgaccttcgaatcgatgcttatttatcatatcattatttgctgattggtttatactggattatattgttattttattacatcgtcgtcagccaattgcctttatatcattatctacattggacatatagccgattgcttaaaccctatcgctatcggctggtatcggcatcggctattatcggcatcggctggaactactccatcggcttgtcagccgatcggctatttcgatctactatttgcatatcttgtcagttgcaggatcaaactgactggtacgctcgaatctcgtcaatatttggatctgcacaggagctaagcagatctcccaggacggtgtgttcgattttttttcgtcaacagtatcacacagttattagcaacttgttgattgatctttgttgttagtcgtgaacaatcaccgaaacaacatctcgtgatgaacagcataaacaatttcagaatccagtaatgcatgcatttagtttgacaaaagtttacttgccgcgctagtgcaaaatggaggcatatgccacacactttgcaacaacgtttgttgcagttcgttggctcagcgcactgaggcactacctaagcaaaaaaaataagcacgacataatatatgtaccggcagatcgactcagcttccattagagaaagtcacacacctcgaattaagataatttttgaaatagcacgcctgggagaagaaggtaaataataataataatatgctacaatgatattagatcactgatgaagatggcagcatacacgtcttggacatggagaggctcgattaaattacattgcattatggggaagcaccggtggagtggtgatggagtcgtgggtacatgattaatttcagagttcaaatcctggtgtctacgaatattatgtacacgtaaatgaactgtcaatcgaaatttagcgagattatggatgtaccgttggtttccgtctttttaaacatgtgagaggggatgcattcgcaagctgtataagtgtggtgttgcctgtgtaatactccctccgtttcaaaatgt

SEQ ID NO: 25605 - DNA, 16455 bp, Oryza sativa
cggagggagtattgatcaatgtgtgtgcgtcccccttctagtaaagaaatatattgcattatgtaaacagatataggccaggccacccactataaataccttgctctcccaacattgttctcacagctcattacacatagcccgctcggtcatcggagcgagaaagctcgccggcgacctcaccgtgcacatggcgcgcgccgccatttgcctagccgtcttcttcctcctcgccgtcatttcatccgctgcctcagatgacccgttgacaaccgtgcagcagccaattagccaggtaagccatggcgccaccatggaggaaaagagaagttcgccggtgaagcaagacgaaggcgaggagaaggcagccagcaaggccgtccaagccggtgatcggcgagacggcgagcttgacgtcggtagaggatcaggccaagatgctgagcatcaccgaggtatagagatcaagaaattagataatgatgacgatgatggcagtgattgggactctgttgatgactccgattcggaccacgattcagactctgatcatgatcatgactcggactcagatcatgattcggactttgatcgcggctcagattcggatcatgattctgactctaaccatgacatcgatggtgatgacaacgacgacgatgacgacgataataatgacgtcgaacacaaaacaaacaagacaatgagtaagaagaagaagcgctcagcttctggtgggagaagggtaggtccaggtggtaacaagagctaattaagaaagaaaggaaatgctatgggggtgtttgggagagaggggctacatagggacttatatttttgtgagagggactaaagtttagccccactttaatccctccaaccaaacaccacctatatattgcaataatggtgtgtgagcttggtgcaacgtgcttcctccacaaatcgatggatggcgcgttcttatctttatttaacttgtataattatgagtgtgcttagggcatccacaatagttatctatatgctctctacaagagattcatgtcagcatatcttcctacttggaagatattaaatgaagagagagagagcaaaactatctactaacttggagatagtctatagataaaacgaggcaatagatcgatacccatgtagacatactattaaggaggtttactattaatatagtctattgctgagatgtacatatgttatagagagcaacttactttaccattgcgggtgctcttagtgcttactgatcgatacatctcctctaaaaaaactaagcacgaacaatgtaagcccgtgtgtatttgtttgtctatcatacaagctggaagatttaaatatttcttactaatatactaggcagaagcgaatggtactcggtttgaaatctcaaatttagtattcccatgatttgataatttcgtacgaaatctagagtctcaacaatacttatgttatgatctaataattctgaaatttggagctaataaattccagattgtcaactataacttttattattattactagttatcgtgcacgtacaatgcacgtaaaaatcaatatgaattaaatcgggcaaattgcttaaattaaacttgccaaactgcaagggagaacatctatacttttatatagttggtactcactaacaattattagaagctaaaactcaacatgcaagtatgccacatcatcacccactagcaattactattttagatcatttaaaattccatgcaagcatgccacatcttcactcactagcaattactattctagcctattaaaatctcatacaagtatgacacatcatctataatattatattatagagatcaacaagtatatgtcaaatcatcttcctcacattattttcttaacatttcaactttcatcattttgacaatatttaacatatactcatccatgaatcccgcagcaaaacgcggagtatcacctagattttattattttaaaaaccataatgatggtagtaataagattgtctagagctacggaataattttgaaaattgaatttcatgtagtttgcatagtacattactgttgggtagtacaattagattttatacgtagatcaaatttaaattcttggattcattatggcacacaattttgttcttcttagtacaattctgatgtacatcaaatgctcaatatttttgtttgagagtactacaattgaatacatatgcaccgctacatgcttcgatcaggaacacgcacaatagagattacttgacaatttcccgtaaataagaacttcgctggtcagaaaccgattgaaagaagaagaataaacataacatagtataattaataaataacatagtataattaaattgaagtaaaattttgtcttatgttttctgaattacctattctcgatgtggatacccaatctaccacgggagcacatggagaagcaggcaattgtgccggtaaatgttggcatagataaacaaaaaatcatgaggcaataaaaaaaatcccatatgctgtatttggtggttcctttccaagaggtgtaaataattgatctacacaaataattgatctagaaaagaataattgttataaatacatataaacaaaaactaagaacataaaaactgctccaccttctgtagcaaaaaaaaaagtgatacatatattctgtaccacgatatcctaaaggaaggtgctcaatttagcttgtgagcctcatctttattgcaggcaccatctccacacaaaaagtttgcaccaatcagttggcatctccctaatgctcataatcaatgttttatttaagagaaatttcatcttagttttttttatcaatatatatggagaacttggtactgaagtataccgaagtgagattaatactattttttaagatgatggtgcttgatagcgatagccgtgctcatctacgatgttcaaggccaccgacaaatcaagatttaagaagaccataatattctgaatcttaacaagttaatggcagaataagagagcaaaatttccaaggagataaagatatttcacatccaaatagaatctgtattaacaaataatgcacatctcatattccttcttgcattgccatgaaaaaagagcaaataaaaactgatttttgcactcaagtaagatagggaaaaaaatggcaattggtagttaatacctgatcattcttttgtgaaactattttaaattagaagctctttatgcatggagcaaatcagcaatcaaacatcgcactatatccatcacaaaaaaaaatgatcatacatggcaacttcataaaaaaaatatagatttcagtaaaaaaaaacatgactcaaatttggcactaaaatatttattatttgaggatctagaaaaggaggacatcaccttaacctacagtctgttcaggtgctcgttgatcagataagtggctatggctcactcctcaccactgcatagtaccctaggccaccagatgcttagtctgtgagtgctacgcagcagcaagcaaacaataccacagtctgctcatcagcttgcccattcgcccatattcattgttgctttgtgtttcccactacttgtacagctaaaaaaggtgtcacaatcaggcagaagctataaagggaggtcaaattgagacaacctgcatacataaagccaacatacttacattttttcagacaacctgcttttataaatgaccaatatttgatgtaaatttaacataacacttggtttcaaaatacaagctatcaagaatcaggttaatcatatcatactgaagcatgcaaaatcataactaaatctagccttttcctcaaacttccctccggccctcaaatgaaaggtgtctgatcattggctgactactttaaggcttcaaaacaaaccagaatgtaaaagcatccctccttccatgcttcatctgtatattcttagcttgaaaaaaaatatgcttagtgagttcacaaaaggaacaccactatactcaagcaataattttaggagaacatattgagatgacatattcggcaggtgaaattttgatactaaataagcacaagttccaggcgacctcttacattttgagctcacagcatgcggcaaaaattgagccagctgtacttctttgaatgttccgaaaaataactccatatttgaaatgttgtgaatctattgaacaaactgcaaacaaactccataaatggcacttctcagtgaagacaagtgtttgtgataaacataaatggtactttgtgttgccattgaaaaatatgtaaaactgctggttatgcattcagtcttcttgatattaccagtccataccagcataaaaacactgatagagaaggttaaagtcctagtaatctgttgttgtagaaattgactgcttcaactacaaaaatatattctcttcattttttttaaaaaaagctatgcagtatagaatgaacacccaatcacccatcagttatcagttcttaattagtaactgaccacaaattcttttcactgacaagaaacttattagaaaaaataattcaagttccaatagagagtaatactatttttttcttcttcaagccctacaccaattcaaatttgttgacctacttgaccttagtataatccactgcttgctgagctatgcgcgtctttaaatcctggattcaagtaattgatggaaattcaaccctgtagttatggaaattaacagaaatttgcagttggaaattttcaagcagcaatccaattcaagtcttgttcagaaatctgaagcataaatgctagcaatctttttgctggtagataggagcttgaggaaaagattgccctctagcaagctagctacaagatggaaattccctggtgtagagtagttttgagattgcctatggttggcgtgctaaatgccagtacaagtgcaaaaatcatcttgcctgagatatgtacaggcgtacagccatgtagcagaccacaacacaccgacctttcaaaatggaacatgggtactgaagattgacaaaacacacctcagacagaagtgaattcatagtatgtgttccatcgcccacctagctcttgtgttgcccctaagcagactgttgagatcacgtagatagaaaatatccaaactgaattccagtaagccgtataaccgtagcatcttcagtatctcagaatatatcaacgaaagcattatatctgatcccaaccggcatatcaaaacctgaccaccatacaaatcaatacaaatttagacgaaccatatgcaagcaagtatgcaacatgaacaagattgagtaaagctactgagtgaagatgtatggctcttccagctgacaatcctcatgaatcgaaagtcctaaagtattacatcatcaccgtacagagaataagtgattgtggatgtaccttgtggatgagaatcaaggaagacctcaggatggcgggcagaaggtaggcgtcggcgaggaagccggtgaagaagtcgtggaatgaaagcacggaaaggcattccacttccacctaggcgctgtggggggcagtcccggacgggtgcggtggaaggggaaccacctcggcgccggtgattccagactgcggtggagtgcggcggcggcaggaaaggatctcgccatcgggggcagtcgcggcggtccggtggacgggggaaccacaacctcgccgtcggggacaggctgcggtaggtggagtgcggcggcggcgaggaaggacctcgccgtcgggggcggctggggacgacctcggctccggtgcggcagcagttgagtgaggcggcggcaacagtacacgcgaggaagaggagcgaggagggcgtaatcttcgcccggtggacagggtgaaattgcgcggaggcgtggtcttcgcgcggtggagagggtgaaatcgcggtggacggtaggattagcgatcaaggtgatgtggatgtagatggacgatggtgattataccagattgatttgggtagtaggattgtagggggacaacttctccttttcctttttatattagtacagatatagatatagattatgtagtataatttaaatttaaaattgatatataccaaattgtagtcagtttggagtataagtgtactattaacttggtttaataaatctgatatttcaaattaataaattttaaaaatattatgttgtacttcatccggacccttaattaggttttttattctaaaattaataaatgtcgtcttatgcttatgtttgggatctcaattatagtatttttatgacataataaatgtaaaatagcccaagaaatccaaattaagtagagttgatagttgacgagataaagttttggaaaaagtacgaattaccccccgaactatcgaggtcgactgaattacaccccccgaacttgaaaaccagatattctacaccctcaactattaaaactggacaaataacacctccgactcaatccggagtggttttgggtccacgtggcagtctagtcagcatttttttaaaaaaataatcagtgggtcccacctgtcagttcctaccgctctctatcccaatctctccctctctctctcttctcaccagcacggctgcggctgcacgagggcgggagcaggcggcgccacccacgacgctgcgcgctcaactacacatccaccatgatcgccgccgtggcgaggagcaagagctacggctgctcggagagcaaggcctagtccatgtacaacctcaactacccgtccttcgccgtggccacgggtggaggatttggtggcgctgctggcgttcaagatggcggtgaccgatgacccgtcggggggacgctgtcgtcgtggtcggacgccgacgccgacccgtgccggtgggccggtgtgacgtgcgtcaacacgtcgttgtcgaggcggctggcgggcggtgggtggggacagaggccgaggctggctgcgggtggcggacggcggatcagcaaatggcaacaaatatcagggcaggtcgcagttgcattcgcgcggtcgcgccgcggtgaccgacggaaaggcgcgcggcgcggatgtggcagtagaccgccagcagttggaatggagcggctggagcgctggtggtgaacggccagacgggatgacctgtgggcggtgctaagcgtggagacgtcacgatgcgaggagccgaggtcctcgccgcccgccgcggcccgtcctcgcgccgccgcccgtcgtcaggccacggcttgtcggcgtcgccatcgccagaagaacctgtccgggtacgtgcgccgaccgtgctcggcttgctcgcgctcgtccgccacctcaacctgcacagcaacctgcgcaggcgagctctgcctcccgctgccggccgcccgcttcgcctccgtctcagctgcccaccgccctccgccgccggcagcgccgcctgcttccggctctcaccagcacggtggggtgagaagagagagagagggagagattgggatagagtagagagagatagagagtggtgagaactgagaggtggggcccactgattatttttttaaaaaaatactgactagactgccacgtggactcaaaaccactccggattgaatcggggggttatttgtccgatttcaatagttgaaggtgtagcatttctggttttcgagttcgggggtgtaattcggtcgacctcgatagttcaggggggtaattcgtactttttcctaaagttttacatgtcgtttaacttaaatcatgtcttaaaagtgagatatttatgatcggagttaatccactcttgcttgtagtaggaaactcaacagagtacataaaatagtcccaagaaatgcttcgtgttggtaacttgtatacaatgtcaaataaaagttgacatattgtttcaaagaaaaaataaagttgacctgttggggcacatgcagcacctgcaaggctcgacctttcaatacacgtgctcagagagaccaataccaggatcaaaatctttggaccttattcatttttttatcaaaaactgctcacttatggccgaaagtttaccctacacaactattatggttatcttaaaatacaaccaaattcttaaaactgttcattctatcgtcgaccgttcatttatttcctcttccaaaccaaactaatgaggaaaatattacaactattatggtaatcttaaaatacacccaaattcttaaaacaattcattctatcctcgaccgttcatttatttcctcttccaaaccaaactaatgaggaaaatattttttataaaaaaatttgttggctcaacatgtcatccactcatcctctttccctctctctccctatcgctctcttatatcttcttgtgcatcttgtaagttagagcgcaagttcctacgtcgaccggagctcttatccagtcttctgccggcgtcgcttagtccatatttgctagtgtttatacgtagcttgaatctcctcatactaccgttgttgctcagagcccttgtccatccacgccgctccttgcctcccatattcacagccatccaagcccacctatacgccatccaaagctcttttcccctgcatgtgacacttagaggcgattggctagagcttctctactcagatgctggctaagctggtaggtccactgagaacatgacatgtcctaaagtctggatctagttggctacaagcctacaaaggcttgtctccacctccgctttcatcaagcaccacaacaatccttggtgggctcgggactacccccgattttgcccaggataccccaccctccgaaaaaaaagcccataaaccttggttctcattcaagccaaaaaaaacaagcccacaaagagagaagggaaaaagcgctaggtctgatcttttgggagtcgaggcatccgacacaccacgacgccatctcgactcctttggtcctcgccgtctttgctacgcgcttgcgtcgtcgcttcctcgccgcgccgccgtcgagccgccgccaccacttccctaactcgatctacagaggccgaatggcagagtgctagaggcaccgctccccacgccacgctgcccaggtgtgggctgcctgcgccggggctcctcacatggcgccgccaccggccgccagcgtcaggagccgggagcccaggacccctggcggcctggccctagttgatcccctgcctcgatgctttccttctgtctaccccttagagtcccgtgcttaggtgagtaaatcagtgtactctgatttgtgaatcggtgaatctgtgaatgttatttttatgagtaaattttacaaaactacatgttttgtggtccaagttgcagaaaaccacatatactttgacacttagcgcttaagtacatatattttagtagtgtagtttcagaaaatcacactatcaatgaattgattcacccgtgatatggcgtggctgttccacttatgacgaggacgtggcatcttattaccagccatcacacgaaataataggatgccatattctcatcctaggtgtaacaactacgtcatctcacatgtgaatccatttactgatagtgtggttttgtgaaactacactaccaaaatatatatacttaagtgccaaatgttaaaatataggtggttttctgcaacttaaaccataaaacatgtagttttgcgaaatttactctatttttattggtgaatcagtgaatgtgaatgtgttgctatttggtactattgtagttgtaggatttgtaaacatgaggttgatatggaattgctcgtttgtatgttagccttaatctagtgatgaccacgcagagaaacaatatactcctatgatttattgaatcattgattcgtcacatgtatcaagtgagatatcttttccgaagttagtgaagaagacatgagaataacaacttttatagctaagatagtggcactgtgattttctatatgtgcccaatatcttttatatttgaacgtgtgaacttgcttgttaagttagtcaaatattgactatattagacaatattgttacattcctatcactttttcattaaatttgtactcgtatatgggatttaggacttcattaaatttgtactcgtatatgggatttacgacatttgaaaatttagctatatgtgatgtgtatttgtgagtaggactacccaatgaaaaattcctggccacgccactgcttggatgtcggcttgatggtggtgaaaagttcagagagagccactgtaacgcttagggctggaattgtattgggcctaatttatttagttatcacctagggttcaaaaacaatattgtttttgggttcaacttatttacttatcacagctacatatgcttttaactctcttgtgttttcatcatcattttacataaaaagtttaatggagttaataatagtaactaggtaggccaccttataaactagtgctgctctagttggctgccggctgagagaggtgggactaagagcatctccaacatcgtctccaagttaaattttagcaaaaaaaatctcactccaacagtctctctacttgaatggctaagctaaatggatggccaaacttcacctcccactagtcaaacttggccagccaaactgactggcaaattgtgggcaccacgcctttccccaatgttgatttccgccaccacgacctcccgcgccgatttccgtcgccacgagatccgcttgcggccgtgctgagggaaaaaccagggaagaggatgtggtggcatggcggcacgacggcgagcgtcgccgcagcctcccacttgtcgccgccggcatccagcgctgatttctgtcgccttgccgccgtgccctcttgagcgccgaagagagagaagaagggatgaggggcagcggcgtgaaggaagcggcggcgccagtgagatgggagacgaggtggtagaggggccagcgagggagggcttcgtcgtggcctcccgctcgcagcctggtatcgtgcaccgagagagaaagaacatacgggtaactcggaggaggtgttgtcatccgttgccgacgctgccgtcgtctgccgtcgtctgccgccgagaccgccgcctcgttgttgttcgccgtcgctcgcttgctcccaccggcctccgccgcccgcaccgctcccaccggcgccgcctccatcctcgcgccactcccgtcgtcctccgccacccgcgccgctcccaccaccgccgcttcgatccccgcgctttctcctgccggcgccgcctccatcccgcaccgaaatgtagagaagagggaagaataggagactgatgtatgggtcccactattaaattggagaagtgtaatggagatgctgtcagagtgaaacgtaaatttggttctctaaatttttggcaagtagcccaataggatatttggagagtcaaaaatagccactctgttggagatgctctagaccatcttgccgctgctgctgcttctccgtagctagcttagctttggcccaactgctattgctcgctgcaaggatgcaaggcccatggtctgctagctgcactagcactactgcttgcttgcaaggcccaactcctttcttttctagtagtattttttttcctctaattattattgggcgttacaacttacaagtacagtccacataccgcctctgctttcaaggagtgcctcccacatccaccgagcatggtcaactccttgagttcctctcttccctgaatcctgagtgtcatattctctttgggctctttctcaccatgagctcggtcgccaacttatccatacactgcgtctgccgagatccgcctttgctgccatcgctgcttccacggcttgcttcatcaatagaggcaaaaagaagatgcatagttggctcgacagtaggcgattacaacctgtcgataaattcttctttacttttttgctgactggatgttgaaagtcaaggtgacttttgcaaggaggtagaatgaacaattttaaaagttgagaagggtaaaatggacttatccttaatttaaaccatgttgagcggtgtcaatgaagtcatactcctttggttccaccacggtgcttttagttttcctgtgaataccatgattatatatgcagctattatattacatatatcacgtattttcgtagtataatctaattcctccgttttaatatcttatttggtgaaagatatatccaaatttgattttatcctcaacaaacttttacacgcaacagaaaaaaaaaaacactttgtgatgagacaggtccaaagattccatgtcccattttcaacccgccatctctacctcccttgacacatgccatatcaggaaggaccctccgccggcgccggccaatggcggcctcccacctcgctcccgggcgatggcgccccaccgatccaaagatccaacaaaatggccaccggataagctcgcgacaccgccgcggccaatggcgccacggcacacgtacgcacgtccgaccgatgcgaatgttgcgacgacgacgacggcgatgacaatcccctctccgagatggtcgcgtaacatcgatcgatctcctcttctcttttgcaaaaaaggtgaggaagactgtacgtgcggatggttgatgcagaccggtccatatgcatgttctgtgtagtattgtagtgcagtggttttgtttggccaaagagtatgcagagatggagtattctcgtaacacgataatagctatagctgcgtgcgaggtcgatgcatattggtctgctacttgtcctctgcgatggatatggagcgaggagtttagtggggtttgttcagtttgtagctaaaattattgttttttttttacatgttttagtgtacataaaatttggttgagttagatgtgtttagttcgatgtcttcttcttaaattttagtagtgtttttatgagagaacttttagaactcccaaaatttggatttccacaaatcaatttgtacaccttactaaacttttatgggcattttggattggtaccaactaccaagtcatgctctacaaattaatttgttagtagcttcaattctactcttgaggggttttgatcgaagccaaatccttgcgatatttcttgccatcagttcgagcctttctggctttggtatggatgagttatcctctgatatactccactactctctaaaataggtcaatgacatgtggacccatgtctcaagcacaagctaagactgcactacattagtttcccatgggtaccacggccatggaattatccacgcacatgtttgctcctttcgataagtagtgtgtgtacaggaaagtaggagtactcgctaaaatacttgcacgcggtgggtgtcttgtaatcggaaaatatcctgatgtccataattatcttgcacacacagacagacaacctcttcagtcaaacactcaaacatgtgcgaggacggcgtactccccgcagcgcactaacgtagtctcaagatgactctcacaagtgatgccactcattctgtccaccagcataaacggcaaaacaagcgatatcatccttaccatcttagggaacaaaaacgaccaatcgttagttagtcatcgctgcagtgaacaaacagataaagaggggaaaaaaaaagatgcaaacttgtataaaccaaaacacatttttctctgaaaaccgccatactttggtggtaggagcaagtcaccgtcagagtctccctctcagccaaacaaagctacaaacaagaacagacgcgagcaaagcttgtgcattgtttggtccagcatcgacttttctcgagaagccatctcaggagcttctggccctgaaagtgaccgcctttgctttgtctcaaacaatgcttggaaagctacttgtaacgagaggattagaatgggggtagacttggattaatgataataataagtgacctgaaaactgacagcacccaaagagggcatggattgcaaaagcatgcgaggatggacttgcctccttcagccttgatgatttttggttgtcattcaaagggttggcaacctaacttcacacaggaaaacccagatattttctcaacgattctgttctctgttgcaacatgagaattcagaaactccttttaaggctgactttaatcttggacttctaggtatcttgtttgtctttgaactcatggtcatgtgcaggaatattatactggttcaataagcatattctttgactatgaaaggatttcatagtgcaaaggagaactcctttcatatgtatatattacagcacaatccaagatccacccaaatcaaaaggcccccaaccaagcccaagtgttagcggaatgtcatccaagaacacaacaatactatactacaatgggaagccagctcaaatgcaggaaaaagaactcttgaggttgtttcacatgtgcaccaaagaggcaaaaaccactccatgcttccctatttatacacatactactagcagtatgcatacataactacaaggtagctaggtgcagtccctaaaaagacctaagcccatcactagccagcaactaaagataattaaccctacatactaatccttacaagaggcatatatatcgaagacaatggaggaactaccatctcaaaaagatttaaatctctagcaaccatttgaagcttcttattcatgccagttcgcatgtcccgtgccagtgatgaccctactgttcaagtggcgaggtgggtgactgaactgctagccgctctgatacctcggcgagagatgttaagttgcacttgatcacggcctcgacaaagtagcatgtctcgtcctttgtatttccatcaggcacgtccaccacaaatgattcaatcacaagcgtccctggtcttccatcgatgctctccggatggacagttacgatggatgagtagttctgaaggagtggggagacagaaatcagtacaaatcaaaataaagctttgacaagtcgtaaagatcatgagtgcctagctgtccataaacaagaacctaaaatcattattcttcaattaaggcaacatggtcaacttatttttcaagtaaggttcaagaaacagcaaggccacatgcagaccacactagtaggtcattgcctttcaagaaagcagacgacgtattggaattcacatcgcaaatcattaaactgaagcccaaatgaagaacagggaaaacagggttgagtttcccagtgtccattttttcattctatccctagtggaagtcaaaactactcatgattatattacttcctagaaattagtaggtcaaataatgaagcacaaggttatctatcatctgatccaatcaaaacgatggatgaaccaatgtgacttccagaacccatatccattctaaatctagataggcatgccatatgcagaggttataatgccaaacatttgctaccaagataaaacagaaaacaagatttctaaaaatactggattgcagtgagtttatcatactgtggattagtaattaagaaggcataaatgatatacttgcagtgagccaatcatactggattagtaattaagaaggcagaaataagcagagcacattatctaatctaaaaagggacaaaaaaaagcagagcagtagacagaaatgggtatcagtatcgagtggcacgaaccctgaggcggtggtcgccgccgacgaacttgacgctgaggatgtgctcgtcgtcgtcgagcagctcgagcctctccgtgctggtggtcgccgggaggccggtcttgacgttgacctcgcgcacgctgccgatctcgaggtcgccgccgcgcacgacgcagcggctgacgaacggcttgtacctctgcggctggtcgaagctccgcaccagcgaccacacctgcagcagcagcagcgatcgatcaatcgatcaaacaatcaaatactcccatcaccaacaatacaatcaaccaagcagatgccgcgaagaaacaagtcaaaacatcccatacaattttgggatctcgagcggccaaaaacacggcgaaattcgcacattcaattcgagctagtaccaatcaaccgaacaaatatctcaggcaacagctacgcatcaaaccgagccgcacgagcaccaaacccagcgccaaaacaaagtataaaaaaaattcagatccaaggagcaaccaccgagccaagtagccaaaccaaacgcaaccaatcgaacaaacaccaaacgaagaacagaaaaaaaaaagaggatggaaggcgtcgtgagtcgtggaactcacgaggtgaacaggagccttgatgtgcttgacgagcgcggagctgcactggtgctcgccgggggcgtggctgtggagcctccgcatgtgctccgcctccgccgccgccgcagcccccgccgccaccgctcct

SEQ ID NO: 25606 - DNA, 6025 bp, Oryza sativa
ggggtggtggggcccacccacgagttatccatgcgcggaccccgaggggccgggaggggtggggagggtgcgtgcgtgagcccggtgcatggaccggaggggtcgtttttaaagggtttgcttagccgcgagggcacccatgatatttctgttaaagaaaaataatagggggtttgagttgtttgttttggttttgtttttcgtagtaggttagtcggtgggtaacttggaaaatatctttggcaccatgagggggagcactaatgtccaaggtagtggtgtttttatttgcatatagtattagggtgtcaacttggatgggtgtatatcctagtggcataagttggattcagaatgtgccacctttctaaaaagatccttttgtagcttcatttagaaaaagatagattagtactatcatatttattgggtgtgattaatttggaattttttggaatggtaaatattgaaattatcattttacaaggcatatgctaattttaaaatgtcaaatggagtaattatgacttagtgatttgtcaaattataagtatatttagtataaaagtatatactaatatattcatatttcaaagtgttctttatatcatattctaggtgatatacagacttatattagaattttattgatcatattaactttttcctattttgtaacaaatctaagctacaatggaccatataaaaaagtatagagtaaattttgttacaatgattaaactatcacaaaactatagatttaagactgtatatcgcaaaattatatatttagcaataaaattatcacggaactacatattcaagatagagtttcataaaactataaattaagtagtaacttgagtaaaaaaaacttaagttttagtatcaatttaatcacaaaactacaactttatagctccaacatgacggtaatgctagggattaaaactctacaacttatagttttgtgataccttcaatattaaaatttgtagttttcgatacttaaccttaaacctatagtttcatgataaaattatcgctaaatttatagttttgtaatataacatcttaaatctactttccccatcctatagtaagttcattgttgccttttttttccgtttgtctcaaaataagttcactcttgaatagccattgcactaaagtttgtgaaagtagaagataaatttatttatagtagataaagtagggaataattagattgaaatttaataaagtgggagtaatctagtcttttttttattggtatgtctgagataggtgaaaaatgaggttgttttgggacggaggaagcatagttttagatagtttgattaaaatacctataatttgcaaaattaattcaaaaagtataattgcttaataggaacataattctgattataaaagaaatgtactatgtaaggaaaaatcactagaattcccgagggtttctcaagagatgttaaagggcctggttgtcaggccgacagctacttcctccgtttcacaatgtaagactttctagcattattcacattcatttagatgctaatgaatcttgatatatgtatgtgtttagattcattaacatctatatatatatatgtgcaatgctagaaagtgttacattgtaaaatggagggagtattattgtgctaccgttgcatttggatactattggcgccggccgtggtgtagccgcaaaaccaatgattgaacatgtctaatgcaaacataaaattgactatgtaatcattaatactcccaccgttttatattataagactttctagcattgcccatatttatatagatgttaataaatctaaacacaaatatatgtctaaattcattaacatgtatatgaatatagacaatactagaaagtcttataatataaaatggaggaagtaagttattgtgctaggcgtgatattctctaataagtcattatgtactagcgcacgtgatattcctaaatatgagcacatttatgcatagtacgcgaaaaattattttattggtttagcggcgtataacttcaacttaaaaattgtgacaaacacagacccttgtttgtaaagcggaaccacacgaagcttcagaagcaggaaaccacatgagtacatgaccgagtccatggaccttgttcacacaactcgtgggacccttcgcaagtttttttacaatatctagataacctgccaaagccggtcgcagcgccgacttgcctattgtgccggcggttgcattcaatgcgccggacaatgacatgtgggacccacgcagctctaccccaccctgtcagtgacgtgagcgcgctgttcttttttccccgccttcgccgtgccaataatcggagggagggctctgccctttttctaaagctggtcaccgtcagggcagaaagaggcatgccgtcgaggaagagcgatgggccgctgccatgtgggccccacgcgcaagtggggtgtgggcgcgagacgacgcggtagggggggtgggcatggaccgggcctgatgagggtgtgtgcgtgtgtgggtggtgtggctcgtcgtggtcgcggtcggtgcttcacctcgacacggcaaaaaatggtgacgcgcgatgacgtcatgcaaaaggacgaaatggtttttaatacggggttactgccaccagcgtgtatcggctgcaaatacggacaggcaaaatgaatatgatttatactgatttataaacatatagtactcccttttgttatatcaaaattttaatttctaagtttgaaactagctatgtcatgtgtctagatttacagttgaaaatcatttttttctaaacggagtaatagtggatagcctacagggctgcaaagaagattgttactccttttttttttatcttttacacagttggctttttaatctacgatttgatcatttatcttatttaaaatttatgtaatttaagcattacttaatttcttttcatatttgtaagaaatctctatctctactattataaaaactgaagatgtttttgccggtattttggttccgtgtatgagtggtttttaagttcgttcacttttgaaaatacaaattcgtatctgagtcaggttttaagtttgttcgtttttagaaacacagaaggagtcgtataagaaatccctttaagaaaactcgcatgctaacttgaaatgatcggactcctaaccgtagctcataattttctagaaaaatatatatccaagctaattcttacagtgaatttcaccttaaccgtataacaataataagattaaaacaactttcacccgttgcaacgcacgggcattctttttcctagttaatagataaaaatgaaggatatatttaaaagttaactatgttaaaacataaaagtataggtggagtatctcaataattctaggagtattaattgagacatggtatttgtgtaataatttttaatagcaccatctcaggccatccccaaccctacatgtcatctagtgttcatagcattaaatatattgacacataagcaaaattttgatgtgccaagaaaattaatgaggagagaggtaaaaagatgaagaaattatttctcatgcaaggaaccacctcttcacaagtactaagaataaaaacagggggatatagatggataaaagaagagagaagagaggtgattgaataagaatttgatttgaagacaccatctattgaatatatagtagtttctatacatagattctatatcactggtaagtatggaaactacttggcagtgtctggattggagatggcctcacaatggtgaagaacgagtggacgatggggaatgaggaattaggatcgagtgaatgtaaacatctagtgttgttccgttgtatcgcgaatttataaaattaccctatacaatagtagcatagaaagataattttaccttttttaattttgtattgtctattttagtggtatggcaaatcaatataaatctgtggattttatctcggcagtatgtgtcacttgtaaattttatcatacaaaatctctatacttaattaatctaaaaaactaaagtgcttatatttcggatgaagtgagtggcatatttctatccttttacatgtttgcgtggaaaacaccctggaataagaaatgctttgctccctgccgatcgatcatgcctggctggccgcggcagtgtaaatgcatcatgagatccagatctaagcaatctatggatggatggatatgggtagctatctgcccagcattgcaatcgcttatattgccattgattgtgtttgacattgcttgcatgtcaatgaaagcaaatacagtactgcttcctccgtttcgaaatgtttgacgccgttaactttttatcacatgtttaattgtttatcttattcaaaaaatttaagtaattattaattttttcctatcatttgattcattgttaaatatatttttatgtgggcatataaatttacatatctcacaaaagtttttgaataagacgaacagtcaaacatgtgctaaaaagtcaacggtgtcaaacattttaaaacggagggagtatatactatctgcaatacaggcggtagcggcaggcaaacggcgttggtaggccattcatgtggtcggacagtaggttacctgtttccccacgggccactcgttcgcttcctggattgccctgcatctcagggagatgtatatgcaaagtatatactcctataatttttaaaatactttctccgtaaaatacttatcattctaaataattaaataatttagaactataaattaaggtatagtggaagttagggtagaatagagggaatttaaatgggagatgattgatgggaccaacagtacttgaaagtgataaatattttgagctaatttttgaatcctagaaagataatttgtaacagagatagaaatatatttttcaacaattgaccgctcgttttttttctataaaatgaataatactaaaaaggttttcatattattaaattgtatggcatcctaactataagtccagaactttagtttgtcatggtttaaccaattattggtcaaatgtgaaaccataccgttaacattgtccgttacttgaaaacggagggagtattaatttagctagcttacctcagcggcggcagtggcaggtacgtacggcgatgtccgggcgatagactgaccaggcgtaattaattggtgattatatctctagttattatatactccctccttgacgccgttgacttttttaaacatgtttaaccactcgtcttattcaaaaacttttgtgaaatatgtaaaactatatgtatatataaaagtatatttaacaataaatcaaatgatagaaaaagaattaataattacttaaattttttgaataagacgaacagtcaaatatgtttggaaaagtcaacggcgtcaaatatttagatatggagggagtactacgtagtactaagaattaagtacagtgtcatacaagaaattaacgtaagtacgcgtacgcgttaaacaattgagatagagatatgaattgatcgctaggacgatgattgatgattgtctatcactattactgctatattgctcaatttgttccccatttcggttatttgtgatatgtaaacagctggaatttcgattcggttattatactgcaggaatagttgtgcatcgaacattttaagctgcttcggggtatgcttttacgggtttcccctgatcaagtaagcgcatacacctcgcgaatgcatacccaataactaaatttctattaaagacacatattcatgtgcctaattatttgtataaactaggatttaaaccctacatgaaaattactccaccaccacactttggtatgtgtgctcggtatacatttatatgaaaatatgtggtggaaaccacatatgtagtggaaatttagaaactaccgttggatcgaaaaatggacgtccgagattcgtccacatcatcacgagcacag

SEQ ID NO: 25607 - DNA, 10489 bp, Oryza sativa
  unsure (1)..(10489): unsure at all n locations
ttttcaatccagcggtagttttttagtttttactacatacgttttcatatgtttttcatactatgtaaaactcgccaccaatattcacatgtagtagtagtttgaagttgaagctagtactactacggaattaattttttctgaactatgttctcttcaaattgcaaaaatcgctcccccgggatggtttaagggtgacatgtaaaaatatattttcatagacgtccccttaataggcccatctcgaagatacattatcgtaggcgtacattttaagggactgcacgtgaaacggtcaacttggagagcaagtgagcccacacgtcccaccgtatcactctttttttctctttctcatcctaaaccgcatctctttcccttccactcccgtaccctcacctcacctcatctcttccctttctcttctccactcctggcgtctacggtgtacacggcggtctcaggggcaggcgactgagacagaggcagcctcagggacgttggtgagcggatccactgcccccgccctcgagagcggcgccgacgtgcggatccggtagcctcggggtagctccgccgcccctgccctcaggagcggcagtgggagcgagcggccatggtagcagctatgacaacgacgacgacacgacggcagcggtggccactgcgacaacaacgatggcagtggtggttgcaatgacgatgatgaggaggatgagctagtgttttgagagaatggggatataggggttgggctattttttttagggatttttttcgttgaaattatttttttatacagttggcataggtgatagcatgcgcaaatcctgtctttgcatgtggttgggctacccataagaaaaaatattgatttttgcagacacctaggtgtaggcgggccgccaagccgcatatagaaatcggttttgtctgtctgaaaattgatttatgtactaggtaggtcccacttgaccatggtattacaagataactctatgtatcgagatggaaaattaccatatgaagcggtaagagcttccaaaaaataattaataatatacaatcgtgaaccatctttgtttatcacaatgctgttacactattaagaaatatctgttgaggtggaggcaagtcatggagagtagacatagatcttagttacttcctccgtttcacaatataagtcattctagcatttcccacattcatattgatatatgaatgtggaaaatgctagaacgacttacattgtgaaacggagtgagtaatacactttgctttattatttataccattatatattaatatagaataataatagcggtcaaccagaaactaattaaaaatttgtatttatattatgcaattaaaattatttctcaatatatttgctgctactactatctaatatggtcaaccggtcgtctggcactcacacgaatagagggactaagaaactaactaaaaacttattatggccccccgtaaaattttacacactgtcacatcgaatgtttggacatatgtatggagtattaaatatagacaaaaaaaataactaattacacagattgcgtataaattacgagacgaatcttttaagcctaattgcgccatgatttgataatatggtgctacaataaacatttgctaatgattaattaggtttaatgtattcgtctcgcagtttacaggcggattttgtaatttgttttgttattagattatatttaatacttcaaatgtgtgtccgtatatccgatgtgacacgtcaaaactttacatccctatatctaaacacagcctatgtttagggtttccgttatttttatcgtttagggtgatcggcatatctagtcctatatatatatatatatatatatatatatatatatatatatatatatatagtcatgattaaagacccaatagattggttggagcactatctcttgatggaatccaacaacagccagtttgattccaattttagcaattcggctagttaccagcatttacaatttatatgcagtataaaaatggatttccagcaggggcggatatatagtgttagcgtcggtatcagacgacaccgacgactttcagcaaaacttatgattaaactgcttatgatctatattgtttgtagcataatttggctaatagtttattttatttgggtaagccagattatttagtttagctgtcatgatttgaagtggttggtttgagagccgattaaatgtgtgtgcgtggatggctagggaggcttagcatttatcttagaatggaaatattatggattagctgagcttaaccatagtcaaggaaggtttttgcgttatttagtactatttgcattagcatgcagatagagatcagagaggtgaagactcgtgcagctggttgcaagtggaaatttgctatagtcgacaagcttctggccgggctgatgatcacatacatgcaggcgagcagaaatttgccgtgctctcgcttggctgttttgtgcggctgcgtattgcgcgaaggttggatcagtggcgttggtttggagatgatgaggcgtgattagcgcgtacggctgttaggaagataagggcatgtacaatggttgtcaataatggtctcttagcattgctaattaggaatactttgacatggaagaaagagaaataggagagacaaaacatcgttgttatacataacaacggcttaacaacgactcttgatcattataatatggaaatatggttgcacaagggtaaaaaaaatagaaagaatattaataaaaggaatattttttaagttaataattagagtctttgttgtctcaactattgtaaagatacggtctctaaataattttatattgttaagagaccatactcgtctctaccattgaacatgcctagatagattttctattttatcagttagttttcttttcggttggaccatggtatctgtatatgtacaggtctacggtcgattgaaggacccccgaacaaaattatcaatctactattttccttttctatactttcctgttattttctattttgttttcatggttgagttttggtaaccctagaatttagttaatctttaccgttttgcgctgaaaaacggtcgtgcttctccacgaaagcgagaagattatcctttattagtttgctcggaaactagtcgttcatcgtcacgtaagtacgatatttatcctctttgctaatttgcttgtaaattagtcgtgtgatttcacgaaagtgaattaatctcgaaatcggtttcactagcggattttgatcattccattttgacgactctattatttacaccgtaaatcggtaggtgatcttgtgttggccacgaaaaagtgtcaacacatatattataacactataatctaagtataattaatatattctgataccgatatagacattatgatacaaatgaatcaactttatagatcccctcttcgagtgaggaggcaatgatgatggtggcatcnagcaaagacggccggtggtggcctatcggatctaacaatagcggtcttgatcgactcgacggtagatgaatccgcaataggggcctcaaacaatgcagcgatgggcgaacctgatgatgacgggggccaagatgttgggcaataatggcagcttcaagcaagtggactagggctgtgtttagttcagcacaaagtttaaatttggttaaaattagaaatgatgtgactgaaaagttatgtgtatatgataggttgatgtgatggaaaaggactgaagtttgaatccaaactctggttctaaacacacctagggtaccagtggccatcacctcctcccctttagtgtggctcgggaattaaggccacagcgatagctttgatctccatgggccatggcgatggctgggcggctgcgctactggcaacgacgtgatagctacgaccagggtttaaccattcaatttcgaagtaaatacagcttctcacaggtttatcgaaatccgaccgaaaaccgataaaatccgatgatttttggtcaacatcatacaaaaccacctaataccgaccggttgatctaacggtttcatgaaagaagtccggtttttgcaaaatttcatcggttttgtgaaacaccggcaacgggcacaacttaattgtagtcagggtcatggtgttcttttttattactattttatccgtactaaaatataagaaattttggttggatgaaatatatcttaggccgagtttagtttcaaactttttcttcaaacttctaactttttcatcacattaaaactttcctacacacacaaacttccaacttttctatcacatcgttctaatttcaaccaaactttcaattttagcatgaactaaatacacccataatacaatttagataggaagactactcggcttcgtaatactaggatgtgactcatccaaccaaaatatcttccattttagtacgatataaggagtacatatcctttcacgtagattgatcggaaactgtgtatattaatttgtactcgtagccattcatatcgacattttgtatagtagtgacatgccatacagtaaccaggtttatagatgaccattttgaactttgatcatcggacgtttaggaggagaaagaaaaagattaggctgtgttctttccgataacggaacgataaattaacacgtgattaattaagtattaacttaaaaaaatttataaaatggattaataagattttgaaaacaactttcctatataaactttttgcaaaatgtgtactgcttagtagtttaaaaagcgtgtacgcgaaaaagatgtggccggttgggaacccatgagaaagaacacagccttgaagatactaaaacgtggcgagtcattagcgtatgattaattaagtattaattatttaaacttgcaaaaatgggttaatattattttaaaacaacttctctctagaatttttttaagaaaatacatcgtttaacaattcagtaaccatgtacgcagacacagctttgtatttctaaaataatgtcaaattttgcatacactttgaatatgccagtgaaagaaaaaagaatctaaacatgggaaacactaataagtaagtacgatactggcttcatggatatatatatatatatatatatatatatatatatatatatatatatatatatataactcgatctactgtggttcaaatcttgacaactgcacacacgcatatatggttttaatagtaatttagcgaacccttttgaaagtaatgtagtgaagttaataaatgcatttattgttaaacgatttgcactcatgggtgaaaacggtagggaaatttccgagatttttagctgccgtttccagtttgcaccgaccgtttcagtcggtatcggtaatcgacggtgatggaaaaggaaacggtaatatctttcagaaatagtagcggaaatgggatggaggtttttctgaccgtttggtcgataatattatttgtacggtaatttccgtcaaaattccgaaacttctccagcggctaagccaacccaacccatcgaaagcccacgaatgaaggaagcttgatagacttgcagcctatgaaaaaggaaagtgaccaaggaaaatgttgtaaaccctatgacgtggcatgtgtattttgctgaactttggtcttttccaattatcgatgttgaagtattgttgaacttgactatattgttcgtcacacttattatcatatcattaatctaacagtgttatgctgagggtgataatgcaagaataaagttaaaatgtgtgctatgccaggctccgctgattccgacatgaattttcgacttccgaccagtatcggtatattctattctgacggtcccgtttccaatataccgatattaccaatatctttttgggtctaccatttcatttccattttcgagaaaaaaatgaaaataaaatcggtatagggattttccgaccgttttcatctcaactcatgggctactgtgaataaggtgtgtgctgatatgcggtaaccagtacagagaaagaaaattctgaaataagcttgtgcaattacccgtttatatgtccaagttcgaatagctactacccatctcaaaatgtaacatgttctattcaaatacattttaaacattttatattttaaaatggaggttgcatatatttgagaggaagggagcagaacaatttcccttctgtaaattatgtgatgccgttgtgtctctttaaaaaaagaactactggagtacccgtgatttggtaggccttcaattctcctgacagcaacatttgctcacaatatttacgttcagtcaaaggctttgaatgggtcccctttcctaggcatattccacagggttaactagatacatgccattaaaaattcaccggttttgaaatataccattactatttgcgtatttggaacgatgccattgatatttgtttgtaatttcagtggtgccactaagacacgtattttgcatgtattggacgaaaatgccctcatcttctacctctctccctcttctctcatcttcaagctctctctccccgctgcttcaactccggcgccgtcaccgccgctgctgctgctcgacgccgctgctgctcgccactcgcgctgctgctcgccgccgctccgcatgctgctgccgccgcaccgccgctgccgctcaccgctgccgtcgctccaccgccgctgccgctcgccgctcgcgccgctgctgccgttgttactcgccgccgctccgccaccgctgccgccgctgccgttgctgccgccgccgctccgccgctgccgctcgctccgccgccgcctgttctctgagctgtggaagaaaggagaggggagaaaaagaagcaaagaagggtaatttggtctaaattttttcgtaaatggtaggtagtggcatatcttgaatatgtgtaaaattgtaatggcatggttccaaatacgtgaatactgatggtatatttcaaaactgataaatttttaatggtatgtatctaattaaccctattccacatcaggcatatccattttggtggcactgtcataatttctcccatcagtgcgacaggccaattactcgcaaacacacaacagcacaatgagagcgaacacagaccaaactgcaatttgatatatgtttgggctccacatttaagtcttttttacttgagcatgggcatcatctcagtcagatggttttcattgcttaggtggtgtttgatctatgactaaatttaatttagttcccgtcgaattggatatttgacgctaattagaagtattaaatatagactaataataaaactaattatataaataagagctaacttgtgagataaaatttttaagcctaattaatccataattaacatatgtttactgtagcataacataggttaattatagattaattaggctcaatagatttgtctcgtgaattagtccaggttatagaatggattttttatcattagtttacgtttaatacttctaattagtatcaaacatccgatataacaggatctaaaatttaatccttgatctaaacatggccttaaagccacgcaaatactttagcatgggcattgcgaacaactacgcatatcaggtatctacacgataggtttatccgactaccttatatgaccctataagataggactacatataaaatggtatgtaaaattgtctgtattttactagtagttgctaatagtagttggttttttagggactgagagtataccacaactcgattatcatatatcataatacacttaacgaatacaaatcctcaaataacaattgggtattacctctcatcggaagggtttggttctgtctaaatttttgttctagcaatccatttacttttagatctagttcactgtccctttaatacttaccgatatagaacatcaacaggcatccattaatatcttcgaatttattttctgaaatgctttcctattattgtgccccagctcagctcttgtttttgaaatttagtgacaccaaacctcaattttcccacaagttccaccgtccttctgacatttctatatgacccttgtctccttcctttgaaaggtcattattcccttgttacaagcagtcagtttctgagaaattaaagtaggcccttgtttagttctaattttttttttcaaacttccaacttttctatcacattaaaactttcctacacacataaatttcaaacttttccatcacatcgttccaatttagccaaactttcaattttagcgtgatctagacacacccctagatcatgtagttcggcctcattaacatcggtgaagctcatcatcttgtctggagcccatcgtttccatcggttcctgtatataggagtactatatatagatccgtctcaatcgctactatagatcaacggtgtcaattttagatgttgcttcaagctacattctcgctacttcatcatgaatgagtttagatactccctccgtcccacaatataagggattttgcccttgtcctataatataagggattttagtgtcctacttatcacatccatcaattccaattcaaaattttacccattttaaccctcaactacgcactcacctataagcaaatatcatttaacagggacattctagtattgtcttgctatccttaaacttatccaaaagggaataatccctcatattatgggatggagagggagtatatcaatcgtgctgatggccgtaccataaaaatacaagcaaccgtcaacatcgatcatgtcgacgtttgatatcgcaagtacggtatttggggatcgttggtaccagggtatatgcgagattgaggtaaaagagatggagacaggggtttttatataggttcgggccccatatcttacaggtaatagccctatatcctgttggccgaagccggtgttgctctttattcatctggatcacacaaatacaatatctgggataacctagctaactgtcgtcgacttggcggctagataaccaactcgtagtcgacggcagggtggtcttcctcctcgaatacgaactcggcgagatcagagataacgctagatccctcttgccggcctccgtaggtgccggatggggtatggctaggctaatttctgatgtcgagatctgacggcgtattggtctgtgttggcttgtggctttgtggcgtatatggtgggtgtgtcctctctccttctagggggctagtatctaaacccgtagatgcattcttgtctaagtaacactaaggatataaatataagtacaatccgagtagtcatggttgtttttatatagaactcttatgatcagttcttatcgggaactccctttatatatgatgtatgtttctgtataagtcatggtatgtggtgggtcctgccgagtttagtccactactattaggtatgtggtatccataaccttgacagatcaattaatccaacatgtaaaagcactagggataattctatttcgtgttccttaaatccggaaatggtttaatttaatatcgtgcctcaattaactcatttaaatcggacaaaacttttctcttcttttttcgtgtcatttggcaaatgaccacatggcgtccatatgggatccaagttgaccgtagagctagctttctataaaacgatttgacttgattatagaaaaaactaaatcccctttattgtaatttttctatctctctctatttccctccattataattaagcgagtgccagtgtgccaccttccacactgtgtaaactccacgtatatagtactctctccgtttcacaatgtaagtcattctagcattttccacattcattttgatgtgctataatgactttaattgtgaaacggaggaagtaggtcaaaaccacaattgaacgaatggaggggcatatttatctgatttgaaagctaaaagatgacacaattagacattggcaagagttaatggacgtatcatctagacgactagactaaaatttgttctcctcttaattatgtttgttcctcaaaacaagtttaaaagtacgtacttcctgttaattgctcgttcattttaattttcatctcttccgtatcatccgaaaatcatatatacaatcttttttatctctatagtgggacgggtctaatatttacctggtagtgaaaatcatctttagtaccggcgcttataacagcttagatatttgcgttttgaaccgttcgacgaaatatcaattctccccgtagtgttatcgattcaaatcatacgcacaaccagtcaacacgataatttgacgcaataataagctacaattatgcacgccgttccatcctagctgtagcttgcatccatgagcgcatggcggcctttcttggaaacggaggggcaagcaaacaagcaaagccgg

SEQ ID NO: 25608 - DNA, 11797 bp, Oryza sativa
  unsure (1)..(11797): unsure at all n locations
ttcattttactaggatgtgtcacaaccatccaaaatcccccctccatctcataatataaggcgtgagcgtatttcaagattcaaactttaaaacatttgaccaacatatatttaatgtaatatgaaataaattttatttgttaaaaattatatcattaggttgacatttaaatttactttcatatgattataattttgttgctacaaaccttatagcatatgagaaattataagttaaagattagttttggagactgcgtaacttttaccatgtcttatattatgggatggagtattatattgtgggatggagggagtaccaaagtataaatctaaacacttttaatgataaaataaattaaaacaaataatattaatgtaattttgttaaataaaacgaacgatcaaatttcatagttaaagtcaaccgcgccgaatatgtatgactggataggtgtagtttttccgtaggccggctgatgtttatccatgagcacattattaaccgttgatttttgctttttcttaaaaaagatttctctccttcattgcacttaacatgctcaattgcattgctgacatagcaacatgcttttcaataggtgtaatttttaccaatccaagagtcgctttaattctttcactcagattttgcaccggccatgacggccttttctcagctgggataagtacataattcgactgagaaattatgggtcagacaagcagctttctctctagttcgatcatgtcttgaggtcggcacaacatcttttgtctccttaaatgccggcatgcagattgttttcttgagcataggctttttgtttagagaaaatcggtgtccaggttatttcaactgcatcaggatttctctatctcaggatcagacgatcagtcatcgtggtgtaatttaatttcctcgtaagcttttcattgatccatccctgacagattactaaattcacgaactgaggaataacttccctttaaaaattttccttgtgataccactgagacatatactaaggtagtcaaatttttttttctaaagtgtagctattttttcaactatcctattttctcaaccaattacaaccttcttccatttaatttctctgcctacattcttttgttaaccaatcacattccaccactcaatttcatatactttttaaattcccgtaaaatatctaaaagtacttacattttaggactgggtgagtaataaataagctgaacaatatatatacgtgccatatagactaaagggcccggttgcgttttgtagagtttcaactcttaaatttaactcctgtggttagatacttagatctagagtgaaattgtgaagcagcctaaacacagatccaggtctctagtttattatatgagaacactccagctatcttcactccctttttaagtggactaaaaccgcttgattaggctttagctaatagaaaggtggagttggagctagatccgtgtttgggatggagttggagttggatccatgccaaacagtccctttatattgaggagggaaagaagggaggagatcaactccatatgtacgattgttatttggccaagatatcacgtaccatgctccgtatcaagatatattaagttctaatctttgaatggttatcgaggagagtggtattttttttaatcttctggggatagttacgatgttattacattatataatagtattgtaacttatgtctatgtctatgttactgatagaaaaaaagaaccctttgctcggttggctagtagcgtacatgaggtcgctaggtcgaatccttgcatgagcgagctaccattttggctgcaaaaatgcagatctaatagtatacaaatggaaggtttcctttcagaaaatctagcaaaaccattttcttgttcgatcttctattcccaagaaccgaagaaactaagtaatagaagtaggagtaagtccacttgaagtccctcaactttacgtcgagtttgattgatatccctaatcctaaaatcagaaattttcattcttaaactgtacaaaaaaaaaagcatacaacttggtctcacggcagtacataccctattcccccctttattttctcttacatggcatatgtttgggcccacttgtcagtactttgagtcacccgtgctcgtgtttgttctctcttgtccccatttgctgcgatgagccggaccgtcactcttgagccagaccagtcatggagctaggccgcatgcttcggctcgttgtgccgctggtttgtcactcccgtagagttctttttccgcaactgacttgtttctcttcatgtgcgacccgacaaagccgcatccgtgcctcgaggttggagcacaaggccaccataccaccaccacaccgctagtagcgagatggagctggcaagaagagaccccaacagcagacggactagtggtggcaggtacagcgtcgagcagtcgtcatcgccgtcgctgctgcaccacaacgaccccatcgggaacccggaggcctccttcatcccaccacaagcacggaccaagagacgcgccaccgccccctacaccggctcgccgtaccaccgccacactacttatggcgagacgacaccggcaagaagaggccccaatagcggatagaccagcggatgcgggtgcaacatcgaatagtcatcgtcgccgtctgaggaccaactactctgagagcggcaacagctaaggcgggctcgtcgcgcgcggcaacaaaacagtgattgcgctagcaagcttcatgaccatcaatggcagccgacaagggggtcagcggaggctagggccagaggcagtcgttctccatgcactggcagtaggaggtccccgagccattgccgtcatgtccgactaccgcaaatgccgcagggctgcagccagtcgccttgccggcgtggtgaccaaatcagcggtaaaagctgtggcagaagaggatcgacgggagaagaagaggagttcgccgtggaccagtgctgctgctgtctcctcctacgaacgggctcaccggccactgccactcccttggaagaggagatgaggggaagagaggagagtagagttggccacttacatgtgggccctatatgtttttttaaaaaaattttattcttgctgactagaatgcgtaaaaccatctatccatactgccatgtgatctaattttacctggttttacaagtcggagggtcaagattcccggtattgacgttcagggattttatttaaacttgacggacgtgaagtggacttgttccttcaaagtacccccacattagttcacctaaagcccaaatcttccaggccatcgaactacctgcccacccaatgtcaggcaccaaaccaggcccagtcaccaatcaccatgcgccaccgcccactgctcttgtcccgcgtcgctggcttgtggttccacaccagtacaccatcgccttggcaatttggcattgatctcctctccagtctccatgactccagaggctcttgggcttgccaacagcgaggtcagaaaaactgaaaaacctccaccccctatcttgatctggtgtcttgcgatccgtatgatgatttttctaatccgtcgttgcgtgtttgaatttcactgtgagttgttgccaggtttgttttgtaaaaccgtaaaccaaaccgaaacaaaagcaccgtttattcggtgctgtttgtattttcctgaagagtatttctattggcaattttagaaaatcgaaattatgaaaacccaagaaaccaaacagaattatccgtataaaccgtatggccacccctacatcattttttatttttacaatcgccctctaagatgaaaacctaaatgtggtatttttttaaaaatacggtacaaacactggtgctatacatgcatattcaccctgttaacgtgcacatatacgctctatttctatgagtatcttagaaacactggaccgttatatgtttatccttataaacacgttcgaaagactgggccggcatattttgagagtgacaaaattaccacgataactccataagacaggtaagttgtttaacactaaaagaataattagacataatgcgagcatgtttaggacttaaatccggataagctgattcaccccaaagaaactaatcggttaagctcggttgcgttggttttaagaggacttaatagagccctatagctgaaaaaccaaacagtggtgggaagaagggataaaaaaaatgctagtatgccactagtaaaaaacggtttttacatacggtccaaaaggggttcacgcatgcggtatggctaaccgcacacaccaaatggtatgcgaaaatcgctacttttacgtgtgggtggtgcacctatatgtgaaaatcagattttcgtgtacgggcgcataagctgcccgcacggaaaaatggaaaatctcaaaaagaaaaataaaaattccaataaaaaaactaaccctaactctagtcggccgccgccgtcgtcgtcgccagcggatccgcctctcccatcttcgctgccggcggatccacacctctcgtcatcgccggtggccgatcacggtgtgtggaggccggatccacaccaccgccaaatttgcgcggaggaggatgggggagactcgccgccagcctcccactcgagtccgccaccactgtcactatcttccaagcccgccattgatcccgcgccctccgccgccggagagggccaccatgcgcgggggagcatggaggaggccgtcgggaggagcggggagaggaagagtgggtgagggtgggaagaggagaggagcgggtgaggccgggcgagagagagagagagggggggaggagagaataaaaaaaatagtgggaagaggaggggtatttttgcatgtgggtgagttaagagccctatgtgcgaaaatatccttatttttacatgtggacgttataagtggttcatttgaaaaattaatttttgtgtgtgggtattataaagagccgtatacgaaaattgtagacgcggacacttatagcctatttttaacctattagggtgtttgtccataaattttattttactagtgtgccattgccatgtagaactcgtgttctacattgatttgtagaagaggtggctggtgaacgagaatttctcttaaaaagaaaatgaaaaagacataaatgtaacacaactgcacaatgcctccgtggtgcacaccaaatccaaagccctgcacacccacagacctgcagtatcagtaactgtgcgatggaaaccgagggcggaagcggcatgacacgcgctaggattagcaaactgaaaaacaacaaaaaaaacacagtttattccgcacgctctgaacccaattttaataagataatcaagcaaatctcggacattcggtaacacgtataccctggtgccagcgtactaataatcccaaaataccgtgatcggatcaaacccatcgacaatttctaccattcaaatatctactattataaaaatcaaaaatatttttgttagtattttggtacgtcatctatattttgatgtttgagttagttttaagtccgttcgcttttgaaaatacatatccgtgtttgagtcggattttaaattcatttgcttttagaaatatgaaataagtcatataaaaaatctttttttaaaaaacttgcatactaacttgagataaaaatcagactcctaactgcagctcgtgattatcttaaaaaaaatatccaagcgaattcccacagtaaatttcaccatagctaaactgtataacaataataagattaaaataacattcacccgttgcaatgcacggacatcttttcaagttttgtaaaataaatatctgtctttctagttagtagtcacgaaggaacccaacaaatttaaatatgggatatattgcctcctagcctcccatttttccatcccaatctcaaacttcttttgaatcaagtttaggtatgaaatgtgtgcgtgcagtgtgatctcattaaatataactattgtggtcatttgtgtatgctgctaatctgtctctaatttaattttattataggacggatgttgcagttaattaagtgtagtggccccgtccaaacttgggtctttgttgctgggcattatttgcttgcaagctcgcaacacatatacaggtatacaacacgctaacccatcagttgtagggaaaatatggacgtatgagagtagttcacgtcattatgagtaaaaattttactcgtatatttactcatgagtaaaagttttacttggtgatgtagacgaatctcaaacgtccattttacaatccaacggtagtttttaggtttccactatatatgtgatttgcactatattttccctcagtggtatagcacagtaggcaacgacattccagcttctccaagccaatcagcaagcggcagcatcggcgcatcccagccttcgtaggtgggcagcagcaaattgctcagttcgggttacgacacaacaaaaaattgggtgcccaagttttttaaaaaatcggtcgtactagaaaaaaaatattttaccactagataaaaaatgtttcaccttgttaaaatgctgaaacacattcaaatcatcactaaaatatttcattcacaccggagggggagagggaagtgatacaaaggagaaagagatacaaaggagaaagattagggagggaacagtgatgggtgcaaaatgaatggttgagagggcccaatatgtttcttatccgccgggcccccatgagagagaatttttacaaatcgaaacaactacatatcaggcgtttccctaaaaatcgggtgttgtttcactgctattagaaaagtgtttcacctttgttaaaatgctaaaacacattcaaattatgactgaaacatttcattcacaccggtgaagcatcaacagattcgtttgcatcaaggagctagttaagaaacacctctaatagagaaatgtttcgacaataagataaaaatgtttcaatatattaaaatgatgaaacaaagttagatcaaagattgaaatattttgttcttcacaaatgaagcatcaagcttcaaaaactgaaacatctatggatatgcaagaactgaagacaaaaaagtgaaacaatatcaaagtatcccatgcaacattttgatctaaccccaagaacatcaagatgcattagctgaaacatcgaaaaatcacaaattttgccattttagatctagcttattcctcctctccagtgaccaccggtttcttcagtctcatttgcaaatccaagctagggcaccatgggcccttctatctccaccaaagctgttgaccatcaccccgtcattgccagtcctagccctcagctatgtcgttgttgctactcgggcaaacggaagctgcctcagctccagattacggggggcctgtcatcttcctccaagctccccggccttaagctatgttgcgagacctagtcggtgagccacacgggaggacgtccccactgcttgtggcagccaccatgtctgccgctccacaagaaccttagtgggagagggagagaggagcgatacaaaggagaaaaagtagggaggggaaaagtcacgggtgtgaaatgagtggttgagaagacctgatatgtttcttctccgcaggacgtccaagagagagagagcgtttccgcaaaaattagacattctaaaaagtaattaggaaaacaattaatttttaaacgactctttgcggtcgccattccttcgagatgaacgaggctcaccaccttaggaaggggaagtttaggtcatttaattctcagggcttgattatgtgtcgatatttcctattctgcatttagttactgaagatccagaacattatattaccagacttaacacttcttgggcgcatttttaatcaacattatttattgggtccatgattctcacgagcacttctgaagttatgatcgatcatgagatgctttgatgattgtgcagagaagatttgatcgagtgactgatttttagactacattaatagcttaactgatcaagaactaaatatgaaaaatatgttctatgatttgatcgatcgatctcgagttatacgttatgacatgtaaactccagagaaaattgggatcaggatatgaaatctagtattagatattatttaattacatactctagtatgaaaactatcgtgcaaatcgggatactcttgagctggccaggatatttttcctgtaatgcaaaaataattacgaattacagatcaatgacgtgcgcccgtgcagatgcaatggaaatatatatcggccacgttgccacttcttctaatataataaggcaatgtcgttgcctactatgcacgatgtgagctaatcacacgaagtggacaacaagttcgtcatgtgatttgttgtctttctcctttgtgtgtcgaatgacagatctcacaattatccaaaaaattttacaaaaaagcatttcactgagctttgtgcgtactccctccgtcccacaatataagagattttgagtttttgattacaacgtttaaccactcgtcttattcaaatttttttgcaaatataaaaaacgaaaattgtgcttaaagtacggtagataataaagtaagttacaaataaaataaataataatttcaaaattttttgaataagacgagtggtcaaatgttgcaaacaaaaaatcaaaatcccttatattatgggacggagggagtaatagataagccaacatatcgatattacattcgtcttcctaaataaaactaacatttatatttggttgtgaatttttttaatattaaatttggaccatgatatacttttgcacatttccattaaaatttttagtaagataaatgatcatatattacgttaaaaatcatcaccatcaaatatttaaaaactgagagagtagtttggaacacatgtttaagttacagttcatttaaacttgaaatgttggctattattattgatcccgcatcaaaaatcaaaggcgtgatgccacattttagattatccaatttacagtacattgctgatacaaccgtttttatggaccgccacttcgaaaaagcaaatactccatccgtcccaaaatataagtatttttagcacagtgccaagtcaattattttcaaatttgactattaatagcaaaaaaataaaaaaaaagattaatcatgtaaaattgatgttactagatttatcattaatcaaagtattacaatatgcaactctttttatttaaaacattttatatttatagatattgttggtcaaagtagcatctcgaagactttgtcggagtccaaaagctcatagtttgggacggagggagtaatacttatctcaatctctagaaacttatcaggactaaaaaaatcaattttcaaataagtaatgttttttttttgtttcggtaaagcaaagcaaatactggacccatggttttaaggctagctattcactcaatgattcttgccgataaaattcatcacaacaaaacaaattagagtctggaggtatagatttgttgagaaaaaaggaccgtgaataaagtattagacctaattaagtatatacatatgcaacatgtaatatacctacatgtattgaattcagacaacttttgagtatgtacttcaatacccaggagcctccctgtgcccaccccggaagcaagcaaacaaggaagaacaataccaacagcattttgcatgtaaaatgggtagatatgttagcattcctaaacatttctgtaaactctataattcaaatggccaggaagaccaagagcattttgactgtaagatggacagatatgttggcattcttacactacccattttctataactcaaactagaaatgggtcgaggccagttctgaattataaaattagtacaaaaactaaaataactaaaatatatatttctccaaaaacgatttggaaaaatcatacataaatttaattatgataaattgtgatttgttcagatttaagcatgacattgtgcttgtaagttatatgatattatatggagcatgtgatgattttttaggttttcttttaagtcatttactaatgcaaacatagttggggtctagcttgggccaggttgtcaaaaaactagtataaagccacacagccagaagctaaaatttccatccataaacacatcagactgccatctccctcaactagttgcaaaatcacacgtcttctacttccatcagccatgcctggagcagctactgccgcagttgttgacagccgccagtgcaaacagcacgcggaaggccctgctgcggtcctcgccatcggcactgcaaaccccacaaatatcgtctatcaagatgggtttgccgactactacttcggtctaaccaagagcgagcatcttaccgagctgaaggacaaaatgaagagaatatgtaagcacatcgatccttccacttcaatcgttgcactgttcatcattatcatcagttattttctgtcttgttatggaaaatgcttgcataatatcctatatttttgttttgtaaatattcggcaacttaattgaagtgtctcctgttattcttataacctcatagtgctatgaactaattgtaaaagatgttggtatttccttttcaggtcatagatcaggaatagagaaacgctacatccaccttgatgaaaagctcatccgtgagcacccggagatcatcgacaaacacatgccttcccttgaaaatcgcgtagacatcgttaccactgagatcccgaagctcgcggagtctgctgcacgaaaggccatcgccgagtggggccgtccggccactgacattacccacctcattttcagcacgtactctgggtgcagtgctcctagtgctgacctcaagctagcatcactacttggcgtcaacccttctgtctctcgcaccatccttagcctccacggttgctctggaggtggtagggccctccaacttgccaaggagcttgccgagaacaatcgcgatgcacgcgttctcatagcatgcgccgagttgacgctgatatgcttctcaaacccagatgaaagcaaaatcgtcggccatggactatttggggatggtgccggagcaatcattgtcggcgctgacccattggtcgatggagagcgcccgctgtttgagatggtccttgcctcgcaaacaacgataccaggtactgagcatgcacttggcatgcagaccacctgcagcggcatagatttccacctctctatccaggtgccaatgctgatcaaggacaacatccggcagtgcttgctcgacacattccgatcggttggaaacatgaatcctaattggaatgacctcttttgggcggtgcaccctggtggccgtgcgatccttgacaacatagaaggcgagcttcagctgcagccaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25609 - DNA, 19205 bp, Oryza sativa
  unsure (1)..(19205): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaaaaacataacacctcaaattcttcggcttcaacacttccgatttttacctagcttctcaaaatacgtagctacaaaatctatgaaatagactagaagttaaaatttgggatacctagtgttttgaaactcttaaaagctaaataccaaccagttgcttattagaatattaattaagcttccaaaatgggtctatgtatgactcctttcaattaaaatctaagtggggtcgtcaaacctattgaaatagtttttttttccaatgacaccaaaagctctttctgcccttttgtgcctcctttggattgaaagaaaaataagaaattttggagggtcgttatccttataaaagaattagacgatataccacgcattaaacggagatttgtagatattcatgtgtacatatatgtaattggacaacagataaagatagcatgcacttagatcttcttttcagagaacatttggatgaaagcggtaaataattatacaatgcaataaactttgtgtcaatgggagcatgagactgactggaccaaacagctcattctcttcttcagttggtgcgttctgtacattgaataatcacgcttgctggcgaatcatgcccgctagtgccgactatattgacagattgagaacattaataaaaaaaaagaccaccaatagacactagcagattctcacaactgtaacgggctatctatgacggttcacaagatgtgaaccgtaattttttttgcctaattatttttacatctataacgactcatggttccgagccgttacatatgacacacatctgtaatggtcgaccaaccgttacagatgacatgtcacattatgtacctattgtactataacggacgcctaagtcattacagatgatatttttcagctattatagataaatagatttgtgctattgagaccgctacctgactttgcttcacattacaaagtgaaaaatgaaaatatcctagagaaaggtaggttataaaaacaattaataaaataagaagaacaattttcatggtcgaacccttttgccactgctgtagccaattcattcatgacgaattttagggagatgcttagatactggacagaaaactgaagaatattattctccttgaaattgacattctgagatgattttagaaaaatatatactcaccttgatcatgtttgttcctatataaaactcatctttgagtgctactgcaatgacctgcacatgtttatacactggagtcttgcaatcttgtcaggcaagtgtctataataaaagaaagaaattcattagctaccagagccttctttgtggattgaaattgggtagtgtgcaagaaaccaaatcagccagcgaataaaaaggatggagcccgaaagaagcagatgcattgatatacctatatcctgactgaccagcagtaagtaaacataagaggatagaaagatctccattgttgaatggcagctatgagctgcagactgctgttgttggtggaagaggagagagcatcatttggatggataagagaatgaggccttctttagtttgcgaacgaaaagttttggcgtgtcacatcagatatacagacacacatttgaagtattaaacatagactaataacaaaacaaattacatattccgtctgtaaactgcgagatgaatttattaagcctaattaatccgtcattagcaaatatttattgtagcaccacattatcaaatcatggagcaattaggcttaaaagattcgtctcgcaatttacacgcaatcagcgtgattagtttttttctatatttaatactctatgcatgtgtctaaacatttaatatgacggaataaaaagtttctgcgtgggaactaatcaggttctgagaagggtcgcaggaaacacatcttagtttcaggttaaagaggggagacgaggaatccgagtcttggaattcagccggtcgtgaactactcgtgcatgactcatgagctcgcgatgcacaggcgcgacttcgatgtgaacaggagaaaggaataagttcatttggtatggagaagtgttgtttagtcccggtttataacccccttgtagtaccggttttctaaccgggactacgaatccgggactaaagatcgctatctttagtcccagttcaaataactgggactaaaaatcgatctttagtcccggttgatgttaccaaccgggactaaaatccccatctttagtcccggttgatgtggggagcatctttagtcccggttagtaacatcaaccggaactaaagatattttttctttttttctgtttttaatattgaatattgatttcacatcatcccctcccatatccaaatcatcacatatcacagaacatctccaaatcctcaaattctcaaataaatcatctccaaatacatcacaaactcttaaaaaaatatatcatctctaaatacatcacaaactcttaaaaaaattacatcacagggttctaaaaaattcgtcacagattcacatctcacacaaaaatacatcacagattcacatctcaaaaaaaaaaagaaaaaacaattcggccagcagccactgccgcctcccctcctcccctccgcgccaccgtgcggccccccgcgccgccgtgcaggccgcctccgcatggccctcggcgccgccgcgctggccgcccgccgcagccgccgcgccggcttcctgcacgcttcttcactgtgtggtgaaggaaaaaaggaaggagaggaggggagttagagataaggaaagagataagaagttagagaggaaaaaaaagagatagaggaaggagtttgttatgtggacgggaaaagatgatcggtactatagattatatagtgtgttttgatttttattcccggttagtagcaccaatcggaacgtgattagtcccgattggtgttactaaccgggattaaagatcctagagccctgacacggcctgacatgaaatcaaccgggactaaaaatgaattttagtccgggttggagttaccaaccgggactaaagatgatttttagtcccggttggtaacaacaactgggactaaagatcttcctcttattaatcgggactaaaaatgagtcccggtttttaatggaaccgggactattatgtgatttgggtcgaccgaccaaagatggtttctctaccagtgttaactttagaccgaatcccattttcatctttaacccaaaaccagatataactggtcactatcaaaatcagtgtaaacatgatttctcggtggttttggctaacgtggcgcctacttggttggtttgactaggtcttcgtgacacgtgcattggtgtggcgcttaggtggtaattcgatcctagaaaaataataaaaacagtgggcccacatgtgagcagcacacaaaataataataaatgtggggcccacgtaggccccacatgtcatcctctctcattcctcctctctcccctctcctttcttcctcatcctacctgtcgcgtgcgtcgtgtggggatgtgtagagacggccgacgtcccacctgccgccacatgccatgaggagcagaggctgcggagggagctcgtccccggtgagggtgccggtgatctcccatcctcttcttcctcctctctctccccatcttccctctcttcatctctctgctctctcctctctgttctccttgacagaatagtgtggaaccatcatagttgaagtaaattatttttatagggaattgaaagttttgtcatgccaatggttatattaaggaaatagcaaatgtactacttgcaaagatctttatacatcaaagtgattgtatagaatttataaatatttttgttgggtttttattttcgagtcttttggcaatgggccatgaatttgtatatgacaatatttccaaattttacaagtgcttataatattctctagtgtatatatgttgtgcaaatgtgcactgcacatgctcaggagggtgagcataatattgttgtagaataatgtgtaagcacgacgcctctttggcttacacttcctggtagtgatgagagattaggcggaggtcttggcagacgaaaacaatcctggccctaaggtagtaggtgacatggtgtgatttatacttatgatacaaataatttttcccgtagcaacgcacgggcattcaactagtatatattattccgattactgacattcatcatactttattatttattaatgcagtatagttggtatacatgtatacaggatgaaaaccggtaaacaagtgtgagtatatcgaaaggaccacaacattcatcttccatcagattagtttttaagagacattttattttttaattacgatatctttagtcactactatctgccttccaaacatttttatttgccaatactgccatatataaagtgagtatgagtacaacgagcggcacaagccaggtcggctttaggttggagttttgctagctgatcctagaaaaaatggaaaaacaagcctaaaaagtagataaaagatgggaaacctgagagccaaagaaagagagcagagatacaaggaaaaaaaaaatcagcaatggctacatccacatctacttggataaaaccgtaaggtgcatggctgcggggtgatggagaagaataagctactaggcgatgaagccaaagaagaagaagaaaccagtggcaacaaatacatgaggacagaacaacgcaaagaagacaaagatgagaacgaagtacaaaagaggcggacctgcttgtgttttctttttgtgcttgcagtgttgtattcctctaggagatcttgttgtgatcttgagccagatcaacagcaattttttctctgcaataataatactttgggttatctagctttgcttgtagttaatcatgcatgcatgtttaatttctcatggttaattgttccatggttcagatggatttatgggcaattctttgtattagctgatctgtgtgagtgttagaggggattacaagggtgattataatcccgttatataaaaaaaattgtattttgtgcggtgtgccaatatgcagaattagtaattatgaggcacatgcaagtgctatttttgttggttgctaaaagaattttggattgtatttatctggtcttagcaagaactatgctttaatagtctaatttcgggcatgtaattgacattattattgtaagaaatattctaatttcaatagtctaatggaaacaggaatatagaagaatctagaaggccgatcatcatagtcgctccatcatatattgccatgcatcaaggatcaacagaagggcaactgttttgtttgaaagacttacctagcattcacaaagatagacacttgcttatggtattcacacaagcaccctagaagtggaagacacattttttttggtgctgagcaccattttattctcttctattcaacctcaagtattatttcaatggtagcagcgagaggcaccataatacctgaaaatttagagcttactattgttactcaagatgggacggcatttgatctactgaataacacataaccaactttacaaaatcagctactgatagacagtttcatggaggtgcaacaaatttcatcaagttcactacacaatttggatataattgactgctctcttcttaaaggttttagtgcttgtttggaacacaggattggaaaaatatagtacaggaaaatcgagggaataggaaagaaattcatgtcaaaaaaagaaggattaaaacacatgaatataggacatgttcggttggttgtatcggcctgacttgcatctttgcatgcaactggctacttgtttggttgcctgcacatgtccaagacagtcccaacagattcaaaatgcccgcagctagactgatcaggaatggccggatcaagcttcactgctcatcctggcctgacgcgtgtagtagcacagcccaccctgcatccgtgtgtccatgagtttcaccaccgcgtaccaggggctgacattgggtcaccagtcaccacattgtccgcctagtaatttgtcccccaaaatataaaactagggtttgctggttttgcaatgaagtcaccaaccagttccctcataccaccttcgttagctgcgacgagctggattaggggcgaagagctccactgctgaaaatttagcgcacacggtctgtagttcatctagatcatgtagaaaggagtatggcgacatgaagtagtgctgtagagagtaatagatctgatggctcaagggacatggctgttattgttgccatcactttgacgtgagttcgccatcatggccgttcatcagttccacactgtggccctccatctggtcctcacgtcgttgtccctgctagagccctccaacacctccagctaccctctccagtagcaggacagccgaatcaagcaggcacgagctcatgaccaccagatctggctgtcgtgatggcgatggcggcgagcggtgggccagagcacagcgggaggcaatggtggtgaactcaacgaagcctcctctttttccttctcttttttagttgtccttttctctcttttttttgtcactagtttgattgcttcaaatatctagtaaccaagaggattagtactatgtatggaagctacagtttatgtttttgtatgatatatagtgattgaatttgaagaaggtgattttaatattttccaaagtattttggcctataaatggtagcagtaaccttatcatccaactaaataggtaactgcactcacacattatgcatcgaacaaaatgaaatatgttctaaaccgtctctctcacacaatcaaccaaacaaaatttaatgctagccaggctaagctcacgcaaacaaccaaacagctggatgcctaacctctaagccagactagactcaacctaggtggagggatggacaacgctaggaaaatgcgggcaacactatataagtgagtacaagcatagtaatcggagtaaactagctcagctttgggttggaattggtcaccgtgccattgccatctgcttgtagaaaaaacaaaaataaagactaaaaagtatattagaataagtgaaaattgagagccaaagaaaaaaaggaaaaaatttgtccttgccacatccatcactacccgggaaaaccctacggtatgctgttgctaggtgatggtgacaaacaagctgaaggtgccgatgatggccatggtaggagccttcatggtgcgtgagctcgctgcatccaagtggcttgacctccttagctggaacaacatatcatcgtccagtggcgcccactccaccatttgcatgcccttaggctcctacgtggatgccccaatagagttggtccccttcctaccaagtatctcggcaacgaggagccggaatatgactagtaggaggtgctcagtacttggtgaatgaagaggctctactgcctcatgtaggagatctaccaggtgatgaaaatgaagaagaggaagaagtgaatgataacaaagactacagtattctacacctctctaagctatgccctttcactacaacatacatctattgcatatatggctactaagttagacatagcatgtatcatgtaacaccatgactaagcatagtgtcatcggcagcaacaagttctgttcctcagtcacacatatcatgtacctaaaaactttggagcttactagtgttgccctagacacaatagtgcttgatctactgaacaatgcatgcctagtcttgcaaaatctactattgatagtctgtttgatggatgtggaagaaatttcatcatgctcgctagaaaatttggatatgattgatcacattcttctcaatgaaaactttgtaattttttagtgttttccatgtaaccttgtacatattttctctctgataaaattacactactaggcaaagccctggtagttttccccagtaaaaaaaaaaacaattgaagggcaattctttatttggaaactcttatctaacattcacgaagataggcactaacttatgataaacacacaaatagtcaggaagtagaagacacatttagggcccatttgaatcgcagggtagaaaaaacggaggaataggaaaaacataggattctgacaggaattgaagtgtaaaacagaggattgcaaaacacaggaaaaacacaggaatggtcgtttgattggagcgcaagaaaaacgcaggaatcggatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctatgaaattcctacataaatcctttgattcaaaggggcccttgctttgtgctggacactgctttgctatctaattcacctcaagcaccaccccagtggtaaacataagcagcgacctgtgagagtaggatgatacattttggttactttcctggttgacaagggatgaagatatgtcacgattgatgggtggttgaatcctgtgaattgtggtttccgagttaatccaaaaataaaactaaatgtggcaaatacacacagttgcttaccataaacacataagcacatgcttaccataaacacaaacacatgctaggtggaacatatatatatttttttgcagtgcagagcataatactctaggtattctaagtttctactagtgaccaaataatgatatatacaaggacacaaacatctaacaacataagagcattcccaattatagacactgttaagagtgtctatacttggcacataaaaaatggatactttaaatagaaactagtatatattgcaatccattttatccaactatggatccaacattaaatattctctcttaatttacattcccctctgccctctatctctgtctctcttttgcagcttctcctttctttgttgggcttaacttttcctctctactttctcgatacggatggtatgtaagcagggttcaatctatcgggaaagggaaatttttcgggggtcagcgaaataacaagatttcagaaatatttcggaaatttcgaacaaaatttccaaacaaaatttgaatttgaacaacaaaaattactgaaatttgacatatatcagaatataaacatgcattgagtccatccaatccaaaattacagaaatttggacaggatcggagaatgaaacgcaaggattgtatcgtcgcgtcctctgcggcttgcgtgccttctgtcgtcgtcgcggcggcgcccgacagccgcgccgccgccggccactccaaccaaacacaaggatgcgaggtctgcggcttgtgtcgccgtcgagccgaagccgcggagccgtcgctggcactccagcatgaggatgcgaggcccgcgctgccgtgtggcttgtgttgtcgtcgtcacaccggagagccgcggagccaccgccagccactccagccacccgtctgcctctggttcgagcaaccgccgctggtgctgctcgcttgtgctggaatgatgggaggagctgttgggggaggacggcggataaaggtgagtgaggaggggatcggacactggggatttttaccagaaaattggggattttgccatgaacagtgttttgccgaaatttttgaccggagctcactgtctatcgggacccaccaatagacccgaagtttcggaaatttccaaattttcattccggaattttcaacccggtatgtaagtatgtgacagatgtatggaggccaaccagcaatccttagggaggataacacatatatgtcagctaccattgtctgcagtgttgtattcctctaggagatcatgttgtgatcttgaaccagatcaacagcaatattttctttgcaacaataatactttgggatatctaggtttgcttgtagataatcatgcatgcatgtttaatttctgatggttaattgtttcatggttctgatggatttatggctaaaattctctacattagctgatctgtgtgagtgtgagaggggattagaagggagattatagtccccatatataaaattttggattttgtgcggtgtgctgatatgcggaattagtaattatgaggcacatgcgagtgctatttttgtttgttgctggaagaattttggattgtatttatctggtatgagccagaactatgcttcaatagtctaattttgggaatgcaattgagatcattatggtaagaacttcttgttgcgttcaataaaatgtagataggaatatagaggactctagaaggttcaaaatggaatagggattggacaaactgatcatcatagtcgcttgtgatatattgtcatgtatcgaggaacaaaagatgcatgggaaattctttaatttgaaagacttacctaacatttgcaaaggtagacacatgcttatgatatgcacacaatcacctgagaagtggaagacacattttttgtttcaacctaaactattgttagtctagatgatggtatttgatctatcgaatatcgcatgcccagctttgcaaagttttctactgatatactttgtttgatggaggtgcaagaaatttcaccaagctcactacatgatttggacatgattgaccgctctcttctcaaggacctttagcatttgtactcctaacttggtcttgttgcataccaaggatcaatgaaagggcaattcattaattttgaaactactacctaacattcgcaaaggtagacacctagtgatgataaactcacgaacatgtaggatgtggaagacactttgtttttctttttgtgggcaccattttggtccaaaatagagaaataggagaaaaggtatgatggtaaagaaccataagagaaaggaaaatttactttaaatgctttacttggagaagccctatctaatataatgttccatattttcctacacaatggcaccatcattttaacctatatttcaggaaaagtcatctttctccaaaatcacagtaaaaattatgaaacgagcagcacatgatagtaaactgaccttgtgcacgtattttttttgctggtgatgaggtggtggccatagcagcagttctccttgcaagttgcagcttgtgctggcaatgaggtgctgggcagcacggtgcaggcccctaggcggagcaggggccttgagctgcggcagcatggtgtaggcccccacgtagtccgctctccctcctccctagcttcctcattgtcaccgacccaccaccctcccctttccgtctcgcctactctccctcttctcgccattgccaagtcaccatgctcccctcccttttccgcccatggcctccttcctgtcggcaatggaagaggtggcacaacatctagatctagtggccctgccgccagatctgatgaccctaaccacaagcaccgaggttgatggagtcattagggattgagaaagggagaggagtggcagatctagagagagagggagggtgatggtggcgaatctgagaagagatagagagagagagagaggcgaaggcgacatatcaggggagagggagaggcaacgataactgatctagggagaaggagatgcaacaataggctaacgagagggccaaagacagtgatgggaaggggaggtgcacgatgttatgaatacgacttgtatacatcagagggcaatagcccaaatatatatatagatacaaggagaaccaaaagacaggaacatggaaagccaaaagacataaaacaataaatacaacctatctaatacacatctaacaccccccctcaaactcagggtggatcaacaacactgagtttggagagatagaacctgtgttgagctctagtttgtgccttggtaaagaaattagctaactgcaactcggaaggcacgtactaaagagcaaccacctgatcctgtacctgtgtgcgggtatacgaggcatccacaccaatatgcttagtaagctcatgtttgataggatcacgagcaatactaatagcacctgtactgtccgacaataaagaagtcggtgaagtcacagaaacactaaaatcctcaagtaaccatcgtagccaagtaacctctgctgtcaaaagggccatagctcttaactcagcctctgcactagaacgagaaactgctgtttgtttcttagtcttccaagcaatgagggaaccaccaagaaaaacacaaaaagcagaaagagagcgacgatcggaggaatcactggcccaagtagcatcagaattaccctgaagttgtaaagatgtggagcgtggaaagaaaagacaacgcgagatagttccacgaagataacggaggacacgaagaagatgactatagtgaatttgtgtgggggcagaaacaaattggctcagaatgtgcacagagtatgaaatatcaggacgagtgacaccaagataaacaagactccctacaatatgacgatagcgagtgggatcagctaacggttcaccatcagtggcagaaagatgaagattaagctccatgggagtttcaactgtgcgttgatcagtgagagaggccctatccagaagatcctgaatatacttggcttgagagaaatgaaatccttcaggagtagaggaaatctcaatgccaagaaaataacaaagaggaccaagatcagtcataagaaactgctcactgagacgtgctttaacaaaagtaataaactccgcatcgtcacctgtgattagcatatcatccacatagagaagtagaattgtgcgactgcggggtgaagtgtgaacaaagagagcaggatcatgagcactagctgagaaaccagcatccaggacaacagaggaaaaccgttgaaaccaagcacgaggagcctgcttgaggccataaagagagcgtcgaagacgacaaaccataccctctggaactaaatagccttgaggtggccgcatgtaaacctcttcatgcaattccccattgagaaaagcattcttgacatcaagttgcgatatattgcaatgacgagcagaagctattgcaagaagtgttcgaacagtagtcatgtgagccacaggagcaaaagtttcatcatagtcacgaccatgttcttgttggaaaccacgcgccacaaggcgagccttatagcgttcaagagttccatcagagcgagtcttgaccttatagatccacttacaagtgatgggacgagcatgagaaggtaagggaacaagatcccaagtaccagtacgctcaagtgcagcaagctcctctgccatcgcatgttgccattcctgatggacaacagcatcacgataagaacaaggttcagcaagaactgtagcaacataaccatagcgatcctctggacgaatcgtaactaaattacgatcacgaaaattgtatcgaggaggagcaaccggagaagcatccagagaaggctcctggatacgaggtttacgactataaacctgggtaagaggaggcacataagaagatgcagaattctcagaagaaggtgccagctgagaggaagagacaggagaaggaatgctagcacgaacaggagtatcaggaaaagtgagaaacagaagagagtcatcgggagaggatgtggagctgggactcatcaaaagtaacatcccgtgaaatccgcatccgccgtcctacaggatcccaacaacgataacccttatgttcagcactatacccagaaaaacacactcaacagactaagccgtcaactttgtacgctcacgtggtgcaagaagcacatagcaagcacaaccgaaaagacgcagattagaataatcaggaggctggccacaaagatgctcaataggaatcccaccctgtagagcagaggaaggttggatgttgatcaagtaattagcagtggaaacaacctcagcccaaaaatgaggaggaacagaagaagcaatcataagagcacgagcagtctcaagaagatgacgatgtttacgttccgctacaccattctgagcatgagcacccggacaagaaaattgagaaagagtaccctgctcggaaagaaaaacacgcaactctctagaaaggtactcaccagcagaatcagcacgaaacacgcggatgggagaatcaaagtgagtgcgaatcatgcgagcaaaagatttataaatagccaaaacttcagagcgatgagtcatgaagtaaatccaagtatgacgagaaaagtcatctataaatatgatataatagcgatgacctcctttggaaacaaaaggggctgggccccacacatcagaatgaacaagatcaaaaggacgcttagatacagactcactagaatgatagggaagttgtatttgctttccaagcttacaaccttgacattgatttaaagagacagctcctgacacagaccctaaaagaccacggcgaactaaagccgacagacgagaaccacaaagatgtcccaaccgatgatgccactgagcaaaagacaccgtagaggaagcagtggaagcaagaagactagcaggcgcagcggaaggaagacgaagccagtcaagctcccaaagacgctgagaatcacggcggcgagggccagtaccaaccaggagacccgtgcgatgatcctggacacaacaagagtcagaatcaagaattacacgacagccatgatccgtaagttggccggctgacatgagttgcatggccaatttgggaacgtaagaaacagcagggacactaaaggaagaaatagaaagagtcccacgaccaacaatagcaagaggagtaccatcggcagtatgaacagtagtaggaactaaaggagaacatatagatgaaagactagatctatcatgagtcatatggaaggaagcaccagaatctagaatccatggaatagtacctgaagcagaagatgatccctcagtagaagatgaagaaccaagaacagcagaaccagactgtgcagaaggtagagccacagaaccaacagaacctgtcgcagcagaagcagtaaggcgacgaagtaacataagaatttcctgtgaatctgaacctccagaactcttctgagaagaaccactagtacccttcgaagaattgccacgacgtaaatccttcttcttcctgaagcaaaatgactccacatgtccatctttatcacaataggtgcagtgaaggtgacccctagtagatggtacaactgtggtaggaggacgcgccgatgaagaagaggaagaaactgtagaatgaacagccggtgtcgaagaagccgaagaagccacagtacgaacagctaacactgaagaaggaagtggtagaatacccgcctctcgaagacgaatctcctcagaacgaatctccgtaagagcttccatgatagtaacacgcggatgccgagaaagtaactgtgcacgagtggactcatactcggatcggagacgtgtgagaaaatcgtagatccgacgaagatccatgtgagaacgctgacgctgacaacacggataggtatgacaaatagtcggtcccaaagaatcaagctgacgccaaatagaggataactgtgtatagaactcatctaccgtactatccccctgctgcaaagactgctcctgacgcaccatagcaagataaagagcatcactagtaggagcataacgatcatgtaggtgtgtccacatgagatgggctgaagtaagagtaaccacctcaccagtaagatgaatctccatactagctacaagaatagcagaagctcgagcatcctcatccaaccaagccttgtataaagcaaactgactctgataattttccatggcatcatcaaactgctctttagccttttctctatcgtcatcagtagcttgacttgcaagtgaaggcatagttggagcaatagggcaaggaggacagggtagctcactagataaaacatcccaaagacgctgaccacgcatatgaagacgcatgtgctgagcccaatggctgtagttgcaaccatcaaaaagaactgggcaatgaggaacagacacagtgccggataaagacgacatcatcaagaaggaagaagcgacggcgagagagcaaacagaacaagcggcagcaagtttttttttctaatgcctcagcccaaaatatagagccaccacgtgcgatcagagcacaacagtagcagagccagagaagcctttttctttctttctttcttttttttctttttcttttttttaaacctcccgatccagatccggatcggggaaacagacgccaagcgacggcgccctacaacccaggcggaggcgcccgcgacgaggggcgacggcggccgcgacgagcggcgacgaccggaggccggtgacgaggggcggcggctggaggcccgcgacgaggggcgacggcggccggagtcccgccaccagaggccggcgacgaggggcgacggcggccgggggcccgcgacgagcgacggcggccggcgatgagaagcgacgatagccggtgatgaggacaaccaccaaccctctacactgttctgaagaaattgatgatgttggggagcagagatggatgattctcagcgacaccatactagatcaagaggaacatcatggcttcaagatgaagaggccgataatcctcaaatcaaatcatggagaagccgagagagaaaaatctaagaagatgagaagtctaaaccatgctctgataccatgttatgaatacgacttgtatacatcagagggcaatagcccaaatatatatacagatacagggaaaaccaaaagacaggaacatggaaagccaaaagacataaaacaataaatacaacctatctaatacacatctaacacacgacaatggtggaaggctgacagtgaaagggagaaacatgctagaggaagagcctgagggatcaatacttaatcacacatccacaccgactcgacaaatccttttatccactcacaaataaaaccggcagcaatatcactgctagtttttattacaaactggcagtaatgctataaataaaattgataagtgaatgccctgccggccatggtgcaagctgtgtccatttccaccaagtatctccgtgatgaggaggtataatatgatgagcaggaggtgctcgggactcaagtgaaggatgaggttctactaccttatgtccatgatctagtcattattgcagcaatatttttctgcaataataatacttcaagatatctagctttgctcgtatgcatgtttaattttcgattgttaattgtttgatggttctgatgggtttatgattaattctctatatcggtttatctgtgtgagtgtaagaggacatcagatgcgagatttcatcccatatataaaaattagtctagatctaaatagctccatggatacatatggctagctagctagcttatgattttgtgcagtgtgccgatgtgcagaattagtacttacgaggtacgtgcgactgctatttttgtttgttgatataagaaattgggattgtatttttctgatttgggcaagaactatgcttcagtagtctaattttgagcatgtaaccaagatcaaaaattattgttgccttcaatagaatggaaacagcataatggaaatttctagaaggttccatatggatcggggattggacaagatgatcgtcatattctctccactacatattgtcatgcatcaaggatcaatggaaggacaattcttcattttgagacacttacctaacattcgcaaagatagacacttatgataagcacacaagcacccaaaaatggaagacacatttttttgtttggtgttgaggaccattttgttctctcctatacaacctcaaccattgtcccaatggtagacataagcagcgagggcgtcatgataagcttacagttactactctagatgagatcgtatttgatctaacaagcaaaggatgccacattttgcaaactctactactggtagactttttgatggaggtgtaacaattttcatcaagttcactacacaatttggatatgattgagcgctctcttctcaatgatcatagcatatgtactcctagtttggttttgttgcgcatcaagtacaacggaaggcaattctttaattttgaaactcttacgtaatattcacaaacataggttcttacttatgatatacacacaaacacccgggaagtggaagacacttattttttggtgctgagcaccattatttggtctctcctactcaacctcaattattgtccaaatagtaaatgtaagaagtgagggtgtcatgataccttctagctactttcccagttggcaagggatgaagatttgttaggattgctgagtggtgcatcatgtggatgaaggttcctgagttaatcccaaattaaacggtgctaaagataagcagttgcttactataaacacataagcacttacctaatacaaacacaaacacatgccaggtggaacacacatttatttttgtgatgcagagcatcattttgcagtaccatacatgtacactttcagatcaacatacatacacagtaggattacagtttgcagtcctacacacttccaaacattcatacacaacaattatctagagcataatacagagtgaaaagtatctgaatttatgccaattattgtggaattcccaaggttttggacggaattgaagttgatattctctctagttcttgaggagataatgacagatcgagctgctagattagactgaattggagaagtcttatgtgttatactataatttccccattctatatatatagagaggtaattacgctataacacccaaa

SEQ ID NO: 25610 - DNA, 17592 bp, Oryza sativa
tcttttcatctatatatgccctgctgctaccataagaaacaaaagaaccaccatggtatatctcatcagtgaatttgccatcagtatgagctgcattgcacgttacggcatcctaattagcaatgttgaaccctagataatgaactacatacttaaatcgacaaataactcaaccaaacagaccatattgaaagaataaaaatttcatcaaccaaatttacctacgtatgaatctaactacaataggcacaagatacatggagatttcaatgtctcttccaaaggcggttccccttcaacccagaacaacgtcctccacatgactaccattgggcgaaggccaagccagagaatccactccctttccatgagcacggaaaccctatctcatcagtgatcacctccttcacactctccgacggtcacctctactaaggcaaagaagacgaagtggtggcagaattgaaaatagagagaaatagaggggactagagaaaaaaaggcagggcacaggcagcgccacacatgtcgcaagagagcgcgttggctaccgggcttcgaggcttcatcgagccagcaatcgatgggccacggcatcgaggaagtcgaagcgacgggtagtatgcacaaagttgagggtggcagagctcaacatggttggtgtgtgcaatcacacaaggaagaattgaacaccatgcaatagccgatggatgggtcgacctaggaaatatgggaatagaattagaattatactaggtgattccccgtgttttgctgcgggaattactaactaatatttattgtctttttgtaatattagttattaactacaaataaaattggtttatccaaccatgtttggagagaaataaatttagtacactcggtaagagattgtagatgaaatattagttggtcaagatttgcattgtaggaagcgggaggtaggaaaaattgataaaaagtttttgtttattagtataaatcacaaaagaaactaaattatatcccgcactttgaaaatatatggacaaatatatgtgaagtattacaaaataatggatagatatgtttaagaactgtagaaatgatgagaggtatagatatatttgatgctgatggtcctttcatgtgatgggccgtatattttcagggccctatagtgagatttatcccccaccccggtcctatgtgacgtctgggccatgactcgatggcaccgtagggcaagctggccagcatcagggtttatcggaggctgcaagctggcgcgtgcgcgccagcagcgagtactcctcccctcacttagtcttaactaactatattagttaatatatttaacactaatgatagtaattaggaaagattttaaagatttttttgagatatttttactaacagattgaaaatttttgaagttagatttgaaaactttcgatttaagtttcaaattttaaagtcaaattttaaaaactttcaactcagatttgaaaacttttaacttgagatttgaaaactttcaactcagattcgaaaactttcaactcgagaatcgagattcgaaaactttcaagtccaaatttgaaaaatttgaaaactttcaactcgagatttgaaaactttcaactcgagattcgaaaacttccagatttaaaattttgaaaattttcaaatcgagatttgaaaactttcaactcgagatttgaaaactttcaagttcagatttaaaaattttcaactcaaaaattaaaaactttcaaactcaaaacatgctaaacataaaaacaaacaagaaaaaagtggaaaaagaaaaagaaaaaaagttaaaacaaaaggaaaaaaaaacctaagcgctccgcgtgcgtgcctgcaacgcgtacgcgctatttagctttctcgcggtttatcaatggtagacgtaaaatctaaagatatttcttgtctgcggttttgatctggtatcgagattgtcaaccctgcctagaggtttcctactttcctggtccatatggggaatttgccacccaatacaatgtctgttcttcgccatgaataaaaagttatcattacatgttaaaaagtccattaaaaatacataatacatagtatatatacttttgtttaatgaccgtactaaacaaaatcttctatggaacttaacagttaacaatgattatggggatccgtacccctgccaagtgccaacagaaaggaaaacattgggtattctcttgcaagcagaaactacgatccccatcctacctgtgtatgtgcaagaaagtacaacttatgcaaatatctgagatatgtatacttcaaagatacttgacaaaatggtacatgcatgcattcatgcatatcgtgttcaacatatctactgataatgtggcgctgaaaaaaaaaaactattactgcgggactcgacagtttatttgtttatctgatgaatgcacaaactgaactaatggacagacggaaataaacgagtactatgtttgagcattaaatttgttgtcgaaagacaactgcatacgtcgaaaaacgtggttactcaacagtggttgaaaggaaacgaagtgtattgaattttgaattgttttctttcttttttcccctccccccattacatggccctaggggactatttatagccccattacaggttcttactattagggtttaggttgtacaggggaatttacatgattacccttacgaaaaggacatttacaggggtacataatattataggggctcatgggcccctgatgggccgtctggcgatcgccggccctatagcccctaggcttgttgggccggaaaggcttcctcggccctcgcgggggcgaacttgccatagtgaagtcgtcttccttcggcagatagtcttcgccttgcacccttccctgagacgcctctggcctggcaaggcactcgtacgactcttcgcctcacgccgttcttgctccatagccttcgccacgggtttcggcagatttggtcgaagggcctcatgccatccgccaacaagcccctcacggacaagggtgagattggagcttcggccgagaccgtgcaaaccatgtggtatggtatgcggtgccccctttcgaccgatgctcctgccgaaacctacattatttctgcgaatgaagtttgttacttgtgcggctggtattattttgccgcgcttcgcctcctgcgattggtggttatatattttcttttcccgggccgaacggaacagtattgggctttcccttcgtgggctttttactgtgccgctcggacggtgggaatttaccgtttcgcctacccttgcgacacgtggcgctttattactggtgggtaggcgaacggtcgcccgggtgagctatatattcccaccgctctttccttttcaccgccacacttgccattttaccgcgtgcgctctcttcctccgtttctttcttccacagcatctcttgacccctcaagcgtttcgcccgttctctttcttcgccatcgcaaacgcaccgttcgccatgacccctcgcaagccaaaccctgcttcggcaaaagagccagatcccggccgagtcaatgacgacagcaccacctttttgggggtttctcttatggacgacgtcgagctggcgaagctggtcagctctggggcgttggttgaggggtaggctttcgccccagggaaagccgtggtgccgaaaccaatcgacaatcggacggtggtgttcgccgtcttttttgatgcagggctacggtttccctgcaacgtgttgttgccggagatccttcgcctcttcaaggtggagcttccacagctgagcccgtcggcgcttgttcggatcgctattttcgactgggcatgccggacttccgggtttgagcctaacgccgagcttttcggcgccatattcttcgccaccgtgaactcgaagacggtgattaccccaactgggacaaagaagaccgagttcaggagtgtgaacttcaacgttcatcctgagcggtccgatctctggccggtgaacgctgccatgtcgaagtgggaccgccattggatggctaggtggttctatcactccatccccttcgaggctggttctgactcggcgaaagccctccggtgccggcgcagggcgatcgcgccgaaccggaaacccaagatcaccgtggacggcgctatggaggcgcggttcgttctgctgcgcaaagtttgctcccgccttagctgccgtgacttggtagaggaattctgtatgcttcgcatctttcccctctcccaggcatggcaagtcacggttgatcaaggcgaagaggttgacggtttgccgaacctgattcttcctgaggggacgaacagtaagactgttcttttgctatatactgctgtgctttgttattttgctttgtctgacttttaacatggctacacacttttacttttgcagtgttgaccctcgaccaggctgaaaccgaagcccgcaggatgatcggcgacgtatcggtcgtcgagtatagccaactgctaacacgacaagtagggatgaaaacggagcggatagtttccgtccgctccggataaaaacggatacggatacctttcggatcggataattctcggatagttcggatatggatacgaatacagatattttctaccggatacgaatacgaatatggtaccagggtttccgtcggatatggataataattcggatatccggtgaatagtgttattcggatatccgcaggacccatgagacataccccatttatttctaactctataaccttcaatatacctttatagattttaatagtagtttatctcttaacactagtccatactattaatattatttaaattttaaaaaatatttataaattatacctcattttatataaaatgagctaattatatatgttgatatttgtttctattagaagttgagttggttttcgtgttccgagaaaaaattgtttccgtattcgtgtccgatcatattcgattcttattcgtattcgagataatccgtatttatttccgtattcgagctatcagtattcgttttcgtatccggtaaaaaaatatgaaaacgaatatggtatgagcattatccgtccgtatccgctctgttgtcatccctaacgacaagcgtctgggcgggcgaaccgggtttataacagcgagttgcctcctcgggcaaacccccacaaagcggacgacgatgcagggccttcgcgaaagcgaatgcgcgggcaagtgaagcttgcccctaggaagcgaagggtccctgcttcgtcggactccgacgccgacaacgaggacgatgccgaagaacgcgacggcgagaatgaaggagaggaggaggccgtggccgataaggccgcgaaagaggcgatcgaagatcgcgtcgatacccccggctacactcctaccccaagtccaggtcacaacgagaccggggtggagtcgaacagctccctccttcgacgaaaggatttggaaggggcgaaggctctagttgcgttctcctcgggcacggtggcgaagggaggtccggtgaagaagatctccaaaaagaaaggactcgtcaacatcgcccgcattttcagcgacgacgagtcttctgacgagactccgacttcgcctgctggccgtagtttggacctttcgactgctccccttgctccgctcggcgttgctggggcaggcagtagcaccgccgccggggcttccgcctccgccgaacggatcgtgtcggctacggcgagggttttcgggagccctgtgcatgagccagctatttcgccactggtcaaggcgaaggggaagtgtgcggccgccgaagcatctgcctcggagtattcccttgcagcgccccactttgcccctggtgacttcgagactcgggcagaccttattccctttgtggagggtgtgagcaaccttgtcttgcccgccggcaccccgagcctgttcaccgaacttaacaagttcgacgaggggtgttccaccattaaaagtttggcggttcgggtatgccttttcttccttcttcgttttcctcctcttccctcttttttttacgtctcacaattagccttttgttcttttcgcccgctcctatctttcatctagattcttgcggctcactgttcgacggagcgaaccgtgcgggcccgttttgacggttttaagagccgtcttcgggccaaggatgatgaaataagccgcaagaacttggaggtggaggccctggcccacaccctcaaggaggcgaaaactgaagtcaaacgccttcagtccgaattggataaggggaaagaggccagggccgaggttgatcgcctcaaggccgaactggagaaggagaaggcccattcggcggtgctcatcgattactacaaccttactgagccgaagatggaggctctttgccagaaggctagcagggccgaagcgagcgccgcggaggagtcgcagcggttttcgcgagagatggcgaagaccaccgaatctgcgagaatggcttgccaaacgctccgcctcgcccttaccgacatggacgcgaaggtgcggggggtccctgccgaggatgcctcagccttcgacttctccgagtggacccagcaggctggcggatcggtttcggactgcgccaccgcgtacggcgattgctgtgcgcgtgtatcggcggccttcaccttaggccttttgcagcagttcggctgtgagcacgttgccgagttccctacctatgcgaagggggactgggagattagtgcgcagaacattttgaccgctcttcgcgcgtggcgaaaacagttttggcagaaagacggccggtccgctgccaaggcgcaccttctggagcaactggcgaaggcggaggcggtagatcggtgcgaagaagagggcgcggtgggcaaagaggttggaggcgatgcccaggatcacccagaggtgtgaggccctccaccctttctttagagttttgtagtttttctccctcttttgcgtttgcctagagaggcgaatgatgtatattcagcaagttgccaccaaaccttaaaaaaggcttttttgtatatttggaatgtatgacacaatgttaaattcttttttgatgatcgaagtctttagcatattattatttcgctcatttcgcattatgccatacctcccccttctttcgcctattcttactatataagctgtgttttgctttttctgcgctgtctatcagggggttcgccaaaagttgtgcattcggcccccttccgggagctggcgaagtcaaaacgagaaatttgtggcattgaaggacctgccgaaggtgcgatgtccatttcgccctgtttatcgcaaaatggagataaacggtcagagctataaggttatcaaagttgccaactggctacgagcgcaccccgggcgaaccttagaagattacgatcttgttcattcaagacgtttggaggatatggctcgcttttggcgaaaccatcagaagactaaacgtcaggaaacgatctttcagcgtcgttacagtttagtctgtgtttcgccccctactcctcttaaggttgtgtatgatattagtagtgatgacgaacctagttcgtctgaccattccttagagagggataatgattacgggggcgaagatgtaatttacttgtagagtgaattgtatcgtgttgtgaaccttctattcttcgattatttttttgaagttaataaagaacgtgctttatttccttttcgttatttttcgcatcatcacattttgtgcttttgttaggtcggaacatgccggcccctttgcgtatattagcgaaataggtgtactgtcttttcagtttttcgtcgttcgttttcgatctgtagcattctgtgtcgaaagagacgcttttgcttttatgttgatcgaatcgtaacgtcattcggctagttatttttcgagacaagctgttgcggtttcaacgttcggcgagcgatgcttcggccgattcgtttctcccccctggcttttttcgctgatcaggcgtttgccttggggtttttccacaaattatcaatcacgcgaaaaaaaataaaaagaaggcgtaggacacagagattttatactggttcgggcctccatggtggataatagccctacatccagtttttttttcctttttttctctcttattttttttctttgccgaaaggcttacatagtgccgaagggcttacatgactgtatgtacatttttacaagttggcgatttgggtgccacccattctaggcatagaagcgcttgagagaggcggcgttccaggaatagtcgaactcctcgccttcgagtgtcgctaggcgaaaagatcccgtcctagacttgtgtttgatgaggtacggtccttcccactttgattcaagcttaccaaccgctactgggttcaccttcttccttaggacaagataaccaggcatcagctccgtgggtcgaacttttttgttgtaagttgccgaagtgcttgtggcgtacttgtgcatgtgctcgagcacttcgacccttaccccttccaagagttcgagcgatacttcgcgcccctcttcgcccccagagaatataacgcttggtgagttagcccctagctctgctggggtcattgcctcatcgccataaagaagcataaacgggctaaacttggttgatcttgtgggggtcgtccgaagggcccagagaaccgatagcaattcctctggccatttgcctttcgctgccccctcgagttttttctttagtgcttctaggatcttgccatttgtacgtttggccgccccatttgactgcgggtgcgcgaccgacgcgaacctgatttccaggttaagcccttcgcacatttctctgaacttatcagagtcaaattgcttgtcgttgttagtaatgaactcttttggcactccaaaacggcaaacaatgtttttccatacaaacttctgtactgctgccgaagtgattgctccaaggggttcggcttcaatccatcgagagaaatattccacagctacaattgtgaatttatacccgtttcgcgccaccgggaacggcccgatgatgtccagtccccatctggcgaagggccatattggcgcaatgggctgcagatcatactggggcgcggtttggcttcggccatgacgctggcaactttcgcacttcttgatttgctcaacacagactttcaacacagtgggccaataaactccttgtctaaatactttggaggccactgttcttgcagcctggtgcgcgccacatagtccctggtgtatttcctttgccatttcttcgccttcggcaaaagagatgcaacaaagtaagggttgaagtaccccggagcggtaaagctgacccgagaccatcttatacttcgtggctctaagttgcaaacgctttgcttttgcttcgtctaccggaagccagccagtttcaaggtgtttcacaaatggggttcgccagtcatatgggtcttcgcccagtttctcctggtcgattgccatgacttccgagctgtccatggacacacttggagcatgtaggacttcgaaaaagatgccaggcgaatgtgggccaccacaagcagcggatttcgccagggcgtctgcttcctcgttctggcttctaggtaagtgttcgaccgttatgccagtgaagtatttttccatgaaccgaacagcctccagatacctcttcattccttcttcttttgcttcgaaggagttgtcaacatgacctgctaccaacttggagtcgattcgaattagcaagcgccggactcctagtgctttcgcctttcttaggcccaggaaaacggcttcgtattctgctgcgttgttggttgtgtcgaactgcagtcttgctgcgtaccgaatcggcacatcattcggcgaaaagaggactgccgcaatacctgcccccctgtgcgaccacgagccatcagagcacatcacccagaattgttcggcgggctcggggtcgagggcaagtaccggtgtccattcagctacgaagtcagctagcacttgagacttgatagcagagcgtgcaacaaaatgcaagtcgaacggggatagctctgccgcccacttgctgagccggcccgtgacttccttgcctcggagtatttcgcccaaggggtactgtgatggcactatgactttgtgggcctggaagtagtgcttaagctggcacgaggccatcactagggcgtaagcgagcttttccatttcgatgtatcttgtcttcgctccttgcagtgcttcggagacgaagtagaccggtttctgtccgaactctgtttcttggacgagtgcagcactgactgccaccggcgaagctgctaagtataatagcagttcgcttcctgggggtgggcttatcagggctggcgggctttgcaagtattgctttagctcgtcgaatgttgcctggcactctggggtccaatcaaactttcccgcgcccaggagggtcttgaagaagggcaaacctctttcggctgcctttgagaggaatcgactgagtgccgcaattcggcctgcaagcttttgtacttcatgtacgcttgacggaggcttcatttgctggatggcatcgattttctcgggattcgcctcgatgcctctttcggaaacaaggaaacccaacaacttgcctgcgcaagctgtcgaatgtctcctgcagatcaatcgcatggtcgaaagccttgcggctttttacgacgatgtcgtcgacataagcttccacattccgccccaactgctcaccaaggactttgtacaccagtctggcgaaggttgctcctgcattccttaagccgaaaggcatcctgaggtgacaaaatgtgccaaacggagtgatgaaggatgctttggggatgtcaagcgggttcatgtggatctggtggtagtcggaatatgcgtccaggaaactcatgagctcgcatccagctgttgaatccacgagctggtcgatccgtggcaaggggaagtcgtctttcggatacgctttgtttaggtctgagaaatcgacacacatgcgccatttgccatttgacttccgcaccaacactggattcaccaaccactccggatggtcaatctcttggattacccctgccctgagcaatttttgtacctcggctttcgccgcttcttggcggtcggcagacatcttgcgcaacttctgttttcttggcttaatgtccagcttgaccgccaggtgatgcatgatgagatctgccggaacaccccccacctcgtcagggctccaggcgaatgtgtcgatgttcttcttgagcacctctaggatactctcaacttcttcttcgcccatgtcgccccccagtgatacaagctttgtggggtcggcatcatcaatctgcactttcgttatcttgccgtgaggggtgggctttggcatgttcttcggctgttcatgcggttcggtctcaacgctgtgcactgctctgttgattatggctagatcgcttttcgaagcggccgaagactgaagccccttgactactatcacccctgccaggccgggcatcttgagcttgaggtaattgtggtgggaaatggcttcaaacttgttcagggttgcacggccgaagatggcgttgtagttgtacgggatgtcgacgacgtcgaacagtatttgctcttcacgtctgttctcccccgagccaaaggctatcagcaagagtgcttggccgagtacttgaactgcttctccgccgaaaccgcggagtgatgctggtgctggggtaagtgcttgggtaggcaaccccatcttggcatatgcttcggcaaagataacttcggccgaactccctccgtcgaccagtattcgtcggacctcgaaactagattacgaaaggatcttgatgcgggaacataactccttctgcgtcttccggcccaaaagaaattagctggtttagatattgcggcgccccttcgcccgccgaagtgatgctgtggaccatacggatctgcatcttcttctgccgcttggacaactggcttggcgggtcggcccttgtaatcacttggattatccttcgctgtgcatcttggcgttgtttggctgggggtgtttgctcctgaactgcttcgcggggtgcttcgacagttgttccctgctgcagccttgggtcttacgcgttgccacattgcctaatgtttcggcattgctccgtggtgtgcgaagagcgtccgtgaaaggcgcagtagaggtcttttcggaccttcttgcgggctggctgctgatggttgcttgcttgctgggcgtctcatgatatatgcctgcatatacatttgcgtataaaaagacacaatgaggttcagttacaataaaaggctgaccaagattatctatccaccctgacaattttgttttggctagtttcagagcctaaatatttcgttgttattatggagtagtttcatatgataaggagcaattctgctgagatatatgtttggagaaaattcatacttagttgcttacctgacttgatgcctgtaagaaagcaagccgaggagccaatggagtttcaaagaatcagatcggaggcggtgaaactggcgagaagggcgacgagcggcggagtggcgcgcgacggcggactggcagcgttagggtttggagagtgatggaggcggcgtgaggagcgagaggtggagggggcggggcgtgggttggaggcgcagtggagcgagaggtgggggaccgatggcccgcgatgcggtgccgggggaggggagcggaggaatttcgcgatcggaacaggaaggaaagtgcgcgtgattcgggggcgctgctgggtgagggaaggcgatgggtacgcgggagacgttagattgagatgagataatctggactgttgagtgacaaatgaaagaatgagtgataagtgatgagtgaaaccatttgttgaactatagggtagatagataactctataatatttatgtattctaaaccaaaaatataaatattcacaggatatttttagttggtggcgcacccattttataatatatggttgaaaataagactatttgtcctccctgaacttcatgttgtgccatgccaaggcggcagcccaaacatgacccaactattgggtcgggccaacacgggcccgacaccattcgggccgtgctatgcctaggccgtaccaaagcggcgtgccatgggctaggccgcgggccataaggccatctaaagttcaggaatgtgctgctgattttttttattagagcatgtgttaatgggattgtgagtatgatgttgcgggtagtgatatgtgtttgtgtgtctctgccacgtttcgaaaaaacaactgatatactccagtatacaaagattgcatttcaaggtagttctcatcttaaacaagatccgatgcgtccatccatgatcacaaggctgggaacattcctccctcgtaacacctacactacacgtatgagctgaacccaccgctcagtcaggaccagggtttcccaaactgctggggccggggttaccgcgtcccggcggtaagcacggttaccgcacggtaaccgtggtaaccgtgataaaccgtgcaaaatttatcaaaaattcaaattattttttaaatttatttgaatttaaaaaggttaccgaagtatttatattaccatacccccgcgataaaccggttaccggcggtaagtccaaccctggtcagactcaggagagactcccgcgggaaagccgaggagtttcccgccctgtagcgcccgccgcttcactccctcccaatcccccctcctaaacccagctaggtttccgcctctctcaccatctccatctccatggccccgaagcgccgccgtgcccgtccggcggacgagagctcgacgccgccgccgccgcctcctcccttgcggacggcgccttcgcatttgcagccggtggttgttttcgcccacggcgccggcgccccctcttcatccgactggatggtccagtgagctctcactctctttatctctctgtcctgtcttctctcccccctttgcgtgtgcgcgtatggataatcggaattgtggcgactattttgttggtagaggtagcgtcttttttttttttttggtatgtgcgtgatgatgtgcgaaattgagggagtgatttctcatctctgttagttggaaggatatggtgaaggatgcgctcgatgctatcgaagttgtcacctttgattacccatgtgagtttgtctgatgagctctaagtgctgatttgttgacccctcactgttcgctaaactcgttgatgaaaatctgttggggggagaatttcatggtagagcaacaatttgttggctgcagatatgtcaggtgggaagcgcagggctccgccgaaggcggagaagcttgttgatcatcaccttggtgtggtgaaggacgctgtagcgaagcatccagggcacccacttgttctgatggggaagtctatgggttcaaggtgatatgtgggagctttaatctcgtttattactttatttcagacttgtttgtgtttttgacatctgtctcaagattgtagtcctcatacatttttcagggtcagctgtatggtggctgattcagatgatattattgtttctgctgtcatatgcttgggttatccgttaaaggtatcctctgtgttgtgtggggtaatatgattgctacaatgtatgaggatgtaacccacatcaaaaaatgatttagccttcggtttccattatataataatttgtaggacctgaaccagtttttcaggaaaagggttgctgtgattttaaaacatgctccacttggttattttcactctctgttatggctctacttagggatgttttgttttgcatccttgctttcttcctcttagggagtgaacggggcagtgagggatgagacactactgaaactgaagattccaacaatgtttgtgcaggtatttctttctgaacacactttgaaatgaaaaataatattcaatattttttaagcttggtatgcaatgcatttttgttcacagggcaataaagatgggttatgccctttggataagcttgaggccactcgcaagaagatgaactgcaagaatgaactgcatgttattgatggtggtgaccactcctttaaaatcggcaaaaagtatcaagagtctactggagtgaatcaacaagctgcagaaatggaagctgttaaagctattgcaaaatttgtgcagaactccatagcaggaacctgaacttagctgtttatgtactatttagggtgttgcaagaattagtatgttcatgccttttggtatcacttagatgtaatagaaagctattttgctaagatggcaagaattaatatgttcatgcacttggtatcatttaggtgtgaaagaaagctattttgccaggatgctagttttgatttgcgcatccgcatccaacatctatttgttttcttgtcaaggtatgccatggttgaaatcattatcctgactactttacatagttgggcaatactgcttatctgcgagtcatgaatttgtctgtgggtatcacgatttaattgtaggtataaacataactgtaaacacagtgaagtttgtaattatcaagggatttctctttgctatcatcagagcaatatgaagtactttgtacaagatttctgttgtttaacatcaatctattttttagataacttacaccaatccaaatccatgaagatcttttgacatccattcatggtgctgaatttatgtacagaagttggcaatcatgcatgtaagtttaccttgcgttcctacatatatatttttttggaagttttgtttcatcatgcatgtaagctattatgaatgtaatattctgtacaatgttcaatgtcaaaagaattgataaatctgtcctggtgttacatccataaaacttcttagaataattctggagttacattcatgctgtcgtctttgtttcatcctggttccatctccatggttttgcttagtagacacccaatcatgggtggagcttcttagaggcttatctaggctatagccctcccctgatttaactactacaattaagtccctttactttgtgacaggtagcagaaagtaactgtagaatggtccctacgctgaaaatagtttgaacattatccccctcaaaatttctcttcaagctccgccactgcgcccaatgttgacgataaatcattttaaatccttatatgctttgatgcaatccttgtgtctatggtaaatcatgtttggtagcatgggaggtagactcttattccgagatagagatgctcaacattggatgagttgaataaagggctatatttccttaattttatttatatatttgaattgtatgatgtacctttgaacttcgttactgtgtttgttttcattttgcttgaggagttgttttcttgctgaggtctagggtgtttcttccagtatatggaccttgtgttttgttttctttagaattgaccaggagctgtggccctcagtgagatgggcaactggaaataacatcctaataaatgtaggcttgtaatagcatgcatcaagaatcatatttttataaattgagattttaaccccaacttaagaagtaggaatgatcatgatatgaaactatgagcgcagtaaacccattctttatttttcacattctactaaatttcatatgtcaggtggtaatgatcacttaatttgtgaatggtctggttttgaagccatctattttattaatgtttgttgtaatatgatgaaccttttgaatgatagacaagaaaacttgccaatttactgatgttaaacaactccaactcttctaggtgaatatattaaacaaatcgtaaattcacctggtgaatatggtgtgctatagcttcagttttcatgaagttccaatttatggacatgtgggctgcatgcctgcacatgcattcaagtgatgtggtacaatgatatatcataacctccgtagaacctttcaaataataagcttttttttatatagggagaaacaagacagatacatgaatgatcagagacaatatattctatgtaaccaagctttggtaagtcataaaacttttgctagtcatatcatagaagagggcttactcaatggcaagccatagaaatatagaatcttaaaaatctctaatgcatggaaactttcacataatgtgaagcatatcgtccttgtgtagcatttatgggtacaacagacatttcttgcaaacaaaacagataatatagttcaattttcagattaagggttatgcccttttgtgtccacatgacttgttggaattttcactacatttgcttgttcaatatcgtgaagcaccttaggtgcttccttgcatttgctgtaaatgcagtatacaaccaactcaagtatacccaataccctccccatgcagtttggggtattcacaagaaaaaaagcatgtcagtttgatatatagaagttta

SEQ ID NO: 25611 - DNA, 9967 bp, Oryza sativa
  unsure (1)..(9967): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctacacatcatacacagaaaaacacaatattgcacaatctagagatgccgtagactcgaatagtcattttccatgtaaatatgatattataattaactcatgcgtaggctaatgtagcaatagggatatggacattgtcaaaagtggtttaaaagaaggttaattatgatgatatgtggtaactggagcacgacctaatttacggtgatcatccataacttaacattgacaattactcttaccgacaataaaaaaaggttcatgactaatgaaatactaccagatttgagtattgtactgcacaagctggtgtacttgcacgacacaaacttgttttcagataaatatcccatactgcaatacttttgaatacatatttttgtaaatggagatgtcattggagcggtccgaagaactatgatgacatggtaactcaagtacgacctaatttacagtgatcatccataacttaacattgacaatcaatcttacggtcttaccaacactaaaaaggctcatggtgaaatgaaatgctaccatatttgagtatttgacatgggacaccccataccaacttgtttttagggggaaaataaatatttaggactggttttgtctggggcttgaccttaacaatttttgctaatgttaaatttcggcatagcctcttttgacaatgtaatactattaaaaataccaaatatttgtaaggccaatttaggccacaaatgaaaccaacctgaatctcttttattaatatattcttattctatatcctttataaatgaatttccctaaaaaattagccccaatcctatatgcttaatccataaattattctaaccatcaactaaaaaaaccctaaaaaagtttattcttgcaattgctcatgataccctcttgtagctcataggtatattttttctaaagttcaatattgtcgacgagtgatactcgcggaccggatgagtagagtattggggtacgttggaacgagggtttacatagtacgacatcaaagcagacaaaaggcaaggattatactggttcagacccttatcaggtaatagccctagtccagtttatatgggattgatgatgatgagaacagattacaaagagagtagtcaaaacagatgataccgacgagatcgtagtcgagggtttcgacgagatctctcggcaagttggctccgcgtactccagcttcgtaagctttggtgggtgtgttggcgaagagattctgatccgaacctctcccaaggggtccccttttataccgtgagtcatcttgatccccaagaaaggttttgaggatatcggacctgggacggtctaacggaaactttatcccttacgagtagaactttataaatcacttgactcgtaaagatattttccttaatttgaagtaacttccatacgacatatatgtaaataatccgtatacgtaaaggtataccatattggtatatttcacaagtcgcaggatagaaggtatgccttatccgtaaccctgacaaatatccctcttactaactagaaataaaataattagttcaaactcccaaaatggtgctatctatatagacactatatatattaccatttgcaaaaaaaaaaagaagaagaagaagaagaagaaaaatattcccttcatttttatctagttgacgcgggttagttccattttgcactaaccaacatcaaattttttaaaaaggagggattgtatattatcacaatagtttttaatacatacatgggaaaggccaaaagtcgcataacaacaaaagggtaaatgtgcttttcatcgaagaaaaagaagttcaaaatctacccttagtccaaatgatcatgacaaacaaaataggacataatccctgcggttccataattcttgacgtccttaccaataacacagggcatcattttttcgcttatgcttatatttatcagccaaaatttgaattttcaaccttaaatttggagctgattttaaggatttttttttatcgaagtttatttttcagcttttgcttttagatcgctaagaacgcacatataaaaattttattcacatactacttttcgtttgcaaatatgccatttcgcttattccgagaataagtgaaacaatggctccaatagtctttaaaatatatctttgattatgtttttatcttaaatatatatacatatataataaataaatataattttacttttatcataatatttttgaaaaataaatatctctatgtatattgttctattatatttataaactaaatacttttaaattatttgtacttctaattaaatttataaaagtttcacctcgaccgaattatgaaaccgttgcgagtataagagaaaacacaatcttaacaaaacattaagatgaaaaggatgaaacttttcatcttaaaaaaccgtgcacaaaacacaatcctaataagtacttcattcgttttatattataagactttctaccatttcttttatttatatagatgttaatgaatttatacgtaatatgaaacggaatgaagtagtaaaacattcagatgaaaaagatgaaacttttcatctgaaaaaccgtgcaccaccagatgagcctctgctttcagatctcaccaaccaaccaaaaaaaaaaatctcctctcttcttatataaataaggaactctcccaaacccctcttctccgtcctcctcctcctcctccctcgccgtccgccgccgccgctcgcttcctcccctctcccacggtaagcccgcgccgccgctctctccctctcctccgtcacccttcccttcctccgaatcggccgagtctgtcagcgacggagaccgcgccgggatccgtgcccattcgcgtagtagcggcgagcgacggttttttttttttttgcctgcaaagtcggtcgctttcgtgtggcgtcgggtcggggagaatggatcgatctgttcgtcttgatcggatggattgatcgatcaatcgatcttggtgggatccgatctgaatgaggtttttgggttaggaaatggagtgaaagattggactttttttttgtcggtgtgttgcacggttcgtttaggattggatctgtgttttcttccgtggaaaatcttccatttttcactgcaagtgcacatttgtggcctcttcagtacttgtgtttctaaacccgaggggtttttggatctgacaccgaggtttagtccgtgttgtcatatgttttttctcaaatctgttacgatattctcctattataaatgcattacggtgtactagaccctgtgatctgtggagtacatgttaaggtcgtgcttccagtaccatcgcatctactgtcatttggttgccatctcgtattatttggttaggaatttgcaattgcctgcatgctaataaatgaattgttgtttgtatggcatgccaaacaagatccaactactttgctgctggtgtgagagggacagtgtctcccaccaattgtagttggtcttatgtacccaccactttgggctgggtcctactacatgctagtgctggttggtggtgtacctaacccatatactagtatcagtttagtctattcttttagcaccactggatctggtgatatagccccatgtataggaatcaggaagattagtagaacagaaaacacaaaagtatgctttaatagttggatggcatatacctttattcggatcaccgttccaaatgtgacgttagtatccgttagtggcatgctttttaatctaacaaggcgttcttcatcgtgtggttagcatatggatatgtgtaatcttgttagctaaatcataattttcgtatgtattcacatgacatttcgatgaatcaaactgatcgtagtacaattgtttctatagaaagatggcgtctcacattgttggatacccccgcatgggccccaagagggagctcaagtttgccctggagtctttctgggatgggaagagcagcgctgaggatttggagaaggttgcgaccgacctcagggccagcatctggaagcaaatggctgacgctgggatcaagtatatccccagcaacaccttctcgtactatgatcaggttcttgacacgaccgccatgcttggtgctgtcccagagcgctactcatggaccggtggagagattgggttcagcacctacttctcgatggctaggggaaatgccactgtccctgctatggagatgaccaagtggtttgacaccaactagtaagtactttgcttccatttaagatgtctgacagtaaacattttatttaatttttatattcaacattttagctaactggtgctgtttacctttacagccactttatcgtccctgaacttggtcccaacaccaagttctcctactcttcccacaaggctgtgaatgaatacaaggaggccaaggcggtaagataatagaattatatctttacatctctgtctgcttaatgattttttttctctgcctgactagatgtcgctagcacattgcttaatgtcatcaatatcctagttcataaagttatttattagtttattttgttgccttttgttatgatgctaattcaaacatcaagttttagtagtgatcaattgtttcttagttgtgcatttatataataattttgtttagaaaagaatctgatgtagattaagtgctggcttgtaaattatgttttggaagattgtcacttccacagattaatggcctgtaaatgacaagcccaccaagtcagttcgtttctttagtgctgtattaatacggccaaacaaattttggccccttgcttagaattttgaatgtagcactttcagattgactatgactagagttcactttaaaggttatgaaataatttttttgcactatatgttgttttcatcttttttcaaaaagctgcccatgttgatctgtggcaatattttttttttctaatttcacatattctttattggtgattggtgaatttacctgaaaagttctttgattaaatatgttatcttgttccagtttgtgaatagtggcactgctgtttcaagcatcaaattctgaattttgttgtagtcctgaaatgaaaatcacagtgccctatttattaagatgtaatctggttgccttaatgtctcctatgtaattgttcttcatgcagctcggcgttgacaccgtgccagtacttgttggaccagtttcatacttgttgctctccaagcctgccaagggtgtagagaagtcgttcgctcttctttcccttctcagcagcatccttcctgtctacaagtaagtgtacaaacaagtctataactactgctagcgctaaatcttcagttcataatttgatgcatgatgatttgtagggaggttattgctgagttgaaggcagctggtgctacatggattcagtttgatgagcccacacttgttcttgaccttgactctcaccaattggctgcattctctgcagcgtacacagaactcgagtcggcactttctggattgaatgtgcttattgagacatacttcgctgacattcctgctgaatcatacaagtatgtttatttcctctactatcgtatcattatcgaacctgcctttcctttatcattcttctttttatagtggcagaacactgaatactgccttttcactgcaggaccctcacatccctgaacagcgtgactgcttatggttttgaccttatccgtggttccaagactcttgaccttgtcaagagtgctggtttcccctctggcaagtacctctttgctggtgttgtggatggacgcaacatctgggctgatgatctcgccgcatctctcaccaccctcgagtctcttgaggctattgttggaaagggtaagcaattaagcatgaagttattatatatgttatattttaatgggcacaatttgcagtatccaataatatcctcaatttctgctcatccaacaatacctttcatttctgtagacaagcttgtggtctcgacttcctgctcactcatgcacaccgctgtggatcttgtaaatgagaccaagctcgatagcgagattaagtcatggcttgcttttgctgcccaaaaagtggttgaggtgaatgcccttgctaaggcattggctggacagaaggatgaggtatggtactcttttttgccctttatctattctcacctcttaattagagcctgagcatagtactcattactcaatagcatttgaagaaacttctgctcatttatacatttgtgaacaatattgtacaggcttactttgcagcaaacactgctgctcaggcctccaggaggtcatcacctcgtgtgacaaacgaggaagtccaaaaggctgtaagtaccttctgtttttaggctgcatgcttgattctattcaacataacttggcctgtttttcttaatatcatgttatattgcttgtgcaggctgctgctctgagggggtctgaccaccgccgtgctaccaatgttagcgctaggttggacgcacagcagaagaagctcaaccttccagtccttcctacaaccacaattggttcattcccacagactgtggagctcaggagagtccgccgtgagtacaaggctaaaaagtgcgtaacagtccacatcaacgcttcaccgttttcccccttttttttgtctatattgctaattacaattcctgctacaggatctctgaggatgagtacgtcagtgccatcaaggaggaaatcagcaaggttgttaagatccaggaagagcttgacattgatgtgcttgttcacggcgagcctgaggtcagtatcctcgtgtactacttgtgtttagtgtttattactagactttacacttggctgtttgagaaaacaatattattagatttattgactcattaacaaagtttggtttgttctgcattgaagtaagctaactggcatgtattttacagagaaacgatatggttgagtactttggtgagcagctttctggttttgcatttactgccaatggatgggtgcaatcctatggatcccggtgtgtcaagccaccaattatctatggtgatgtgagccgccccaacgccatgactgtgttctggtccaagatggcgcagagcatgacctctcgccccatgaagggaatgttgactggtcccgtcacaatccttaactggtcttttgtcaggaatgaccagccgaggtccgtgcctgttgttgatgatgcaatgctaattattcaggttgcgattgagctttctgttgaggctgacattttcacacttgctcaggtttgagacatgctaccagattgctcttgccatcaagaaggaggtcgaggaccttgaggctggtggtatacaggttggacctgttctataattttgttctcaagtgaatacgcaaaacatgatcatcttgcttacgtctttttaattgtcctttacaggtcatccaaatcgatgaggctgctttgagagaaggtctgcccctccgcaaggcggagcatgctttctacttggactgggctgttcactccttcagaatcacaaactgcggtgttcaggacaccacccaggtaatctttcttccatcagactgtcactgtaggctttcaatatcatcaccaatcttctgtaacttaaactgaacaactttctctcgacagattcacacccacatgtgctactctaacttcaacgacatcatccactccatcataaacatggacgccgatgtgatcaccatcgagaactcccggtccgacgagaagctgctctctgtcttccgcgagggtgtgaagtatggtgctggcattggtcctggtgtctacgacatccactcccccaggatcccgtccacggaggagattgcggaccgcatcaacaagatgcttgcggtgctcgacactaacattctctgggtgaaccctgactgcggtctcaagacccgcaagtacaccgaggtgaagcctgccctcaccaacatggttttggccgccaagctcatccgcacccagctcgctagcgcgaagtgaggatcgcctttgcagcaagttcccttcgattttgaggaggaatgccatcatagccatcttgtttttgaataatctgggtccagtggatccactgtctgtggttaggtttagtcagtctcttggggccaagatcactcatacccattttactttgaatgaatttggtggtttttgaggcagtctgtcggtgtatttgtattgtaaactgagtggaaatcagcagtgtttcatctacatctgagttgttgcggatcaaattacaaaattttcaaggagagttgatgttatgttctgccaagtacccaaggcttttgtctggttttcacccgagttgatagttttctgatgatttcttgctgtgttatcactttgcattcttttactcgtgcttatgtgctgttcatgatgatatataaatccaatcacttgaaagacttccatgttgggatttgaacacaaattggcttacttctgtaggcatattcaacaatagcaaactcttcatgttcattaggaaatgaaatggattgaaaatgtaacaaaagtatacttgcaattagtagtacattttggttattaatgtggtgtttcagtatacacatttgcaggtgttaatttacatgtaatcacattagcttaattacatatcattcacatttggcatctgtttggtcagagacacaagagtcaagagctcaaggtgcgccacacggatacgatgatcccgacgagcaccgccgccgccgccgccatgttcaccatcagcctcctctcctccgcctccctcctcccacctccgctcgccgtcgccgtcgccggcggccgctcctcctccgctgctgccgctccagctcgacccatttcttgcgcctccttctctctcttctcctctttcctcttctgcttcgaaagcggcgtagtcgccggtagccttggatcgccgccgtttgctgctggacttggcgcaggaagcggcggccgtggcgagtcttttgtgctcggcggcgacgaggatgtcggcttgccggcggcgggctttgctggttcaggggtgatagccggaggcggggtccaataccgctgtgacggttgctgcggcggcggcggcggcgatggcggcggtggctttggctttgttggttccggaggagtcactgccgttggagaccaataatcctctggcggcggtggcagcggcgatggcggcggcggcgagggctttggctcgagaacacgtggcatcttcaccggagctcgtggtggtggtggtggtggctgcggctttggctcgacaacggcaggggtgtcccccggagttcgtggtggtactgtaggcggcggcggcggcggagatggtggtggcaatgttggtggcggctgtggcttcggctgcacaacggggggcttcaccgacggtggacgtgtcggcggcggcggcggcggagatggtggttgcaatgatggtggcggctgtggcttcggctgcacaacggggggcttcaccgacggtggacgtggcggcgccggtggcggcggaggaggaggtggtggtggcaatgacggtggcggctggggtttcaccggaggtggacggtgcggcggctcaacgcgcgtacgagtacgaggaggcggcggcggcggcggcaccggcgacagagccggcggc

SEQ ID NO: 25612 - DNA, 2129 bp, Oryza sativa
tccttcttgaagcgcacccacctcccccccctcgccgccggcggccgctcgccggtggcgcggagcatgccgtggttgtccacctgcaccctcacctgctccttcctgaaccccgggagggcgatctccaccacgtcctgctcctcgccggcctgtctccactccacctccggctccacctcctcgtacactcgccgctgctccatcgccgccgccgccgctcgccggagttcgatgtgtacacgtcaactaagcttgcttttgtgacagcgacgtgttgtaataaacattatattacactttatatagatgcatgcaaatgtgttgtgagaatggaattagatagatagcttggattggttgatggagatggcaggagcatatgcaatgcaacctgggttaggttagctaagctaattaaggtagccatggatggagatggagtgagcttgacgccatgggtgacctccttccttggggcaaggacatatgcttctttgcttccaggggcggatccaacgtgaatgtaggggggactcatggataccccggagcaccccttcgattttttcaccataaatgataaactaaaggtccctaaatagctggatattgaagaaactgtgtaattgagcccccccccaattttttttttcctggatccgcccctgtttgcttccttcatggcagatttttttttttttttgctacacctggtgtattggatcttgggtaataccaaaagttcatcatagttgggccaattgggccgcctatatgcttttcaggaatttcagcctatttgttttttttaaaaaaagaaacaattttgaattggcaatacttcatttggagttcttagggagaaaaaaaatatgttagtgctgattttattatcatgtagtattagtaataagcatctgtgtaaggtgtttgtctatgtccatgtggcttggatttgggtaataccaaaatcagaattgggcctgttctgttgggcattggacttccagggacagcagcctttttattttctttttaacgaagaattttgaattgagaatgtttgttttgaaattagttcttcagatttgatatttcttttagctgcaattcctttcagggagagcagtctttctttttgttttaaagaagaatttgaaattgaccattattgtcctgaaaaaagttcttcagacttgatgttacttttagttgcaattccatttctgtttgttttaaacaataattcgaaattgacaatatttgccctcaaattagttcttcaagcttcatgtttgttttagttgcagtttgcaaaggtacttcttcactttccaagttttaaagttgtacttctttttcagcatagttcttcatgagtcttatctcttcagcctacctagcaaaacttagtaatttaggcatgtttttttttttggtgatagggaggaaaccatattgctaatccctttttcttcagttaatcttcttgtcagttctgaactgaagctcaaacagaagggcacaacgatttgtacaagaaaaccaaaaccatctgggactctgtgcttgggtagcattattcagttaagagatgatgtacacatcccatgagtcaagtgtttgcagatcaagcaaccagacaagcaaagcatacgtggagaatctgtttgcatcttggggtggatcaaattctgcataattttttaatactggtccaataccagtacaggctgctgatttgttcacacgctggtcaccccctctgaagatattgttccttggatgattgtccttgctggataaagctccttgcataatggagcacagttaacaagggggaaggacaataagtttcacaagtatcaatcagttatatgatggtaatataaggcataaaggcttttccggcacgcggaaaattagtaggaatgtctcaagaatttcagaaaaaaaaatctcattcaaggagttagggaatttcagaaaattcagagtagaagacaagatcatgtgagatcaatcaactgtacaaaagaggtccccagcttgttaggacaattccaagctgggattcaatgaatagtcctagatcagggtaccaggctacaaaaagagtaaaatgc

SEQ ID NO: 25613 - DNA, 11151 bp, Oryza sativa
gaaatctcctgacaaatttaaggaccgctggtgcattttactcctacaaaaaagtcagtctagtgatcacaaatccacttatactactacccaccatgcattgtgttcatcatttctgacagacaggcactggctcactagaattctcactcctgttaataaatcagaaacttaagttgcaaatggtggttccttcttgagatgatcatcttgatcttccagaagaacttgactggagaagagaagagacaaggtgttgatgatcctactgtaactcatggatcaggagaagatatatagtcacctgtgatagcttatctgaattacttactgcgtggttccaatctaacagtagcatctcctgatgttgagacctcgattagatggatggatgttgaggctaatagttgttcatccgtgtggtgccaatctgacagtagcatctcctggatgctcttgttcatggaatggcgtgtcgtccatgcattggtcaggcaatttgacaatttgttcatcgtctagcagagaggatatatggtcaggaaagagttgatgagataaaattgcagttcgagtacggttatactgccgtcttacctgatccaataattggatggagaatgttgtgccggtaagtaaacagtaacaagttgtgaattttcattatctgctagctagagtgtcagctctgaagaatatatcagcatatgtagaaacatgatgaacattagtttcagctgatttgttttcttgttactgtcatacatctctggtaataatagaaatgggataggttttccactctgtctgaaaaaaataattcagctgatattccaatctcactcacctcacctgctgaattcccatagccaaataaattgattccataccacctattataggggatagaaaggggagaggttttcctctctgtctggccaaaaaatatttcagctgatattccaatctaactcacctgctgaattcctatagccaaagaaattgatttattagacatactccctccgtttcgaaatgtttgacaccattgactttttatcacatgtttgaccgtttgtcttattcaaaaaatttaagtaattattaattcttttcctatcatttgattcattgttaaatatattttatgtaggcatataattttacatatctcataaaagtttttgaataagacgaacggtcaaacatgtgctaaaaagtcaacggtgtcaaacatttcgaaacggagggagtaccaattattgtatcttcagattagtgagctgcatcagaaagtagtatgcatgatggaatcagagaaacaggagtagcagctgcagcatctctcttccaaacctttaaatactaatccaacaatgttacttttgcttaccagataagttaacaccacaatgaattatcaaatcccaaatggtactgaatcaacacaatataatatggcatataagttgacacaaatgcaaacgaccaccacaaagtgataatttagtccaaagagaacataaaaaaggaagatgagaggaattcagaagaagagttttgagtcagtcagtatcaaggtcatgtgattgatgattcagcatcccttgaggctcagtggcctaatgagctgccacttgtcctaatgactccacattttcctgtcaatttccacactaactctgaaacaaagctcaaaacacagagcaaaaatcaaagaccaaaacttccatctttctctctagaccaaccaagaacactgcatttccagtaccaaaataaaacaagaaaaacaaagaaaactacttcctccgtttcagattataagatgttctgactttggtcaaagtcaaactgcttcaagtttaatcaagtctatagaaaaaaatagtaatattttcaatccaagctaattttattataaaaatatatttaattattaatttaataaaaaaactaatttgataatgtaaatattactatatttgtctataaactaagtcaaacttaaagcagcttgactttgatcaaagccaaaacatcttataacctgaaacgaagaaagtacaagacaactacaagttcccagctttctcttcccatttcgattgcggccatctatgccatcaaaatcgtcgtagcttcactactctctcccaatcatcactaagctccaacctcctctctgtcatctcccatggcggccttcttgcgaacgctgcaccggcgaagaacgcgcaatgccgccgccgccgcgttcttggctctcgccgtcgtcgtcgtcgtcttcttcttgtccgtgttcgtcgccacgcggaatgaggctgacatcttcttcagtggcgtcgcggcggcgagctcgtcgtcgccggattcctcgtccggtgggtgcagggagctgcaggcgctcgacggcgatggcgcgaggtgccggtatctgcgggcgcacgcgccgtgcgcgccggtggggtacgtggactacctccggctgctgtactgcgggttcgggcgggcgccatggctgggctacgcggcgctcgcgctgtggctgctcgtgctcttctacctcctcggcgacacggcgtcggcctacttctgcgcctcgctggaggggctctccgccgtgctccgcctgccgccggcgatcgccggcgtcacgctgctgtcgctcgggaacggcgcgcccgacgtgctctctagcgtcgtggcgttcgccgcgggggcacgcggcggcgacggcggcggcggcggaggggaggatgccggggatgttggcctcagcggcgtgctcggtggcgcgctgttcgtgtccaccgtcgtcgccggcgtggtcgctatcgtcgccgggcgtcgcggtggtggcgagccggtgatcatcgagcggcgcgggttcgtgcgcgacgtgtgcttcctcctcgtggcgctctgctacctcctcgccgtgctgctcaccggcgccgtcaccgtctggtccgccgcgtcgttcctctccctctacgccggctacgtcctcctcgtctggacctcgcactgctgcgccaacgcctccgacgaactcgaagtggacgacaccaagcagcccacctccgacctcgccgcgccgctcctcgtcgtcgacgacgacgacgcgtcaccgcctccactccccgtctcctcctcctccaagcccacctccgcgccgagaacgttcgcgcgccgcctcgtcgacctcctccactcgccgctctacctcccgcgacgcctcaccatcccggacatcgcggcgcaccggtggtcgaagcccaccgcggtggccaccgcgctcctctccccgctcctcctcgccgccaccaccgcgcccaccaccacagcgaccaccctcctcgccgccacgctcgcgggcgccctcctcgccgccgccgcggcggccaccacggacgccgcgtccccgcccaagagccgctcggcccgcctcccgtggctcgccggcgggttcctgatgtcggtgctctggtcgtacgtgctcgcgcgggagctcgtcgcgctgctggtctccatcggcgtggcggccggcgtggaggccggcgtgctgggcgcgacggtgctggcgtgggggaactcgctgggcgacctggtggcggacgtggcgctggcgacgcggcgcggcgacggcggcgccggggcgcagacggcggtggcggggtgctacgcggcgccggcgttcaacacggtggtggggctggggctgtcgctgacggtggcggccggggcgcggcacccggaggcgtacgcggtggagggcggggcggcggtgtacgtggcggtggggttcctggcggcggcgctggtgtgggcggtggcggtgctgccggcgagggggatgaggctggacgcggtgctcggggtgggcctcctcgtcatctacttcgtcttcctctgcgtcagcctcgccattctcacgccattgccttcaccacattaacttcatttttcttctttgcaaattgaattgcaaagatgatgatggtgatgatgctagattggttgggttggttggtgtcaagtgttaatttgggtgattagttattaattaattgcatggtattttgttcatgcagaattgggaagatgaaatgctttgtagtagtatatgacttgtcatgaaatgtaaatagaagagcacatatagatgcaatgaaataatgcatagtagtactagctttttcaccggaatggttgaatagtgagatgatttgtaataattattcgagcatatagatgaacaatttaaataccataaagttataaaaatgaatatgagatagtttgctatatatatatatatatatagttttttttttggaaaactacgttatttaaaagttcagaaaacgtgcgcattctattagtctgaaatatatacaaatttccgaaatgttttcttttctctgtgagtacgtactactgaactagtacagcatacagaatgtgtactctacagtgactgaagcgtgtagctcgatcaaacaatttgattagcggaatttcgtagtcattaaatttgtttttagtggctgggccacaataataatttgattttagttggacttgcagagtggagtccttgctgggcttcgttttctagttgcattacacgaacgtgtatgatacgatacgattgcctatttgccatgtgcttctcactctgatacgattcccatatctgacatctagtagtcatcaactatatctaatctcgtggttgtgacgattatattactggtaattagtgacttaagagctttgtaaattacttgacaacgaggcaccagtggtctagtggtagaatagtaccctgccacggtacggacccggtttcgattcccggctggtgcattttgttcttcttttatttttcacagtttttcaaattttggcctgattaaaaaagaaaatttttgggtgttacactatatgtcggaaagagtttttgacacgaatgaaaaaactaatttcataactcgctagaaaatcgcgagacgaatcttttgagcctaactaatttgtcattagcacatgcgggttactgtagcatttataactaatcatagactaattaggctcaaatgattcgtctcgcgatttcctctaactgtgtaattagttttttaatctatatttaatgcttcatccatatgtccaaaaattcaatgtgatatttttagtaaaaaaaagttttgggaactaaaccaggcctttaacaccgagttttttttaaaaaaaatctttttcccttagaaaggagagagttttatacccatcaaattttaattcagagtttttttaattccttctcccttaaaatgaagaggatttttgtaccgtttccgagtcggagcagcagtcttgccctgactatttacgtgcacgtgatcgaactcaaacagtggatggatcgatcacccgggatgtcacggcggcggaggaacgacggcggcgaggccgatggccgcgccagcaagacggcgcggcggcggccggcgcagacgaagatgaagcacctctacctggtgctcgacgacggcgacgaggctactactacttacaccatccacaagctcgacgtcgacgacgacgcgggcattatccacgcgcccgacgtcgaccggccggcgactcggttcgcggcggcgccagcggccggtggtggccaaatgcacttcctcgccatggccgggaagaacatcgtcgcggtcgacggccagggtggcggcccgacggccgtgtacgatacggaggcggccgcgctgacgttcgcgtcacccctcccgggccgtctctcctcctccggcgccggcctggccgtcgtcgtcgaggacggtggccacggcggcggcgaggcgctttacgcgctgacgtcgctcggcgagcgcatgccggcgtcgttcgaggcgctgtcgtgggcgcgcgacccttgcgcatcgccgtcgtcgttgctgttctcctcctcctcctcgccggggcgccactactactggtcctggaagaacgtggccgatacgccgccgccgttcgccgaggaggaggccgtcaccgcctacgcggtgcaccccgacggccgcaccatcttcgtgtccaccaccggcggcggcggcggcggcacatactcgttcgacaccgagcggcgcaagtggcggcgccacggggactgggtcttgccgttccgtgggcagggctacttcgacggcgagctggacgcctgggtcgggctccacagggaggtccacggccgcgtctgcgcctgccaggtcgcgtcccgcggcggcgcgcggcccccggagtacagagagacgctcgactacgacagcgtgtcgtcgtcgagaagcaagaaccggcgccaacgcgccacgctcacctacatgggcgacggcatgttctgcgccgtggagacctgtgagacgccgccgacatcgtcgtcgtcgtcggaaggaggtggcggcggcggcggcgtggaggtccatgtcacggtgttcgggctcaagtacaatcgccggggagagctgcaggcgagggttcgccgcgccgccggcgcgttcccactgcccaagcaacatgtcccatcgttttctcctgtagccttctggatgtagcagctgcttgcagaaattttatttttatttttttatacttttttatgtattaattttattgatataccttttgaaaacatatttccgaaaattttatgaagtagtttgcttctcttgcattacattgtggaatatgatcagatcaatagtttcatgcaaattaaagtcttacatgatgatatttcggccactacacaccagatattgcccccaaaaaaaatgattgcacaaagttaacatatggctggacagtagatttcaccttttctttttatagatgtcccccagcttctattaaacttcaacagatgtacacacacaaaaagcaaagtctactgggtatatatacttgtttacagtacacaacagactcaatattgctatagtaaaaaaacactcatatccacaccaaaacaccacccaacatctgaatccctggaatcattcacaagcagcaatcaacatggttagcagcttctgagtattacagattgcattgatgtttaaagaaagaccttaagcctcttccggattgtgatataaaaaaaaggccaacacacaaaaggctagcgcgtctggtatattagaagtagcacatgcaaaatcggttcatgaacatgcaaaaggcttccaggttgtgataagctccactttcaatatacttgtacataagagaacaacaataaagttgaactggtaagaatggctgtggcacatgcgcacaaattcacagacaaatgagtagagagtttggtcatagtaagggggtgttcgggagagagggggccattagcccctctctaaaaaaaacataagtccttctcatagggatttatgtttttgtgagaggtactaaagtttagccccagtttagtccctccaaccaaacaccacctaaggaatcatgaataccatcacgatccttctgtacagactggccttaagtgactgaaaaaggtgtttcagtgtctgccctgaataagctgaattgtgcagggcttcaattcgcgtatatgaacagagtgttgtcagggaaatgatcagttgagttctttcaatgtcacttgtaaatgtctgctgtcttcgtggtcaaccttttggattccagaatctgtgtggcttttagtgaattgacctgaacattagcacaagaaatcagatgtatcaaacaaatgcgtacatgcgaaggtctgatttttgctagagtctacagattcactacacaccaaaagcagccaatggtataatactataatgcaactaagaaagaatatgaagattagaagacaagcagtactcactttagcgtatatccttgcttaaacatcaccttctggaaatcgcccatgagtcttggaaaattctgtgcaactataagtacaaatacatcctcttttgctcttgcactgtgctgcctgatgtttctgagaagtttaagaaggccacaaatgtcatcagaataataagctttccttcctgtggcaggatcaatgaaatcaagtgtttccttcaaatgcgtatttccatctggagcttcaacacccttcttccatttggtgtatttactgagtttggtcttaattttctcgtacgttggattatctgttgtctccattttctcaaacatgttatggagagacatgaagtgggcagctgatctatatccatccttcaaagtgatatagtcctctgctaaactgtcataacctctggcacaacgatcaatcagctcaatccactgtataatgtccaaaggcaaagtggtgaccgaaacaaatacctcctcgcgagtcatcttcacaaatctatctgtatccttttcaatgtcaccatcctcaagcttgttaatcactccctttgacagattaccaaatctcatgttaccacaggtatccattagaaaattttccgatgtaaaatggccaccaaatgtcagtccagcccagtgaaaattcttgagtagtacatatgcgttcctgatcttgcatttcacttcatttgacgttgtgtaagaaatatgtctacacatattcttctcttcttcttcagttgatgtgcttgctccttccttcggttctagtggatttgtccatggaatctgttccggtggcgacttgacttgaggtgttatggtttgaagaattaacctgtccttattgaacttgcagtagttcctcaggctggtatacattgtttcatccattttgcagacgaaaagattatggtttagatggtatgccttttcttcaaatgccctgtcatactcaagtttccttcttacagatcttctttggtaaccataacatggtcttaattttttgcttgttgatacgatagtgtcccttgcaccttgacttgttgctggagtcttgattagagcttgaatagcctgtaaattatttgccatcacaatgattaactaagatcaattgccaaaataacaatcagcagatgtgtttccatgtcaaatttttttttcacaagataaccaatcaacagatgcagctatttgcctatcaagacattcaaattcagcatatgagcagataatacattctaggacaaatctttaaatgtagcaatgcaaaattagtgctcgctaccttcttgagagagagagagagagagagagagagatgctagctacttacaggtgcatcattttctgggatctttattccttttatatagcagtcgtcaatccattggatgttaaccaccttcttgccttcaccgttccatatcagaacagctccctccgaatagtctccctagcaatttgaattaaatgtcaagaacgaaacatgtgttacactaataaaaatcggtagtaatttttttaccgccatagcaacatgagtgcagatgtcatagtctattgattgcagtacgaagcctcctagtacttcaattttccttttgctctgcatcatttagttcagaatgttaataaaacctggaggaagtaaattgttatcaatggactcccatgctgacaagccagccatattagtggtagaaaccaaaatgacatgctgcacaattttacagggtttcaaaattgaacgcagataaatcttacagagccaatcaacaaaattagatacgattcgactaacaaaattcgataaaggaaccttagatacattagtgaagtatagattactcctctaattcgttatcaggaaaatatatggagataaatcctctaattctttatcagcttgtacccttcaggcccaaagaaagggaaggacaagtcacaaaactcaccagattctcaaatagacaagcagtttggaattttggtgcatactaggaatatggcttgcttagaaggagtaaatactaaggggctgtgtagcagaaaactaagatggactggaaatgagtgattgtgtgatatgttccctactgttgataatcatgagcgtaatgtttcaatcttcagagcactgctttcaggtagaaagaacgcaatcttttcgcggaaagtatataaaatggaacttgttttttaccttgacattagatgagatggcataaatatcaaaatatgcacacgctgaaaatgcagtacgaaaaggagaagttcctgagaagatctggttgacagacacaatacttctgtaaaattgctgatatgttcaatttagtttaaatttcatcattccataaaagtcacatgtgtagattccttaacctgctgataatttgacttcatcctgatagcctaggcaccgataattaatctttaaaaaacaagtgtaaggaacgggatgtgtgctgtgtgcatgttgtggcctgaactaaggcagtaaaaatcaattaagctcgatgtccagttccgcatttcccttaaaccctaactctgcaattcgatgaaattggggaacacacgccgacatgtgaattatgagcaactagaactggggacattatctcacctgttcttttagaaggtgtgggaatccgtgaagtatgaaacgcatcccggcgaaagggcgattgattctgcccccgcgatctgctcccgccgctgatccctcgccgctgatatggcctcgcgcctcgagatcgatccccgactcctcatcgccgcttcggcgtccaaatccgccgccgcttcgggctcctcccccggccgtggatgtatcccccggcaccgccttgttcttgagccccgccgcgtatctccccaccacagccgccgccgccgcaaacgatttctccccatccgcagcggaccgcttccctgtctctgccttgaccttcagccccaccaccggcttgcgctcctccacctcccccgcgtatttcctcctcgaccccacctcttctccatccaccaccgccgcgtcgcacccctcctgcttcacggtggctttgctccgcgccaccgccgcgtcgcacccctcctgcttcacggtggttttgctccgcgccaccgccgcgtcgcacccctcctgcttcacggtggttttgctccgcgccaccgccgcgtcgtacccctactgcttca

SEQ ID NO: 25614 - DNA, 5811 bp, Oryza sativa
cttcccccccccccccccctctccgaccgccacggctccctcctccgtcgccgctttggcccgcgcctccgcctccgccaccgccaccgccgccgccgccgccgtagcggggtcccatcagcggcggcatgacctagccgcggcgcttggcgaattgggggcgaactgcgagaagcgagcgggaggaggcgagaggcgaaaggggaggggagacgagcgggagggagcggaaatttcgagttcgttgggctattggctacttgctgagctgtcctttcgttttgtctacccggtccggatggggccttgtgggtttttcactttttctttttctttccttttctctctctctgtttttttttgtgacgatgggagtaataaaacagtaaattccttctattttcttgcggtgaaaaattccttcagatatcagtatcacggccaaaggtgccacaaacctactgaatttaggcggttccaaaaacaaaaatttctatgctataacatcgaatgtttgatacatgcatagagtatttaatgtaggcaaaaagaaaaaatcattacacatattgcatataaattgcgggacggatattttaagcctaattgtatcatgatttgacaatatggtgctacagtaaatatttgctaatgacggattaattaggcttaataaattgttttgcagtttcctgacggaatctataatttattttgttattaggctacatttaatattttaaatatgtgtccgtatatccgatctaacaaccaaacccaaaaattttccccaactaaacaagcccttaggtggtgtttggatccagcgacttaattttagtctctgtatttagacactaatttagagtattaaatatagactacttacaaaactaattacataaatgaaagctaatttgcgagacaagtttttaagcctaattaatccataattagagaatgtttactgtagtatcacataggctaatcatggattaattaggctcaatagattcgtctcgtgaattagtctaagataatggatgggttttattaatagtctacgtttaatatttataattagtgtccaaacatccgatgtgatagggacttaaacacgttgaacggtactcccttcctcctaaaatagaaggaattttgggtgatgtgacatactatcctataccttataaatctgaacgcaaatcctttatattttgaggcggagaaagtattactaattagtactaatatttcgttgcggcaacatactgacatgtacatacgcagcccgccttgtcaggtttgccaccatcagccactaccttctcaccacaagctccgtataccccaccgacaacatcgacacaccgctgcgtgctcgtcggtcagctgaaggaagatgatgcccctatgtggagatagaggtggtgtgtggcttccgttttccagcgatggtggtgcggcgaggggccaggaatgataatgataaggtgaattaggcttgggtagcagcggctattcacattaattagacgactgtacggctcgggcatccaatcaatttggagaaaaatagaacgctgatgtcagcgcccaatttacgtgcaaaactattttaaactgatttttctcttaattacttatctaaatcattatccgattgtaccattaaattcgttgcaattaaatctttaaaacaagaccacacatggatatattccgacgaaattttttttagcttattattaaattattttaaatattgcacgatgttcaaccaagtatatcggaattgattcacttagtagatcgaaaatgtttcgcttgtttaaatcaggtgttgtttcaccgtatataaaaataatgtttcagcaaatagctaaagaatgttttagttcacagcaacatttgatccatacgtagtgaaacattataagtacactaggtgaaacatttttcggtggaataaaaaataaaacgaattcccttaataggggttcccaaaatatataggtttttttgttataatgaaatatttcagtttactgcaacattagatctatacatagtgaaacattgtgaatacacttggtgaaacattttgggtaaaaaaaataaaccaaatttccttaatatagagttttcaaaatatctagttgatttgttgtaggtggagacaggtactgtagtgggcctagcggcatgcaccgcgcacagggggcggggtagaggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcacggctcctgtagcaggccggcacggcacggcccgcggcacggcacggcccgggcggcccgtcaggccgaaagcgccggcggcgcgtgacagggcgggcggcggtccaacgggaaggcgacacgtggcactaacggctatttgaccgttcaaatttgaaaataaccgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccagctcgaagagatcgagaacctccggtgtgtggcaaagcttcgacgagataaaggaaacatgccccgacggaagggagatatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagagctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtacaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtaagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttctttttttttaacattaccaaatcattacttttttaaaaaacttttatttccattttttaaataccattttttcattttttaacattagtaaatcattacttttttttaaacattttatttccatttttaatttttttttccttatacatttcctttccttttttttaaaaaaaaaaaaacactgtgcacggcccgtggcccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggccacctctagggcgggggctg

SEQ ID NO: 25615 - DNA, 13557 bp, Oryza sativa
ccccccccacccggttgatcggatagaatcattatcgggaatgataatgataaggtgaattaggcttgggtggcagcggctattcacattgatggagtagaagagcaatgtctagtggatttgcagcagaaaccataggagcccaccagataggcggataggaggaagaaatcaaatttgtactagtacatttttatgagtttttaatgtttcagaaaatgcatctttcttgggttggattgaaacgttgtccttgatacttcgatggtgtttcatatttttgtttaagaatcttgtaattggttaatgttccatatgtgaaaataatagtacgtttcaatacatgaaacatttttcaggtagcggtaaaacatcgcccaaattttaaagaaaaaaaaaggttaaaatcaaacactcgatttgctgtcgcctcccagcattcctgaacttggagaaagtttgtccgaaacaacggcgtcacacagcgcgtccgactccgtttctcctgtaggtcgagtcggagtcggtttctcaccccatgtaacccatgttcgaatcggattcggacactacaaccgccataactacctcggctatatatatgcaatgcacgtgtaatcaaagtggatcaaaccatccatctagctcgcgcccaaacaccgatcgctcgggatgcctaggcggcggcgggacgacgacgacgacgacggcggcgaggcctaccggcgacatcaccacgacaagaggccgcggccgccggcgccgccgcagcagaagcatctctacctggtgctcgacgactgggacagaggctacagcatccacaagctcgacgtcgacctcgacgacgccggggttatccacggcggcggcggcggtccagccgtccggttcgcggcgccgaggtcgtcgtgcgacgcgcggttcttccccatgtgcggcgacagtgtcgtcatggtgtccgacgcggcgccgacgctggtgtacgacacgggcgcggccgcgctgacggtcgagtcgccgctccccggcctcctcgccggcgggatggccatcgccatgcccggcggcgagaggctgtacgcgctcacgtctctcggcgagcgcttccctcgcgccttcgaggtgctgtcgacgggcggcggctggtcgtggaagaacgcgcccgtggcgccgccgccgccgccggtcgaggaggccgtcgccgcctacgcggtgcaccccgacggccacaccgtcttcgtctccacctccggcgacggcggcggcggcacgtacacggtggacaccaagcgcggcgagtggaggcggcacggtggctggctcctgccgttccatggccagggcttcttcgacgccgagctcgacgcctgggtcggcctcccgcgccacggggacaccatctgcgcctgccaggtcccgtcccgcggcggcgcgcggccgccggagtgggacaccatggacgatgacgacgtggtgccgtcgtggaagaagagccgccgccgccccggcggccgtcgacgcgccacgctcacctacatgggcgacagcaagttctgcgtcgtcgactgcgtggaatgcgacggcgacgacggcggcggcgtggtcacgccgccgcaatgtgaggtccatgtcgccgtgtttgggctcaagtacaaccggcggggagaactgaaggcgacggctcgccgcgccgccgggtcgttccgagtgcccaagcatttctcatggttctctcctgtggccttctggatgtagacgaagccatatataagcaaaaaactgcaatgcaatctacaatatatattgcgattcagatcaaggaaaaaagaaaactaacattcagaatgctaatcaaacagtgctttcctttcagtgaagtgtagcattctacagtgctttagggggtgtttatatacaggggtgtaaagttttggcgtgtcacatcgaatattatatagggtgctgtatggggtgttcggacactaataaaaaataattacagaatccgtcagtaagcctcgagacgaatttattaagcctaattaatccgtcattagccgtcagtaagcctcgagacgaatttattaaacctaattaatccgtcattagcaaatgtttactgtaacaccacattgtcgaatcatgtagcaattaggcttaaaaaattcgtcgcaaattagtcacaatctgtgaaattacttatttttttagcctatatttaatacttatcaggtgtttaaacttttgatatgacagggtgtaaaatttttgggtgagatctaaacagtcccttatttatagtttctcaaagttcagtcatatgcttgtaagaatgtaagttgtataatatcctttttgagttttgacaaccattaatacaatggatacaatggagagttttatctgcattttgaaataaacaagaaagaaattcaatgtaacagagtatctagtcccagcaactagttacacatgcatgctgtcctgtaatgccacaatcttaactcacacaagatgctaaccatgttgattgtttgaatcaccgattacagagaacaagggtttcaaacggccggtttaaattgagaaaaccaacgtttgcagcggaagataaaaaacctggtacccatgataccaagaacgtgctgccttgtagtactgaaacttcttatcatagcagagaacttcaacttccatgctgatacataacactaaggatttttatgaccacataagagaaaagtacatccagaaatggtacaactttttaaccattccatcaccttatcacagaatttacaccattcaaagtcatccatgtaaactgctgcctataatttctgtatactaaagattgccaccatacaattcctgaaaaaacggatggcttgatgcacatcgcaaaacaaacagatatgtttatgtaggaacaacataaggctctttgtagtccttccaccaaggaaagaagagagcaatgattgccacaacaaaaacgaaaagaaaaactggatagtgagaacggtttgcatttcttttcttgcctccagtcttcttctcattcacagcttgacattcttgacatggagatttggctgcaccatcaaaatcctcatcatcatcgtcagccgggaacttcaaatcttctattagggcatcagtgttttgcatatggcattgattttcctgccgaattgagtcccaaaattcttttctttccttaagctcactgttttttctgaactgaagaatattagtacctggccctgagcagtgttgtatagctggactttcaagtggtgggtgaccatcttgttctgggtctctacagaaggtgcaagaatggagttgctttcttggagtagaattcatcctcatgtcacctgataaaacctgtgccctggatatctgaaataaaacatgagacaaagtgagagagatgtaaattcatttaattctaaggaagttatgtcttcaacccaaaatcatgtcaaatataaaccactgaaagacaaatcttcagcacgctaatgaaaatgcatatccaaacaattaacatatatgtggatggtatatgaaagtgacatcaaaatatgttcatgctatttggggctaaggaatggaaataatatgttaaagaaaagcaagtatttaatcatacaacacatttgacattttaagtagatcaaagctgctatgagtttctgccgcatacctgagagcagtgattcgtttcatgcgctgctgaacagacataacatgggccagcaactcttgttggcacatctgacaacctcctgtctggcttaattggatcaacagagctgaaatgtgccatcaaacctgaagcctcatgactatctggaataacagtgcgaaataagtcatgattggacattccatgtgatttgtcagatttgttacaccatagctgccgccttgcacgtgtgcttccagaaccacattgtcccactgaatgttgagaatcaaaatcagtagacaaatgaacagagttcaggtcacaagaatgtgaatcacatgaaccatcgtctctgatatccgcatcatccatgagagaatgtgaatatgaaccctttctgccatttcttacagaatagtttgctaactgactcaaattattgtcatgcccactctctttttgcctgccaacaagtagcttagcagtctcagatgcctcgaaagctgcaatgctgatggctggcatagtgtcgtcctggaattgttccatagcatggataatactactgatctcagaagatataatgcctagatccaaacccttcatgatggaatgtatcatttgaatcgatgaaataatcatctgagaactgcttgccttagcactctcatccagtatctgtaagcccgatcgaatcaaagatcggccataaggctcaagcatcagtggattttgtgtcagcaaaacaaccaccaagtttaagtgcgcgatactctgagcatgcgcctcctctagggcccctgagactttcaagcagacatcattaaccagctcgttagacgcaaaccgccagttgttggattgcacaagcgcggcgacacaaagagcagagccaaaagagttgctctccaccttagtgctcatcagacaatctgcaaagggacgacaaagcgagccaatgatcgcgcttttcaacgcttccgtcgccagaggatcaacaacgtaccgcgatagcgcgcaaacaaccttggagcaaccaacggcattccgcgaggacatcatcctaacgattgccgagacgatcagggcgatgtgcggcacaatcttgcggccgtgcgcttgcgcggcggtctcgaagatgcacagcatctcctcctcggagaaggagcatggcttcacggggtcacaaacgcgggcaagaaatggcgggagcgtgttcgaatcaagctccttcacatactgtctcaggccactgaaggcagccttgttggtaaggggatccatcaccatcagagagagcgcgccccctgtcgatacgaaatccagcatcagagattgccgcaactcgcaatcgattcaaccgcccacaaatattttctatggagcaaagaactaaaactactactcctagtcctaacaagggtttaaggcaaagaggaaagagcttcgaaacctagaagaggggagaaagagcggagagggatgagagggatacggggtgctcaccggcggcgagcggaaggaagaggaagtgagcaggagggggacgacgccggcaacgctgcttcaccctcgcgggatggagatcggcggcggaggaaggcggcggggcggggcggggcgaagtcgatctccgcctccgggagtcgggtcgagtagggccgtcggtaggagtcccaggcccattaacgcaaaggcggtatgggcatttttagttacccatggcccaacttgtcgctattaatctggacatagttaatatctagattcataatcagaagttgtttatgtctagatttgttgataaaagttagtttattttgagacggcgagaataaatctagatgtttttttagatacaagaaaagcggtgcatactagggtctgctagcctctcaaatcaaatgctaagtctttatggttgaagttgaagtgagctcgatgaatcgttgatgcatttcttttaagttgccctaatggctcagtgggccagatagcttgggtgcaaccaaataggtcagagctattgtttttccaacctggtctagacttgtctgaatagtttgtttttcaaatggctggtcaatttgttatatacaaatttgacgcgtaggacaatgaatttgtccagctcaacttcaataggctgaaatgactaggcaagctggactatccggatgaagttgatcaccaatggaccgaacaagtctaggcaatgtactttctatgggttggattagccaaacaatcaccagctagacagtccggtgaagatcgaactatctgcccttttatagcgcaactgctagttgtttcagtgaccatcgcaaaagtttaaagggttagactatgtcctatgcacttcaaaggcaatgtttaaaaatggctagtttgtgtagttgaggtataaatatacagtgctagtcgagactaaatactctatgctatgtacctgttcctatctcttggataacattgcaacttgagataactcgtggaggacttaagctttcagagtgattacttgagcgaggtagtggctttgtacgcactcacaaaagagtagtgctgagtagcttcaagtgaagttttcatcttgttattcatggcatctcttaaggattttgtggaagacccgatgatcttgggaaaggcttggagagttggagtttggcttccatagtgaagaatagctatacaaaagagcggctatggactttgtgaccataaaaagaagtgagactataatgtagagtgctccaatgaggactaatagattactgagtctatgataccttgctaaaaagtctccgtgtctccgtgcttgatcttcatatctcaatctctctactgcttgcaattacattactagaattgagtaggacttcaaataagttaaaaaagcttgtgccatgctagttttgaaccctacgcatgtagtagcttttgtttatcacaattgagtgtaatctcagcctttagtttttaaatctctatttagcccctctatggcatgtttgatgctatagctatcatggtaacagggcctaccccttggtagggtaattaaattgctctgtatatcagccatgttttaaaaaaattaaacaaaactttaatcttgttaaaacttctcccttttttttaatcatgtggttactaggcttactaccgaaaggagtatccttaccgtgataaaggaaaggaaatcctgattgtgcttcgtatccaatgctaggggctgttcatgagttggtgcatttttccttagagccacgactttattagtcaacccatactccccctctttttttttctttctgtaaaacccatgttgtcttgattttctaaacaaaacatagtttttgtgaaaccaaccaagttggcgtgtctattatgtcgagaaaaacaataatacaatgccataacttgtaaactataagcctagaaattaaagccatgaactacaacgagcacacactaacattgtacagtggttgctgaagggtattatatgaatagaatacatacaatttaaaaagaattgatgatggaaatgctgccttttataatcactgaactaaataagaaccctctttgtttccttgtggaagagaacatctgctattaaccaatgcatatgcaaggaaggaaggatacctcatttctatgtgcccctgctcatggagtgtgaccaaactgtcctcatggcatccaaagctatatatttctattaatgctattcaggtcagtaacagccaagaggctctgcacacacagttcgtcaccttcacacacagttcgtcatcttccaaactgtcctcatggccctgtttggatcattaaacctagattactgacaaaacccattccataaccgctaggctattttgcgagatgaatctaatgaggtatattaatctatgattcgctacagtgatgctacagtaatcagccgctaatcatggattaatatacatcattatattcgtctcgcaaaatagtctaggggttatagaatcggttttatcggtaatctacgtttaatactcctaaatagcaaaattctggagggctatttaatagctcggaggatccaaacaaggccatggttgcacttgtttctttccatcatcacttaactcaatcatttgcttttcagcctataaactgctatagaaaattaagttttaaaacttaattttggagttgatttcaagggggttttcatatttttattttttagcttttacttttaaatcgctatacaagtatatataaaaaatttacaaataaattattttttctcggtgataagccgttacggcctataatcaactataggttaaacaagaggttattcttcgaaaacaactaaaggcaccattcttgtgaaaaagctttggaagatgaagtgtagtagcagtacaagttcaattgcctgaagagcaggtaaagccagagagatcaaagcagcaaaaaggccatgacaacatcatggagtatatattcagattcacctcctctttttcttcagcaaggaaagggaggtgcaatattaaaaaaaaatctgcagcagtttgtgctgtcctttttggaaggaagtaaggaaaagggggtccaagaggaggttggctcacacaatgagtgacacaatgccctgctgccttgctttgctcagctttgctttactttgcttgcgtaggtaggaagaggaagagcagaaaatggagggagagcagtatgaaaatttggcagcaaaattggcaggcgccaaacataataaatgaaatgaataactgcaactaatttgtttatagatttagatggatgtttcggatatctgtaacgataatcgataatgtataattttatttgtctaacaagtttagaaccacacatgatacacctatgtaataccggtgttgtaaattgggcccatatgtcgtgtacatgcaagggaaaatatatagttttgaattaaaaaaatgctagttatagtttcacgaaatacctacttttgaacaaataattacagtaatgtgaaatttactcaatggaaaaagtgcaagaactgaattgaatgggagaaggaatatgaaaacaaaaccagatttgctgcagatttacgtattcattgtgatagatatatatccccaatatatatattgacattgtttttcctaatactaatttcttattagaaggaaaaaacacccaccaaaacacatagtcgagcccagttcgttccaggctcaagcctagccaaagccacagctcaccacagctcgtcagttagggcatgtttagttcgcaaaaatttttgccctgcataccacatcagatatacggatacacatttaaagtattaaatatagtctaataacaaaacaaataagattccaccagaaaactacgagacgaatttattaagcctaattaatccgttattagcaaatgtttactgtagcaccatattgtcaaatcagggcgcaattaggcttcaaagattcgtcacgcaatttcctggcgaattgtgtaattaattctttttgtctacgtttaatactatatgcatgtattcaaacattcgatgtgatagcatgaaaaatttatttcggaactaaacaggccagtattatcgccagtattgagtacttgctcggctcggctcacgagccgacggctgggctcactgagcgagccagagcaatccggctcagataaaagcgaaaccctccctcccctctccaagcggaaacctaccccctcttcttcctccgcttctctctctctctctctctctctctctttctctctcctcaaccgtgcggctgcctcctcctcgtcgctgggcatggatgtgcacccgccgaatgcggccgcctcctcgctggaggagttgttcccgcaccagcccgccacggtcagtgctccgggcctcctagctttgttgcttccccctttctttccccccttcttgctgttgctgtgtgtgtgtatgtgtgctttggtataagtttttttttcttgccaagaaccgggcgtggttgggttgctcttccgtggggaggaggaattggggaggaagatggtttctttttcttggggagtattggatgttttctttggggattttctttttttcttctttctaaattggggatttcttgggagtttttgtgttgggggttttgggggtttttggtacaagaatttggtgcggttgtggtggcctattctctagtttcttgatattattgttctaggacctagggtttgggtttttttttcctttcacttgtgttctttaccgtttagatgaattttctccactattatgtttgcatagaagaaaatgggggattttcctttgtttcttgaactatcttaccttcctattcatgcgtgctgcatttcctcgcccttttcttcaccttttcctacctataaattggaaagaatttttttggttcatagagaaacaaatatatttacagttgttgagcaattcattcagccgcacacttttttccagcagagcttcatagggaaaataaacaagactatgttcatgccaatcttgcatcttgtttttggcttagttgtgaggtcacagggaagaaatgcatgtattgctttgtgactttcaatatcgatgtgtgtatatgttattcccttaccatcactgtcattgcatagacgtgtccattgtaaaaatcttctttcgtcgatgggatgatgtgcatgcaagattgcgacagccaattttttttactttgtcaattcgggtgaaaaacctttattgttgccggaaacaattgataagaggcactgagctttatcctaatttcttttaggcattgttcaattttattgtgtaattctaaagctttactgttagaattcaataaagggcctactgcctgcatccccatgtgaaatgtggttgcctagctctcttttggtttggagtttcttttggtctgttgcaggtatagcatttactgcaattgatcctattgtgtgcccactgcccgctatagtgtttaattgcaagttgtaactgagtgattgctgtggcagttttgtattccttgccacaattacaaattgtagatgctgcacattctatctttgaggggccataaatttcttgatgcttgagatatatgaacttcaagtttgttaccgctgtataccagaaacagctgatactgacccctggaattttgtctttgctaatttttgtcagaaaaaaaaaacttttgaggaatttaattgcgccatgcttcagctaactttattttttgattttggacctccatgcatgtcttgctgtaatctagtagaacgagagctttgtaaagctataattccttcactgttatgtaatttagtttttaaaagatggatagataattgttttcgccattgcaatcttgtctaacatttctttactttgcaggaaagtgatagaagtggcatagagtggctctctgtctatgtagaggactgcttgtcaacctctgcatcctgcacaaaccctgtctctgcagaactaccgcctattacaatggcaagtcaaggtgctgcaaaaccaaagttaccaccacgctcatctaccaatgcaagaaaaaagaaaaggagcctggcatctgtcataagcgacactgatgaccaacattgtatcacgctgtttgtcgagccaccgctactcctgctcgatcataaggactggctagcagagagtgagcttatcctccccaagaaggacaaagatgaagaacttgtccaagagcaagaacaagaggaggaagagaattacaaaatgagtgcaggaatgcaattccagcaggagcaactggtgatcacttgtagctattgtttgtccagccaatcaccacagtggtgggatggtccatcagggcctacctgcgatgcttgtcgtctgaggattgaggcgaggaatgggcacaccaccagttccaagaagcgctatggccaagagattgacaaagaacaggacataggaaagcggcgagataagaagaagatcaagaaggctgtttatgtgaatgatgagctgctatcggaggagccaatgaagaggtgcacccattgcttgtcctacaagacgccacagtggaggaccggtcccttggggcctaagacgctatgcaatgcttgcggtgtgaggttcaagtctggcaggctgctgccggaatacaggcctgctaatagtccaacttttgtgagtgacatacactccaattctcataagaaggtcatgcagctgaggaattctgttccacacccaaggaagtgaactggtggtcgggaacgtctcgatctgttgcgtttagttttaggaactcttcagttgtagaagtaagctgatagtgaagaacatcttaatctgtctcattgaattttaggcgggctccttggtcgtagaagtgagctgataatcacatctcaatctgctgcattgagcttttaggggctctcagccttagatgctgagaaaacgaaagcagaatctagttaggcgtcatgaactctttgttagctctagccgttttttaacttgagaaattaatctgctagttgttggagatcatcagtttaataccaatgggtggttgctacctttgttatcccaccattgtcttgcagcatgcttgttctgtgatactcgctgaatatgtttgcaagatggaaatcagaattcagagcagcctcttagactatgttctgtgatacttgctgaatgtgtctgcaagatggaatgagagcaagcctcttagattatatcctgcaccatctatgatctttgcacatacttcagccatgccccttttggcctcttctccatatgttcataattctcattatagtagtatttgtcattcttttctgaagtggaatgagagcttctcattgtgtggttttgttggtggggtgcaaaaccgcaaatcgtatctccttggacatgccatgagccccagatagatttagggttcatgtttcctgttagtgtgctaaaattcaggccaatcacctgaaaattgcaagctacatggtaaatatcttgattaataactgttatagtccacctaatatctgatcttatgacaacaaaatcttagcaaatgcaacaaaatcataactgattgttttcctggtagcaaattctgctcaacagtagatcagatagactgcatgaatcaatgccctgcagatttcagattttttcagaccacaaagttgtcttcaattcagaaatctctctgcaggctctactcttgcacactgagacaatttccatggctggagatgacgaacaatgatgcagctgtgcttgtagtcttcctgtccactcaaaagttaaagcaaaggaaaggaaggtctagtccaggctacctttctgctgttcttttatcatgttggagccttttttggttgcacatggttggccctcttctgccatattcatgcttgcaattttactgacaattaaagctctgtaaatcataaatcatggtggccgagaagctcaatcctgtacttgtctgaagaaactcacccatgccgccatgcgtgttcttgcaagttaaaagctcactctttttcagttcatagttttgcttgcctttccctaaatgtcagcagagaaaaggcaaagctgtatactccctccgtcccccccccccccctcaaaaaggcaaaccctgagttctcgtgccaacgtttgactctccgtcttatataaaatttttttataatttagttttttcattgttgtttgatgatcaatacatgattaatactttatgcatgacttatctttt

SEQ ID NO: 25616 - DNA, 21606 bp, Oryza sativa
  unsure (1)..(21606): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttaggttgtgttctgatgcaagatgggaaggtggttgcctatacatctcgtcagttacgtccgcatgagaagaactaccctactcatgatcttgagttagctgcagtggttcatgcgttgaagatttggcgtcattatcttttcggtactcgtacagaggtgtacaccgatcacaagagtttaaagtatatctttactcagccagatctgaacatgagacaacggagatggttggaattaattaaggattatgacatgggaattcattatcacccgggaaaggctaatgttgtagcagacgctcttagcaggaaaggctattgcaatgctacggaaggacgacagttgccattggagttatgcaaggaatttgaaatattaaatttgggaattgtcagtagaggtttcgttgcagccttagaagcaaagcccactctaatcgatcaggttagagaagcccaaattaatgatcctgatattcaagaaatcaagaagaatatgagaagaggaaaagctatcgggtatttggaagatgagcaaggaactgtatggttgggcgagagaatctgcgtcccagacaacaaagatttaaaagatgcaattctgaaagaagctcatgatactttatactccattcaccctggtagtaccaagatgtaccaagatctcaaggaaagattttggtgggcaagtatgaagcgtgagatagcggaatatgtagctgtgtgtgatgtttgtcagcgggtcaaggcagaacatcagaaacccgccggtttgttgcagcctttaaagataccagagtggaagtgggaggaaatcggtatggatttcatcactggtctacccagtacgtcatcaggccacgactctatttgggtgatagtcgacagacttaccaaagtggctcatttcatcccagtaaagacaacatattccggaagtcggttggcggaattgtatatggcaaggattgtgtatttgcatggcgttcctaagaaaatagtgtctgatcgaggtagtcagtttactttaaagttttggaagaaacttcaagaagagatgggttctaagctgaacttcagtactgcttatcatccgtagacagatgaacaaaccgaaagggtaaatcagattttggaagacatgttgagagcttgtgctttagacttcggtggaagttgggataagaatctatcttatgcggaattctcgtacaacaacagttatcaagctagtcttcagatggctccttacgaagcactgtatggtcggaagtgccgcactctgcttttgtgggatcaaacgggagaacgtcaggttttcgggactgatatcttaagggaagcagaagaaaaggtaaaaatcattcaagaaagattgcgtgtggctcagtctcgtcataagagttatgccgacaatcgccgcagagatttgagttttgaagaaggagatcatgtgtaccttcgtgtcacgcctcttcgaggggttcatcgttttcacaccaaaggaaaattggcaccgtgttttgtgggaccttataagattatcaatagaagaggagaggttgcttatcagttggagttacctcaatctctggcaggagtccataatgtgtttcacgtgtcacaattgaaaaagtgtttaagggtacctaccgaagaagctaatcttgaacagatagaagttcaagaggatctgacatatgttgagaagccaatccgtatcttggaaacaaacgagagaagaaccaggaatagagttatccgttttgcaaagtccaatggagtaatcactcggaagaagaatcaacttgggaacgagaagatgaattaaagtcagctcatccgcatctgttcgccagttcttccgaatctcgaggacgagattctgtttaaggggggtaggtttgtcacaccctaaaaatcctaaatatataaattgttgtttaattggaattattagaaatgattttaaaagtctagaagaaaagatctaattttaaataataaattccaatataaaagtgagccagataaaattttaatactttacttgattctatagttcctagatttttctgggatttatttgagccaaggaagtatttttaataaatggaattgtatttcatgaataatttaaattggaaaaggtttttaaagttcccttttggctttgtccctctctctcctctccggcccaatcggcccagtcagcctgcagccgcccgcgcgcgcgcgctcggccgctgacaggtgggtcccacctgtcggactcgtcgtcctccttgcgctgaaaccctagccgcgcctcgccgccgccgcctttccaattcggccgcatctttcccgatccggtgaaatagtttgaggggaaatgctccccgggatcttctctacctttttccttttggaatcgatcgccaattcggtttggaaatccgtggactcatgttcgattcggatcgatctctctcctccgaaccctaaaccttccatcgcgtcgccggtcgccgtgggccttcgccgccgcctccttgcccctataaaaggacccccggtgtctccgctatccgtcgccaccctcgcctttgcccgccgccgtctgtagcgccatagcaccgtgcagccgtgcgccgccgtcgccgccgcagctccagccgtgcgccgccgtcgctccggtcgtcgtcgctgctcggggaggtcaccgttgtggtcaccaagccgtcgccgatctcgtccacccctccgtcgtcgccgtaggtcaccggagcatcgccgtcgtcgtaaagccgaaggtcgccgccgcttattccacgacgtcgtcgccgtccgttgatcttctgccactgttttggtcaccggtgagttcgccacgtcgccctctacgtgttggtgtcctccattcgcgtcgtcgcgccgtcgttcgccggcgagcttgcgtgcccgagccgccgctggtgatgacgtcatcgccgacgtcatcgttgccgtccgtcgtaggccggtcgtagaccgttagatcttggccgtcctttgtggatagaatcgatctcggccgttcgtttccgtgagtcgccgccgtgcacccggtccaccgcgagccctagccgctgacgcaataattcccttttccttttcaaaaataattcattattgcgtcataattcaattaaaactcatataagtgttttaatccgatttaatctttaaaaattcataactaattcatcttagctcggatttagtttgttcaagtctctaaatttttctaaaaatgagatctacatattaaaaatatccacatgtaatgttcatgcttgtttatgtgctgttttagtgattttgctcttttctgtttagattccgacgtttccggagagtccgttttcgcaggagaagaatttgaagagttccaaggccagcaaggcaagtcacacagatccaaacaaccctttgagcatgttgatcccgtttaaagctattgtttctattcaactattacatttattttctaatgtcatggggtggaattaacctattgtttgttatagcccttttgttcttgattactttattccttgataccttgggttattataacttgactagttgagctttatatattggttcagctagatatcagatatgattgcttagccatgcttagaaacattagcacactattgggataacttatgattcactattatttaatgatggcttaatgatagttcacgatggtcaatcgtgattggttaattaattaaattgccaactaaaacttgataatggtgggttgtgaacacatggttttgttggtcgtgctcatgacaataaaggaccggttcacgattttcggttgtgaaacattaaccgtgccaaccacaagccagcgtgggcaacggctttaccttttgtataacatggttcattccggagcaccagactgagaagtggcggagataagcccacgggggtcgctggggagtccatgccttgtttataagggggtgattatgatccaggaacggtgagctgtggtggattgtgttgtgcgaggggtactgtcacagctcctttccgaggtactgtggtggtattgaggcgcatggtgacatgtcatgaggctgtgtcttgtgggtacagtggtacacctctggccagagcacaactattcgaatagccgtgcccacggttatgggcgggtctaacaatgtctttcgtgattagtctcacacttctcatcataataaaagatgctataactggtaataatttgattagctcctggtttggaatggttaattcctggtttggagatagaactgtgcagccgagatgattgttcagaatgtgcagccgggatgattgttcagaatggttgggcctaagcaacagggtatgttgtatagcgttggattaatattgtttaattattacttaactgttttattaaattctgaaatgtttattaaatgctgtttatgcaaatgaaaccctactatgccatcctttgttatcctgtgcacttgcatatttgttgcgtggcttgctgagtatgtcatatactcacctagcaatcattcatcagaggaggagttctacagtgatgctgatggtgtggaagattaggtgtagccctggtcaagctgcctgtggagtggagtcgtcggcgccgtttatcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaccctgcttccccttctcctcagcagcttgcagaatttcctcatgctttgccttcccatcctctactcctcgattcagatctggaggtggcggatgtggaccttgcggctcttgtcgcccaatctgcaaagggcggatatgtccccttccccctgcgtctcccctccagaatcgattaggcggcttgaaaggtggacgcggcctccatcctccgccttgatttgccattggagagccgcttcttaccaccttcgcgaaactccggccgtcccctcgaacactcgccgtccactctcgccgtcgcccaccaccgcctacccttggccactcctccacttctctcacctccccttgcgtctcccccttctccaatctcctccacccgccttggaaccctagctcctcgagactagctccccacaggtggtgtagaaacggagtcaggagagtcgactcaatggtgttccaccgatctccaaaatcgccatcgttgaatctcgacacgtgttgcccctccacctctctctcccccactattggatcgggccgaaaaccatgggcttcctccctcccctgatcaaaaactctctcgcgcgccgaggagcactctcccaactcccgaaggccatcccctccgccacgaatcaccaccggcgatcgtcggagcgccgcaggtgactccctcgtcgtctctcctaggattgaagagtttctgacgccgcgggtgactccctcgtcgtcattgattagtttctgacgccgaattgaagagaggattggattactgctggcatatgaagtgaatcaatgcaatacgattcgtaatgagttagcatcccaactgcagagacaggtcacgtatatacgtacgtatgcaggccggcctacttccaaatccaaattccaatacgattatacaattcaccgattgattgatttaatttcttcctgcttcaattcgatcgatcgatcggcgtcgaccagaaattaatcgatcgagtctatctagggaccaatcgaattcatcgagttcgctcaatggcaactgctgctggtagatatgaagacagcggagtcagtgtctctttccggcggaaggcggcgtacacggcggcgtcgctgcttgtcttcctcgtcgccggccagctgccgctctatggcgtcaagaagtacaacggcgacaaggatgtcccggatcccttgtactggatgaattgcatgtttgcgtcaagcaataacaccctgatgactcttggaatcatccctcttcttctctccgagatggccgtccgcatcttctccgcactcatcatcaccaggtggccacccttccatcatgtgcgcctgtaagctactccctcatcttttttacagtacttacaaaaataatggaaggtgccatattctgtagcgtaaaatctggtatctcttgatacctccggtagtatgagtatcgctccacagagttcgaattcgttttttataagttgtataataaaaataacaaatataaccctaaatatctgcatagtagtttagtataattttgtttaacttatagaaatcgaatttgatttgtatatttgtaaagtgatcgatgtatctcaaaattgatctatcttatcaatttttaaattattttttatcatttaagtggcatgtaaaaacgagaggatcctctcaaggatgaaattccatctccaatattagtaattgtttttttttggaactaacatgcatattaattttgtttgattaactaacatgtctgcatggatgcgtcatgcttgctctatatattgtggagattatggataccccatatctacatgacggttgtaatttagccggatatacggtaccaaatatagatggaatatctctataaagactcgggttaggttctaaacttatatgtcaaggaaatacccgggatcttagtcggttactattgtattttatctataatcccatattgcgttaggatatggactgtattttgtaaagtggactccttcccctatataaggagggtccgtgtgcctcttggggggcgattctttttccagtttatacaatcaataacacactcggcggaatcatccccggacaggagtagggtattacttcttgaataaaaaggcctgaacctgtataaaattccttgtctccaaacccattcactttcctagcttgatagctacccccttttattattgtcgaaatcttgtttcgacagttggcgcgccaggtaggggcagcgtcaagttatcgccaactaagtgcgatgggtttcgtttctggcatcgacgacttcgcctttcctcccgggtaggcgttccggttcggcagcctcaacttcatcaccaacgacttcggcaagatctctctccttgactcggattcaaaccagtcggggagagaccaggtccccgtgccgttcggtattccgaactcggccgaggcctactccaagatcatctctcccgagtcggcttcaaaccactcggataagatccaatctactcttccgcgaccagatcaagacgacgggtcctatccctcaatcctgatgaaacttcctgatgatttggccgctgtcttcacagtcaggacatctcccactcgaagatctaggcgagcttcggccccgatccgatctagatccagggaggttggcgttatactccaacctctcgggacagtctcgacggaagagttggatggctacctcagctcccccggcgtcagttctcgaccaaccgagatcctcgactacgacgatttcagctaccactacgaccacggcgacctcgacaacttcgacgacagctatgaggataactacacgcccctcttcttcggcgtattcatggctgacaacgaaacggaggaacagcgccaagcccaagaagcggaccaagatcgcgcacggaaagaagctgaacgtcgccgactggaggaagagcgacagcgacaagagcgagaacgactacagcgtgagcaacaggatcgcgaacggattgcaaaagaggctgaagatcggcgacaacgcgccttggaatctgggcggcgagcgagagagctcattgggcaacaagacgtggctccaatcggaactggagaaagggaaagaagccagggccgaagttgatcgcttgaaggccgaactggagaaggagaaggcccacaccgccgtgctcatagattattacaatctcaccgagccgaagatggaggctcttcggcaggaggttcgcaaggccgaagcaagcgctgcagaggagtcgcggcggttttcatgggagatggtgaaaaccaccgagtccgcacggacagcgtgacaaacgcttcgcctcgcccttactgacatgggcgcaaaagtgcggggtgtcccctccgaagatgcatcagccttcgacttctccgaatggacccaacaggctggtggttcagtttctgactgcgccaccgcatacagcgattgctgtgcacgcgtgtcagcggcctttaccatgggcctcctgcagcagttcggctgcgagaacatcgccgagtttcccaagtacgcaaagggggattgggaaatcagtgcgcaagacatttcgcccgcgcttcgtgcgtggcgaaaacaattttggcagaaggacgaccgctccgccgctaaggcgcaccttttggcgcagctggcgaaagcagaggcggtggacctttgtgaagatgaaggcgcggcggctggagggggtggaggcgatgcccgggaccacccagaggtgtgaggccctccgcccttctcttagattttcatagttttcttttggtgttcgctagatgtggcaaaccattgtatattcggcaaacttccgctaaaccttaaaaaaggctttttggtatatttggaatgtatgacacaatcttaattactttttgatgatcgaagtctttggcatatttttatttcactcgtttcacattatgccataccttccccttctttcgcctattcttaccatgcaaaatgtgttttgccttttctgcactgtctaccagggggtctgctgaaaatcgtgcattcggcccccttttgggagctggcgaggtcaaaacgagaaattcgtggcattgaaggggctgtcgaagacgcgatgtccatttcggccattttatcacgaaatggagataaacggtcgcagctataaggttatcaaggttgccaactggctacgtgcgcaccccgggtgaaccttagaagattacgatcttgttcactcaagacatttggaagatatggctcgcttttggcgaaaccatcagaagactaaacgccaggaatcgatctctcagcgtcgttacagtttagtctgtgtttcgccccctactattcttaaggttgtgtatgatattagtagtgatgacgaacctagttcgtccgaccattccttagggagggataatgattactggggcgaaaatgtaatttacttgtaaaatgaattgtatcgggttgtaaaccttgtattcttcgattatttttttgaagctaataaagaacgtgctttatttccttttcgctatttttcgcatcgtcacattttgtgcttttgttaggccggaacatgccggcccctttgcatatattagcgaaataggtgtactgacttttcagcttttcgtcgttcattttcgatctgtagcattctgtgtcgagagaaacgcttttgcttttatgttgatcggtcgtaacgtcattcggctatttattttccgagacaagctgttgcggtttcaacgttcggcgagcaatgcttcggccgattcgtttcgcccccctggcatttttcgctgatcaggcgcttgccttggggtttttccacaaattatcaatcacacgaaaagaaataaaaagaaggcggaggacacagagattttatactggttcgggcctccatggtggataatagtcctacatccagttttttttttctttttctcttctctttttttctttttttttcttgccgaaaggcttacatagtgccgaaaggcttacatgacagtatgtacatttttacaagttggcgatttgggtgccacccattctagacatagaagcgcttgagggaggcgacgttccaggaatggtcgaactcctcgcctttgagtgtcgctaggcgaaaagatcccgtcgtggacttgtgtttgatgatgtatggtccttcccactttgattcaagcttgccaaccgctactgggttcgcctttttccttaggacgagatgaccaggcattagctccgtgggtcggacttttttgttgtaagctgccgaagtgcttgtggcgtacttgtgcatatgctcgagcgcttcgacccttacaccttccaagagttcgagcgatacctcgcacccctcttcgcccctagagaacataacccttggtgagttagcccctagctccgctggggtcattgcctcatcgccataaagaagcataaatgagctaaacttggttggtcttgtgggggtcgtccgaagggcccaaaggaccgataacaattcttctggccatttgcctttcaccgccccctcaagtcttttctttagtgcttctaggatcttgccatttgtacgttcggccgccccatttgactgtgggtgcgcgaccgacgcgaacctgatttccaggttaagcccttcgcacatttctctgaacttatcagagtcaaactgcttgccgttgtcagtaatgaactcttttggcactccgaaacggcaaacaatgtttttccatacaaacttctgtactgcggccgaagtgattgccccaaggggttcgacttcgatccatcgagagaaatattccacagctacaattgcgaatttatacccatttcgcgccactgggaatggcccaataatgtccagcccccatctggcgaagggccatattggtgcaatgggctgcagatcatactggggcacggcttggcttcggccatgacgctggcaactttcgcacttcttgatttgctcaacacagactttcaacacagtgggccaataaactccttgtctaaatactttggaggccaccgttcttgcagcctggtgcgcgccacatagcccctggtgtatttcctttgccatttcttcgccttcggcaaaagagatgcaacgaagtaagggttgaagtaccccggagcggtaaagctgacctgagaccatcttatacttcgtggctctgtgttgcaaacgcttcgcttctgcttcgtctaccggaagccagccagtttcaaggtgtttcaccaatggggttcgccagtcatatgggtcttcgcccagtttctcttggtcgattgtcatgacttccgagctgtccatgggcacacttggagcatgtaggacttcgaaaaagatgccaggcgaatgcgggccaccacaagcagcggatttcgccaaggcgtctgcttcctcgttctggtctctaggcaagtgttcgaccgttatgccggtgaagcatttttccatggaccaaacagcctccagatacctcttcattccctcttcttttgcctcgaaggatttgtcaacatggcctgctaccaacttggagtcagttcgaattagcaggcgccggactcccagtgctttcgcctttcttaggcccaggagaacggcttcgtattctgctgcattgttggttgtgtcgaactgcaatctcgccgcgtaccaaatcgacacaccattcggcgaaaagaggactgccgcaacgcctgcagaaccgtcagagcacatcacccagaactggtcatcgggctcggggtcgggggcaagtactggtgtccattcagctacgaagtcagctagcacttgagacttgatagcagagcgtgcaataaaatgcaagtcgaacggggatagctctgccgcccacttgctgagctggccagtgacttccttgcctcggagtatttcgcccaaggagtactgtgatgggactatgactttgtgggcctggaagtagtgcttaagcttgcgcgaagccattactagagcgtaagaaagcttttccatttcaatgtaccttgtcttcgctccttgcagtgcttcggagacgaagtagaccggtttctgtccggactctgtttcttggacgagtgcagcactgactgccaccgacgaagctgccaagtataatagcagttcacttcctgggggtgggcttatcagagctggcgggctttgcaagtattgttttagctcgtcaaatgctgcttggcactctggtgtccaattaaactttcccgcgccccggagggtcttgaagaagggcaaacctctttcggccgccgttgagaggaatcgactgagtgctgcaattcggcctgtaagcttttgtacttcatgtacgcttgacggaggcttcatttgctggatggcatcgattttctcgggattcgcctcgatgcccctatcggaaacaaggaaacccaacaacttgcctgcgcggacgccgaaaacacacttctccggattcagctttatgcctgccgcgcgcaagctgtcgaacgtctcttgcaggtcgaacgcatggtcgaaagccttgcggctttttacgacgatgtcgtcgacgtaagcttccacgtttcgccccagctgcttgccaaggaccttgtacaccagcctggcgaaggttgctcctgcgttccttaagccgaaaggcatcctgaggtgacaaaatgtgccaaatggagtgatgaaggatgttttggggatgttgagcgggttcatgtggatctggtggtaaccggaatatgcatccaggaaagtcatgagctcgcatccagctgttgaatccacgagctagtcgattcgcggcaaggggaaatcgtctttcggacatgccttgttcaggtctgtgaaattgacacacatgcgccatttgccatttgacttccgcaccagcactggattcgccaaccactccgaatggtcaatctcttgaataaaccccgcccggagtaatttttgtacttcggtcttcgccgcttcttggcgatcggcagacatcttgcacaacttttgctttcttggcttaatattcggcttgactgctaagtgatgcatgatgagatctgccgggatcatcaatctgcacttttgttatcttgccgtgaggggtgggcttcagcatgtgcttgggccgctcatgcggttcggtctcaacattgtgcactgctctgttgattatggctagatcgcgttttgaagcggccgaaggctgaagccccttgactactatcacccctgttgggccaggcatcttgagcttgagataattgtggtgggaaatggcttcgaacttgttcagggttgcacggccgaagatggcgttgtagttgtatgggatgtcgacgacgtcgaacagtatttgctcttcgcgcctattttctcccgagccaaaagctatcagcaaaagtgcttggccaagaacttgcactgcctctccgccgaacccccggagcgacgttggtgccggtgcaagagtttgggttggcaagcccatcttagcatatgcttcggcgaagatcacgtcggccgaactccctccatcgaccaggattcgtcggacttcaaaaccggctatctcagctgagattaccagtggatcttgatgcgggaacaggactccttcggcgtcttctggcccgaaagagatcaactggttcacgtactgtggcgccccctcacccgccgaagtgatgctgtggaccatacggatctgcatcttcctctgccgtttcgacaacaggcttggcgggtcagctcttgtaatcacttggattacccttcgttgtgtatcttggcgttgttcggctaggggtatttgctcctgaactgcttcacggggtgcttcgactgttgttccttgctgcggccttgggtcttgcgcgttgccacgttgcctaatgtttaagcattgctccgtggtgtgcaaagagcgtccgtgaaaagcgcagtagaggtcttttcggaccttcttgcgggctggctgctgatggttgcttgcttgctgggcgtcgaactccttgcggagggcttgcacttcttcgacagccatcacagccttgcccgcccgatctgttctgaactttctccaagtcatgggggcttggccttgccttggcggctgtccctggatcgccggctgagactggcgaactgataggggaggtggttcgacaatttgaacttgtgcttgagcttgagcagcggcgacgaaggctttatcgtactcagcttgtatagcttgccgtcgcttagaatcctcctcgccccttgcgaacccgtcagtgatgcgaagtaggtgctcgagcgtctgcggctccttgttggcgatttttcttgttagttcgccctcaagcagaccggccgaagcggcgtttataaccgacgcctcggttatgtcttgaacttggcaccgggcttgcgagaagcgacgcatgtactcccttatcgactcccccggcctttggcgaatgccaagaaggtgttgctgcgtcttcggctcctcataggtgcctcgaaagttaaggacaaaaacatcgcgcaattgctcccatgagtaaatgctattggctggtaaattgaaataccaagaacgggcgatgccgtctagagcgagatgtattaccatcgccttggtattttcatcaccatgagccgcttcgatcgctgactcgtagatggagaggaactccttcgggtcagtttcgcccgaataacgcgggacaggtgggaacttgaactggggcgggattggacgagtcttgattcccccactcagcggcagccccttttcgcctcccgccctgtttaccgcaccttgctgcgggtacggtgtggcgaagggcgaaatcgtggcttgtgcgtggagttgggccgcggcattcgactgcccggctccaactggtggtacttgctgggccgccatggatgggtcaaagattggctgcgaccacatcatggcagcttggattggtgcttggtttgttccgaagcctggggttggaacttgctgccaaacggttggcacctgagcagtgttgccgaagtcgaactactgtccttgactccacggcgaaggtcccgagcctggctgaatcggtggcaaccaattaggcgcaccttgacttgtattccccaccgggtgagccgatggggttgtacttgaaatgtagtggggttggttgagttgctgaaggaaagcttggagttgcgcctgcagagccgaagccccttccgccactgtttgtgtcgcttggccaggtggttgatgctgcccgacgaagtacaccggcggctgtgcggctagtggcggagagggctgggtcaccacttgcggccggacttgagaaggggcatagcctgccgaatactgaaggattggagccgacgtggccttggtccgccttgtcgcctcgtatgcttgttgttgttctagcatttggcaaagcatgtcttggagccgtgtcatgttctgccgcatggcttccatgtcggcttcggcttgcgcttcggggtccaggctgatttgggcctgtacaacggcgagcgcagttggcgccgccggctgtgatggggcggcttgaggcaccaccagttggtttgtcgaaaggatctccgccctggtctggagtgctcttgccgccgcagccgccttcgccacgtcggccgtgttcggcacttgcactgaggttgcgggggccgaagacggttgtgatggcgcgggggccgagggcgactgtgatggcgcttgtccttctacatcttcggtcacggacgccgaaggctctgctccttcctcggcggccatgtccggtccggcgtcgctctccttccacctgacgaccttctccttcacgaccctcttcagtggcattcgctctcagtggtttcgttcggactccccatggtcggcgccagctgttgtcgaaacgacaactgcgtacgtcgaaggacgtggttactcaacagtggttgggaaaatgaagtgtactaaattttgaatttcacttgggatcccccgttacatggcctagggggctatttatagccctattgcaggctcttactactaggatctaggttgtacaggggaatttacatgattacccttatgaaagggacatttacaggggtacataatgttatagggtctcatgggcccctgatgggccgtctagtgatcaccggcccttaggcttgatgggccggaaaggcttcctcggcccttgcgggggcgaacttgccatggcgaagtcgtcttccttcggcagatagtcttcgccttgcacccttcgcccgagacgcccctggcttggcaaggccctcgcgcgactcttcgcctcacgccgttcttgctccatagccttcgccacgggtttcggcagatctggtcgaagagcctcatgccatccgccaacaaacgtgattttagaaacatttagaaaaaaataatctaatttggagtttatataagtgcggtaaacttgttttaaattttattttaatatacagctccttaagacgcccgtatgtaaaaatgagtttatttttgcatgcggaccttttaagaggcccgtatgaaaaaatcaatttcttaatcaaaattagctaactattgcaagaagaggaataagtctattttccctcgctaatgtcttactcttgattgaatcctctccctcaaccacaaaattggatataagaaaattactaacactaaaatttagaaatgttgatatgttctattagaaaaaataacgagctatatctcttccttgatttgagaatctcggtttgaggggttttttactttgatatttatttgttaccgtattcgttccgtttcgtattcgctccgtatatgtattcgacaatattcgattccgttttcgtatccggagtttccgatttcgattccgattccaaaaagaaaatatgaaaatgaatatggtagagctagtttccatccgtatccgttttcatctccaatgacatcgatcgatcggtagccagatttggctcctttttcttgtgcgcgcgcgggggatcttgttgtcgagtcggatccgctcacttttgatgggccatatgaccatttgggccagagtaggaaggcccattttggaagaaagttacacctctatttggaccaaatattctactactatatactacggtgtatacgcatgcacagtgtacgtataccttatgcgtagttttagccttagaattactttatgcgtctactttgccattttagtttttttaaaaaaaaaatcttatgtgttccgtgaactagcaaatgtatgtgagtttgaatggcaagtggaggttcgctgctggtttgtgaaaacgctaggggattaattaatattgccaagttttaataggatttcttatatatttatcaaagtttggtaagaaactaaatggatgcacatctttaataacttttatgaaaaaatgatatggtttaaaataacataaatatggacaacccttagttgttaattttattcacctcatatataaaaaaaatctagataacggctgtaggaataggataacttgaaaggtatatgttatttccatcaaaacggttggacaggcatgcggcacgatttcctactaagcggtaggcggcggcgggcggtcggctgcgccctcccctctgccagagggaaggcgggaggcggcagcggcagcggtggattttgtttgttctttttttttagaatttgtgattcatggtatggatctgagatatataatctgtgatgtatttgatttgtgatgtatttttttggagaattttttatatgaacttatgatttgtgatgttactttgattttaggatatgtagggcactcgatttgggaaaatcatgtagggatcaactcgaaggaaaaatcaaaatgcaagcagcaaagaaacaatgaaaaaaaaagaaaaaaatgatgaccaaccgggactgccactaccatctttagtcatgattggtaaacatctaactttagtcccggttatttcacccgggactaaagatggacgaccatctttagtcccgggttgcatttagtctcggtttgtaatataggactaaaggggttgtaaaccaggactaaagaagagttttccgggagtgaaagtaaacgatcaaatatattatttgaatgtatagcaatgcattggattttcagatggaccaagcggctagtaaattaatcagacaaaagtataaacgtgatttttttatcattatttgaacctttttaatttttaattttaaaataaaccatctcaaaacttattaccaaaatctaaaacttttggtgtaacaaaacaatactgccaccagcgggtgtggcagtttgccatgacaacgccatgctgttacattagctataccgatgtggccaaataacattgctacgtcatccacatcgatatgggagtattattttaccacgccagcctatcttatactgtggtagtgttgttttgtcatgttagtctgactggcgtagctaatgtttctgattttgaaaattagttttagaaaaatttattttaaattaaaaatttaaaaggttcaaaaagtaaaagaagttctagaaacatgttgtagacacaaaattaacacgcgttattgattgcttcaatttcatatctagcgccaacatggcagcatgattaatgacgcattttccttaatcccctttggcaacttaattatatccaactaaaggataaaattcaagtgaggaacgaggatccccaaaacttagcgaagaaaattatcaccagttatttctttttaataatgaaaatgtattacatctctgccatctgtcataaggcatgcaaccaattagttcttattaaaataaataaaatgagttgtgggacaaatctccagttaccttgaaaaataaaagcagatgacacactaaaatgatcaccagttaattaattactagagaatggaacaatatatacctccaaaattatagtacgtcgtgttaaattatacaaagacatacatgtgctccatgtgccacactagttgggagctgcttctttttttatttatttcttgtgaagactgagctgatagattaattagtcctcttattttgtttatttcagtttaatcaaggattaatgactcttcagccttgcaaaggccatcatatcgaattaatgacccatactatttttaatcgcaaaaaaatgtgaaaggaatgatcgatcgatatcaataaaacttaaggtttttgtataccatttcagatgagctgccacgtgctaccttgctactgtagaaactacagtccttgcatgctatccacaccgttcgattgtggctgcaagcatctctgcccttgagcgtgtcttcccagggagcctcggctgctctccaggggacccccatttttttccccatcggttgattcatcccccagcttctctatttgcacgcagttcacacgcttcctccgtcgatccatccagcgccgccggtggcatcgccgcctcccttgcccagtgtgttcttgcgtcttctttggcttagctgtggacggccgtggtcttctgctcggtggcttcgtctccaccatctccattccatccgtcagaggctgtcgccgtccgcgagtagcagcagcctctcctctcccagtgacagtccagttgcgccaccaccgacgaccttttgccttaccggttggttctccggtgcccattgccatcgtgtgcgggagcaatgccctctttttcccacggcagtccaggcaagaaaatccttctatccccattgttgtacagaagaaacccttaggcctttagaaatgtcgttctttgatttattatgtaccattgtgacagattcccttaacctgtatttttaatggtgcaagttacttattatcaagcatgtgattcaataatccctactgattaagcatttaattgaatttagcctgctacagtggttatgggatggttgcctgctgcccccaagtccacgacatacacatattaaagttgtccatatttaggttcatgcttagctttccataatactccattgtgtactcatctgcttgctttatgattttgttttgccattttgtataaatatctaggagtggtttggtgatggggatggatgcggtgcctgacactctaacaccaacaccattttctcagctaacttagggacaaatgagacagagaacaggccaggtgctactcctacacattattcggcatattcaactttctttgctttttctcaattctcaactacagttttcttatgttgagcggaaaacttattgatgatttatttctttgtgttctaagtgctcctagcagtgaaagctctaaccataccatatcttttatctcaactcctgaaataggaatctccatgtcagtgttttgtcgtccatttcaacgacccgttaacaggaggcttgcatttaaccctatcaatcctgctactccaatagatcaacattttgtctcctcatcagatggcccaacagtgccaggtgttcagtcccttcctgcagtgcgcggtaaaggtaagcccctctattaagaattaatctctatttgattgtgctcaagcttgctatactaccattgtatcattttagattcataaatgccagttcaggtacctgtgccatagttgtacatatttgttcctttgtgtctgctcatataaatttggatgcttctcacattggcataggtcctttggataatattggtttgagactgcctcgaccagatccatctattgctacggaagcacgcaagaagcgtaaagtcacaatggttttaaggagaggacataagttacccatatccaatattttctccttcaactaactggcttatttgttgcttccattggttcctacatttctatttgatttcgttcagcaagtgctgattcgaccaatctatagctcctcaatttgtgattgttacattaggagctggacctgatgatttctcatcttcatatcgatgtgttcaacgatgtatttccccacaagttaatgccaggcattgtgatgtgcggatagccaggaataatgggatgagtactactattggcgcttctccttcatctcacattgcccaaaatgacacctccttgcatagggtgaatacatgtcaacgaagccgtgtagggcggtccagagctgatggtaccttatttagtttgctatgatttttccttatttttacctgt

SEQ ID NO: 25617 - DNA, 1067 bp, Oryza sativa
atctgcatgctcaagacttataggggtgttcccttattattaccagctgatcatgatgctgctcgatattcaggctcaacctccacagttcatgttccgaagtaatttttgctgctcaacactaatgttctatctcgatgatcgtaaagcttctcgacaataatactccacccaatgatcttttttctatggtgaaaccacttaaccatgttctaatttatattatatcatccttttacaagattttccattctaatttttctcttattcctttctattaggtactattttcacacctctcaatttaggaggccctacccatacttgccaacattgtggtgctcgattctggtatgaggaacgcgtacgtgggtgtggacgaacagctttgcaaatttacaacaaatgctgtagaggagggagcatttatttgcctccatataggccaccaccagaacctttgctctctcgtttaactggacgagatcgtgttttgtccaaccacttctttgaaaacatcagacgatacaattctatgtttgctatgacatctatgggtgtaaatatcatcaactcaattaatgatggtcatggcccttacattttcaagattagtgggcagctatgccaccgaattggatcgcttattccaaagcatggtgcaagaccagaatattgtcaattatacatatttgacactgagaatgaaataagaaatagagtggctgttgcttcacatagagagatgagttttgaaccaaatgaggatattgttgcatctttgatgaccatgctcaatgcacacaacccagttgttcagctctttcgaactgctcgtgataggctgcatgatcagttagaggatcattactcagtgaagttatttgccacccccaatgaacatggtaatatctactcagccccagttgcatcagaggtggttggtttgatggttaatgatataggcactaccgagaaaggtcgtgacttaatagtagaggatcactcattgcagcttcaaagggtaaatgaaactcattgcaaatttatggcaatgcaatacccgc

SEQ ID NO: 25618 - DNA, 14857 bp, Oryza sativa
gccgcttgaaccattataggaaaaaaaaaacttttcagctgaagtataggagtagcccctataaagctttacttgatacagtcagtagcggcattattgatgcttcatcggtaggccagaggattattttgccaggttcattcactggaagtccacgctattactaccaaaattaccaagattgtgtggctctctgtcgtagatttggatgcccggatcttttcatcacttacacgtgtaatgctgcttggccagagataacagaagctttagcatttataccaggacaacaaccttctgatcggcccgatattgttgatcgagtttttgaaatgaagctcaagctgtttgttgatgatataaaaaaaatatgagttctttggtcccatactcggaagttagctcgtttaattactatgttttaattcttatgttttaatatgagttcttatgttttaattactatgttttgtttcagttttgtttacctcaatattttttttcagttgtctacacgattgaatttcagaaacatggtcttccgcatgtccacttgatagtgtggcttaaaaaggatagaccccttgatgccgatcagatagacactttcatatcagcgcagttaccagacccatctattgaccctattggttatgaggctgtctcacaattcatgattcatggtccttgcaatattccaggttcctcttctccttgcatggctgatggtaaatgcactaaattctatcccaaggaattttctgacaaaacagttgtgctacctaatggccatgttaggtatgctcgaccaaataatggaatcatacaaagaaacgtggcattgagattgataatcaatttgtggttccacataatgtagacttattagttaagtatcaggcacacataaatgtggaaagtgttaatcgtgatggtatggagaaatacatgtttaagtatacaaacaagggccctgattttgctaaagttggaatcaaaagaaaaagatacccccggttcttctacagaggaaataaatgaaataaaggaataccttgaatgtagatgtgttacaccacatgatgcagcttggcggcttttgcaatttgatatccatcacaccgatccagccgtggaacgtcttccagtgcatctcccactagaaaatggtgttgtatttactgaggatgaccatcttcaccaggtgattgataatccatgcaatctcataacaaaattgactgcatggtttgaggcaaacaagacatatccagaggctcgacaacacacatttgtagagttccctgaacattggacatggcatggtgatggaaaattttggaaaccgcgtcgtaatgcccgtggaaaggttggccgtatagccaatgttagtcctaaccaaggagaaagattttatctgcgtatgctattgcatattataaaaggggcacaagacttttctgatcttcacaccatggctggccaactatacccaacatttcgtgctgcatgtcaagcattaggtttacttggtgatgattgtgagtggtccaatgctatggctgatgcagcacaatgggcattaccataccaacttcgccagctatttgtcacattacttcttttttgtgaagtcactgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatcttcccctcttccccggcccatcttcccctctctccccgggcgctctctctctctctctctctctctctctctctcgcactctcccatctctccccccctcccgctcggcctcgcccgtacgctgctcgcgcgtgcgagagccgccctgagcgcctctctccccgctcccccgctcagcctcgcccgcacgccacgcgcgcgtgcgcgtaagccgccgcgccgagcgccccctccctttcccctcgctctgtcgcgcctgcagccgcgcagccgctcgtcctcgcgagccagcgtgtgcgcgcccgcgcacgtggtggccgaccgcccggtcgccgccgccgccagcctctgcacgcgcctgtcgccagtgtcgccgctccgctccaaaccgccccgccgtcatcgtcgtcgtcatcgcccggcccccgcccctccgcgcgcaagccgccaagggacggaggcagcgcccctcctccctctgccgcgttgcccccgctcccctcctcctttttcccgaatcggcaaaagggcaagcccctttctccccctcctttttttcccctttttcccccgccggcgtcatcctccctgtcgccgctttggccgcgaccgccgagcgccagctcgcgccttgaccgccctaagtcggttcccaaaccgacattgccgccccctttaaaccccagctccttcccctccaatctccctcgttttcgcctcctcgccatagctgccgcccccgtgctctgttcgccgtcgccgtttgttgttgcacgtgtcgaaggagtcggcacgagcaaggacgcggaaggggactccggccgcgccctctccttcctcttccccggcccgaggccggagatattactcccgcgccgtcggcctctcgtcacagcgccccgacccgcacggtagtgcctccctccgttcttcctcctcgccccatctcctccccctagctttcggtagtagctcgagtagactacccgtagctagccggcgccgccccgaccgttgccgtcgctcgccgcgtgctcgccgccatcgccgctcgagctccgtagcacccgcacgtcgccagcctcgctcggcgtagctccgtccaatccgacgctagcatcggattcccgtggtcgcgtggatgctctcaccgccgggaatcggtctctcgtgacctcgtcgccgtttccctcttctcccgccgccggttgccgccgccgcaatccgccgccgtcgagcaacctccggcgaatccgagccgttggctcgtctccccttgtcacgtgcaaccgcccggtgtgcacgcttttgcccgtatcgccgtggttcgctccgccgctcgccgccgccgcccgccgtccattcgcggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcggaccgcgcgcatgcaccgcgtcccttccccgcccgcgcgcgtgcgtcgcgtgctccctccgcacggtgagccgagccgctaacaagcgggtcccacccgggaccgcgcgtgatgagcccggtccaccggctctctctctcctccctcccgcgcgcgcgcgagtttgggccgccttgggccggccagcccatttagcttggccagaccgctccatttctcttgggccgcgccctagccatccgagaaaagtctatattccctccctcccttcttttctttttcttttccaaaaaaggatttaaataaatcctttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcaagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattcccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgctcgaacagccgtgcccacggtcatgggcggatgtgaggtgattcctagcgtagttttgtttgactactgcttgtgaaattgttgttgtgaaaaggggttcgatgtttgaaaaatctgcagctgatgggatcagctaggcccgggtggccgtttgaaaagttgttggcccgggtggccgtttgaaaagctgttggccgggtgccaaccttgttgcaatcctaaagactgacacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatccccccccagttgctgaagaagatgaagtggatcctactgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacagtcaccgacccaataaaattgcttgaagattatatcaagccaatgggagaagatttggcatatcgtactattcggcccacacaaggtatctctcaaccattagtgcagcaacacattaggtcatatgtcttggatgaattagacaaattactcaaagattctggatatagcctaggtcacttcaacttgccagagccagaacaccatgattacaatgttttgaacaacaggttggtagtggatgagctctcttatgaccttgatgctactttagtagaagcaaatgagcaacttaacaataaactcaagtcagagatctatttatgatgccatagaacactcagttctgaatggttcaggtcacactttctttgtatatggatatggtggtaccggcaaaacatttctgtggaatgcacttctcaataatataagaagtcgtggaaagatagccttagcagttgcatcttctggtatagcagctttgttgttgccaggtggtcgaacaccacactcacggtttagaattcctatagatattcaagagtattccatgtgtgctattaagaaaaatacacatgtcgctgagctcatagaaagaacatcactaatcacatgggatgaggcacctgtaaaccataagcactgttttgaagcacttgatcgaactcttagagatatcatgccatcaaacaattgttatctaccaaacaagcaatttggtggtgtcacggttgttctaggtggtgattttaggcaaacattgcctgtcatcccaaatgcaaataagcagcagatcctcaatgcttcaatcacacgatcccatttgtggcagaattgtgtggttctccatttaactgaaaacatgagacttagatgcccaacactttctcaggttgataggattgaattagaacagttttctcactggcttctttctattggtgatggcacactacctaatagcatgccaacagatcgacctgacacaacatggatccaaattccagagtatcttttgttacctgctcaggaaagaaaccttacaggtttaatttcttttgtctatgagtaaacaccagatgcctcagaattaccagcctatttgtgtcagcgagcaattttggccccaacaaatgaggtggctgctgctataaatgctcagattattggccagatagctaatgaggaaatgtcatattatagctttgatacaattgatgataccacagctaactattgcactcttcaagacctgtatcctccagagtttctcaacacggttcgcatgagtggccttccagatcaccatttacaacttaagattggtgtcccaataatgttacttagaaatttgagtccatccaagggcttatacaatggaactagacttattgtgacgcagctcactcatcgtgtaattgaagcccaaataataacaggaagcgctaaaggttctaaagcttatatccctagaattgtttctgtttcgacagacccgaaatggcctttcaagatgagacgtcgtcaatttccagtgcgtgtttcatatgcaatgacgataaacaagagccaaggatagagacttagcaaggttggtgtttacttgccaagtcccgtgttctctcatgggcagctttatgttgccttctcccgcgtaacatcttcaaaaggattacgaatcctcattgaaaataactctgctgagtatgaaagaaagacacataatgttgtgtattctgacattttccatgatatattaagccaatgttgtcagttctccccagatacccatgtccaatagatcagctttcttactacaaggtatttatgttttacaatttatgctctggtagtctgtttagtataatcttttttatgcctgaattttccatattacatccagtagacaacctacacttgctaatgcgtttctcaatgctctttgatttattaaagtgtatctgtcatcaacggagtgcacaacacagaaccatcttcatatatatattttagtaatgcagtcctcttgcagttctatggttcttttgaaaggagtgacttaacaacaatacataataacaactgttgaatttatttcaagctaaagaaactgtagtgcttatgttgttcagctatgttttcaaagtagcttacttcctgttcacatgtaaattatgtgctttaagtcatgtatgcacatcaaattaccccatttcaatataaatttagcattcttaaatatggttcccaccacctcaggtttgatttttcttttgtcccaagttgatatatctgatttctatctttctacatatccaaccatcctacattcatagctaaacatacaaattagataagtaatatctaaacttacatacttctataatccacatggatatatggtggtaagttcttatcattacttattgttgatatagataagcacagttctaatgctcctctgctcatatgttaacatgagtaaccattttgttacattgtactgctaaattttaattctatttggacagcccattgttaaaagatattctcccctcaacttcctattgaatggtaataggaaatgtcccatttcttattgttttatgtagagatagagacctcaaattcacgtctcatactatcgggtaatgattgacaagtatatttgatctgagttcattttacttattgcagatcaagaatgacatataaagaagaatattacttaatattatatgagggaatttctatcgtttaacaaggtatgacatatgacactgaaaggaataaaatttccaatttataagctcaagagttaaactatgttcctatcagaactaaactgaacgatctatgcgctttggcttcattttagtgtttattttgtagctcctttacatggtgatgaaatttccattaggcgttgatgcaaaattcaacagcgcctactatttcaggattaccaagtaggtactgcaggagacgtgctcacatattatcacaactactctgttttgccacaaatgatgcctatccggacatgtgcaacttggttatctcttctgcagttctgctgattgatcctactgatttacagagcttcttaatgtatgttttattcttagtggttttgtatattctcatatgagtaggctgagatttgtataaacctaatgccatgcccaatgttaaaaaaacatgtaggatacgatttaaccctatgattgttgtactgaactttccatctaattcttccaatatttagtgcccgcggcaacgctcggggtatagagtagtataactatatcagcgtcatgctgtcaaaacatatctacacatgcatacatgtgtacttttatgtattttatgatttgatcgcatggcatctcttgatatggatcattatcatttcataattaagctgcagtggtatatatatatacatatactgtatggccaaggatagcatgccacgagcaaagatatttgacgtcgattaatctatatgcatgattcttgctctcacaaattctaacggtctcggggaataagccaaacgatatatttataataaaaaataatttataaataaaatttttatatatgtattattagcgatatataaaagtaaaggctgtaaaataaatttcgataaaaaaaacttaaaatcaactttaaattaagattgaaaattcaaattctggctggtaagcataaatataaatgcaaagatgaggctggttgatgaaaggcacgtaaagttaataagaacgatcgatccatatgaagctgaatcaatcaatatcagtctctcattttcggtgatctgcccgtacctggaccaaaacctgcatgaggttgatccaccaatgtgtatgcagcgaactgccgaggttcactcgctcacggtttgcaatctcgttttgggttgaaatgcgagcttgtttgtttgaatggacatgaatattatcactatctttccaaatccaattgacgactctgaataatcagatcgatctgtagtccatggatttatgcaggtgaatgttgatttcccacgcaaagtgtacgtagatgggatatttggatttgtataaagactttgacttttttaactgggactggtcaactaattaattggttccaagacttattgccaactgtactactccattatacaagaatatttttccttagtccccacaaaacaaatattatgggaaagagtgcaagatactctttatgggaagggacagaattttgcagaggattaatgttttttctctaactaattctttacgtaaatataaaattacaaaagtagtataatactatgttacacaaatgaatttgaccacatcaattttcacatatatggttaaacgcacccattatccaaaacaaataatcataatgattatggtataatatgtgtgtgtgtgtgtatatatatatatatatatatatatatatatatatatatatatatatatatatatatatatatgccaccttgccaaataaaatggcattactcgttgtgggcgtctgtgtttgtactgtgtttcttaaaaaaatgacagtatttctctatgcgaccgaatagattagcactatccccttcccccttagcgtatgacaccattaacttctgtacacatgttttatctttaaccttactgaaaaaatatgtaataataataatattttttgttgttatttatttttaccattaaagctgctttaagtatgacttacatatattcttttatatttacatttttttaataaaatcactgttcacgcactacaaatcgatgacaacgtatattagaaatggagtgaatatttcatcgtgtagaacggataggatggtgatgtgtagggtctttggttggagttggcttggctaactattccaattctatctgcaagctagcatggccggcgtgcgtgcaccgggatggcgacgtcgactttagttcttagaatgaaattattggtagaaatttggaatgcccaagggccaagggacaatatgctgtgagacgagaagaatctgccaactgcttgcatgccacaggcaaccgccggcaatgatatcattcatgggattttttttccttatgataatggaataaaaacatcggatattatttagtttaaaaaaaacatgggatattattttattatctgaaagtcacaattataagaaacacccatacccaatcatatgtacagtactaccttcgttttatattataagactttctaacccatatatatatatatatatatatatatatatatgaatgtaggcaatggtagaaagtcttataacctgaaacggagggagtagtatacttcctccataaaaaaaaactcaacttaggaggggatgtgacccctcctagtacaatgaatctggactaccatttatccagattcgttgtctcacatcccctcctaggttgagttttttttgggacgggagagtaagaatcactcatatgagaagggctcactcttaaccaaaacacagcaggggagtctcccatagtaaaaacactcaagtatcatattgtgatatagtagtaataatatttaaaactgtacaattgaactgacacatagtaacaaattacctgtagcagtataccactatacttgtatagacatgtttcatctattgcacatatatgctcattattaaccatctagcccatcgttaatctagtaccacctattttatatactgatctcaaaaaagtatcgacaatagacatatgttgtgctctcttcgtaaaaaaaacgaatctggacatacactatgtccgtgtatgtccagattcatttatagaagtgggttttttttttgacatagggagtacgagcctaaacaattctactctgatatcgatgtcccacaggcgacaacaaacgaatttgcgaagcctccatatcctgcataccataaataaatcaataggataatcccatatagtttttccccgattgaattttcgtagctgcaaacacttatttataggcagagagagagagggagagagagagctgtggcttgggcaattacgccacagctcactgaattcgatcgcctctctctctcgttgctgccttctggcaaaccatggccgtccaggttcaacgaacgcccctcccccggtccacgtacaccggccatcgggtctatctcctgcgggccccacctgcagtgacacggtgcaccgtggaccgcgcctttccgcgcagtcatggacctccccttcctcctctcctgtataaaacctcgcgtcctgatgcttcctcctccaactccacgagccgccatttcccaaggaggagcaaggattgttgttgtttcgctgtcagatcggtaggcagtgccccccctctctgttgtctcggattggattggattggattggagtttttctgggttgatgtggtgattttgagggtgatttttttgtgtgtgtgtgtgtgttcttgatttttgttttttatttggtttgtttcagattcctgacgggataatgggtgagaccatcgccaaggatgtcaccgaggtgagcgagcgccaaaatggtttcttgttcttcatcgtggtggcatttttttggattggtattgggatgtgatttgagagagaaaaagaagaagattgaatcttttttgtgatgtgctgtagttgattgggaacacgccgttggtgtacctcaaccgggtgacggatgggtgcgtcgggcgcgtcgcggccaagctcgagtccatggagccatgctccagcgtcaaggataggtgaagctctactgaaatttatcatcttgtcatgttagggtggtggattatgtctgaaaaatcggttatttgtggttgtttccggaatggagatgtgatttttctctgtttagttctcagctgtttatgattagagctcttacttgcatcttggattttgagatgaaattttgatgtgtggttgtgttgggtttgtacaggattggatacagtatgatcactgatgcagaggagaaggggctgatcactccaggcaaggtgaggattttttttaatgatttcggtgttctgtaccaatggaacagtttggtcttataaactagttgttcttcctgcatcaatgtgaatgttgttcatttatttatttgttggatcccactgcggtttgatagtatgttggagctgatctgctgatgaaagggcgtgcatagcagagagtttgagttgaccggcgcatgtgcgaaagctcaaataagtagttagattgataagaaatggaccattcacctactgcattggtctagatattttatagaaaatgaataaggtgttcctcgcgttatctaagtcagaaggcaacgaaatgtgatccccagctgtcactcgattgcataatcataagttatccgatagctgttattctgccatctcatgttgtggcatgtttccctaatttattcttgatgaagaggccactaaacattatttttgcaatggagataacctaatgattgatgcttgggcctagactggttttgtttagttgattttattggaaaaataaattgattttcttcattaaatggaaacctgctgtatggactgattagtactagatgaaccagcatatgtttctagctagttatgtacaatagaccttgtcttgtcttattttagaaatagttttcgtagtacttatgctattaaagaatagatgaccaagtaaattttttttcagccaaataagatcacggctccattgcatcactgaagtttttcgatctgcttgctctttataagaacaatcatattattttcaatagcagcatattttgacataccatgcttcttctagattaatatatttgccgtgtctaggagtcatgaatgatgaatgtggccttgtttgcagtattgttcgttttctcctgcatctaggtgttttatttctgcagatactttgccagttgaccaaagtaatttttatattgccagttgaccaaagtaatttttatatttccagttgccatctgcatgattcaattagtagcttaaagcatactccctccgtcccaaaatataacttttagcattcagaatttgtctcaaaatataacaacttcttcacctacattcccttctcaaccaatcacaaccttccaccattcaaattcaccacctactttctcttcccaaccaatcacaaaccctcgtccatttaatcccacatactttcttaatacctgtgtctaagcctagaactccttatattttgggaaggaggtagtatttaaataagggaattttacaatgctttttatgtgatagtaagttagcagtttttttttgttggtaaacactttcttcaaactgctagtaaagctaaatctattataacttccatatagttaagaacgcaagatctggctttactgatgttttgctttgtctgtcaatgattgccagagtgtgctgattgagccaactagtggcaacacaggcattggactggccttcatggctgctgcaaagggttacaggcttgtactcacgatgccggcctccatgagcatggagaggagaatcatattgaaggcttttggtgctgaattgatacttactgacccactcttgggaatgaaaggagctgtccaaaaggcagaagaactggcagcgaagacaaacaactcatttatcctccaacaattcgagaaccctgctaacccaaaggtgtagcatgatttaacattttaatacccttgtttatatttgtgttctgtggactcatactgggatgttattatgcagatccattacgagaccactggacctgaaatctggaaaggaacaggaggtaaagttgatggtttagtttctggtattgggacaggtggcactattactggagctggacgatacctcagagagcaaaatcctgatatcaaggtaaggaccagaaaagctctatactacagttttggtttgccacattgaataattaaagttccagcatttgttcctttaggaaaagaatagtatctgattttattttttttcttatgtaagatctatggtgtggagccagtcgagagcgctgtcttatctggtggaaagcctggtaataaggagtcatccattaattccatgtcatgactttatttcattttctggttgtgtcaataaaaaaataataaattgtttgccgcactttagttttcccacaacagccaaaagctaaaacaaaatctttgatttgtggttgtctgggacttagtcatgtgaatatccttgttgaggagggagag

SEQ ID NO: 25619 - DNA, 1798 bp, Oryza sativa
tgaaccatttacttctaatgcagggccacacaagattcaaggaattggagctggttttgttcctggggtcctggatgttgacctcatcaatgaaactgtacaagtatgttatgcttctgtattaagttgagctgtagaaagacatatatataatttagcaccatgttttttttctctcacttgatccatagctttacttttcttcattcgaatagtagtcggtactagatctatattattcatgatgtcttagcaaatatctgcttcttttaatctggtatgaacgtttggtgcattgaactgtttgacaggtttcaagtgatgaagctatcgagatggcaaaggctcttgcattgaaagaagggttgctggtaagatttgtgtttgatgttcatttctgtgctctattattaatctgtaggtacacaaattgcttttgttaagcctctctatgtacggatcattcggatggtacctttgctgaagtcatcagtgatgtaaataattgtaggttggaatatcttcaggtgcagctgcagcagcagctgttaggctcgctcagaggccggaaaatgaaggaaaactttttgttgtaagcgtttcatttttcttacctctgaatttctaatgccctgtggcttaaagctacttcgactgcacctgcatttgtttatccatttggtattttagtccaaatgtacagcagtacagatatactccaaatttacactccagtgacctagaggaaaagctaacgaatctgagttcttgttttgtcattgtggcatctataatttcaattcgcatagaacgaactgccgtcccaaaacaagcactatctccacatttgtcatgacccaaggccatgacgggataaacccatggacaacattgtcgatttgtttcatcatgctcatccccacactaacacctttccctcaatgtaggttgtcttcccaagctttggtgagcggtacctttcgtcggtgctcttccagtccatcaagaaggaagctgaaaacatggtggttgaatgaaatgcacaatatccgggaatccacaggaataaaagtttggtatctctgcttgtgtgattaaacatacattgtcctgccattttcaagttgttctgcttgtgtagcaatggggaacacagtgtgttagccttgtagtgttaaacagtttacattttatcttccctgtatatcagaaccctttacatgggcatttgtcagccagtgtgaatgaaataaagcatcatatgatttgtctcatgttttgggatctcgtctgaaccataatattcttataagagaacaaggccctgtttagttcacaccaaacttctcccaactttccatcacatcacatccaaaactttcttgctcacataaactcctaactttttttccaaactatcaacttttcctaaacttctccctaattttaggaactaaacacagcccaagtctcatgttttgggatctttctctgaaccacaaattctcataagagaacaagtctcatgttggatctttctctaaagtctgaaccataaatattctcacaagagagcagtagtgctctgaagaatgacatcaggcccaaataagggttgtaccagtttatgggccatgggccatgactgacagagaaaatacaaaatagtagtactgatgaacattgatgctcctagtccttgctgctgctgctaactggcttttgcaggaaaaaggagccaacatcagtcaaaaaggtgcaatgcaggctatgctcatgttccaggaactgttttggc

SEQ ID NO: 25620 - DNA, 253 bp, Oryza sativa
ataggtcgttccatttgacttaaaggagctagtatcaattgtacatctgcttgaacactagactgcactgagatcacttggcttgcattggctgattttaactgtgaagctcttttaccaagaagatgcctgaaagcagctagtgctcgaccacggtgcaaatgatgttccaccctcaagtctttctcctgaagagggtaataacgaagttgctagtttggggggaaagaactagaaaactataatagagcat

SEQ ID NO: 25621 - DNA, 207 bp, Oryza sativa
taccaagcaaaaatgttaagtcgtgacttacacggtccccagtcttgatcccaagcatcagaccatatggcagcacaggcccaataaccatcagataaaaggctttcagagaactccttcaaattagtgtaatcattcacattcgcccaagaaccgatcacagctccatcaacatcaccacattcaataggacagtggttatgaata

SEQ ID NO: 25622 - DNA, 277 bp, Oryza sativa
catgagaaggagcacgagcgagatgaggagcaccggggcgagcaccacgacgaggaccccgcggaagcggaggacgcggtcggacacggcctccccctgctgctgctgctgccgcgccccggcggcggccgagaagcggcgcatcctcgcggcatccgcggcggaggggccggcggcggcggcgaggtcatcggccgggagtaggtcggccgccgagggcgagcggtagcggatgcggccgttggtcggggacggcttcaccgcctcctgctgcggc

SEQ ID NO: 25623 - DNA, 7706 bp, Oryza sativa
tatactttgcaaccttagaacatgataaacagaagtatttttaattcaacatgaataatctgtcccatttggaaaaatgaatgtgtcaatggatagtgcaaccttgttgcacggagtgtaacagtactaccatagaattgctctatcttaatatttccgtatataatacacagtcggtgtgcatcctcgttatgtagagaccgggagagtcctcggaacagttgtatcaccttgatgtaattgactgagatcaataaaagcttccattatctaaaaaatatataatacacagcccacaattgtacccagtgtgcaaattatgctattcgtggaaacaacatttgaactagagaattgtttattaaaaaggtactcgatccgagaaggagcaaagcttaaaagcttgattgtgtctatgttgggggaccaatgtcattagttgggtagtaatcaaggcacgtgattttttctgttcttagttaaccaattcagaggtatgtacctaaaaaatgtttttctgcatcacagttctgtaaacagagcaacatatttccaagaataaagtagaacttgttccttattttagagaaagtacaaactgtttgtatcaagggaccacagtttagtaatacggctaattaagttgactcataataaaaaaggttatcagggaataaaatatacttggatgacgccgcaacttcactatcactttccgccctacttaatagccggtagacagatgctaatagcagttgcaagacaccttcttctgcgagattgacctccacgagcatatttaatgatctagcaattcagttttgttagatattcttgcatatataaaaagatcatgtcaatgcaaattcaaataattcattcaaaaagtaaaaaagaaaaagaaaaaggtaggcatggaactagctaaaaattaaagcataataacacgaaacaatgtatatatagaaacaatgtgcataaaggatgaagtgagaaccaagtatatgcatatgagtacatgactgaaaggagattcatgatagcatgaaattaattgtttcctctttgtgagttgtgactggtataaatgtaagtcttattcagtatattcttccagctataaattcaactttcctcctagaaaaccatatcttttaacaatttccaaacacataagcaatacattcatgtcctagttcatttaactagtttgctctgtatgtataacaaatattttaatgctctccaaacagttgtaactgttcattgaaatcataagacatgtaccacaaacataatactggtattaatgtataagaaactagggcataggtaaaagagatgaaataaaagaaaaacaacaaagctgatattaatgtcaagacaaaagaaaagtacaagatcttactgctcaagatcactgatctttgtgtagtgcaaggccaattgcagccaacgtaacctagagaatttaaggtcccatcctgccaatgcaataagcacatagcagggtcagagcatatggcgtgtacttttataacacccagcatgtgttgaacagaacattgcattgaggcaatgctatcatctatcagaattggatatttcattatatacataaatgagaaataagtactaacagaaaaagggaatgagatcattgcttgttggatacttgacacaaaatgatagtaataataatgtaaaatgaattataatgttttaatagtgcgcattaatattcaggtattagtcaacccatcgaactaactactgtgaataataattggaacagtgtttattccagaaaacgacaattgaccaatcaccaaaaatagaataaaaatccaccatattcaaaatacttgggtacaacatttatctcgcaaatattttagtataaatcgaaatagtttagctcatttctgattaaaatagtgtagctcaaatttctgtttgcaatacactgcaaataaatctgtaagcataaccttaaggaaaaataaatccatgagccaaatattaagaaaacggcaggactgcaagatgggacaggcaaccgaacatctagaaagagactcgggactaaaagcagttagaatagcaggacaacagacaatatgaaaaaactaaagatattgccaagtgtattaaaacacaccattctcccagcagagcctgtctgcaaatgcaggtccttcatacaataatgccctgtccaaaacttctatttgccaaggcttccatcttgtttcaggtctgtttactgaggacaaattcagagcatcgcatgcactaccaccagcagaagtcggttgccaaaatttgatgccattgttgtgagatgaaaaggatgaaacagaaattgatggaagaaccacagaaaggctatcctgggtaatcagatacacatatccctgaaaggagcaaaggacacactctccggtaaaagtagagtccttctgaaatgaggaccttttaaggaaactagcatcaatatccctctcatcaaggtgtaatgaagccataagaaagtttgtgtgaacaattctaaaatgcttgtttccatccgcattgtgacttttaaagattctcgttaacccaaatggtgagaggctaattatattctcctgtaatctgcatggtggaaggatcactcttcttaatggattggaaactgccattgtatcagggtaagctaacccatctttcatcggtgttgtagtactgaaaccacttggccagctatccacctgattttcattactgctacaatgttttcttcttttcctaggcctgacaacaccaggattgtctctttctgagaagtcatagaccaattgctgtacagaccgatgacaacaaaatgttacactcccaatatcatgaccagcagcttcccaggcagcaaaactatcaccacgataaaacatggaaggcggatgaaagtttccatgcatactggttttgaaatctaagatgtccttggcatagaacaaatagattaccccaacctcatctacgacagcaagaacaagagaatatgatgccaaaactaacctcttaaacattcttcttgcatgattcccaatatagatattttctccatcagaagtttttacggtgggggtgatgctccccataggaatatctatatctgttctgcaccgttcaagaacactaaaggaggcggcaatgttacaagttctcacattccaaatgacaacaaaccctcccgagttaaggcatgcaagaaaatcatctgacaattggaaatcaacccattgttgattaggaacagcaccatcatatacattctgaaggtctgccacaaagttccactgtataccccactgatttagctcaataacaacaaccaaaatatccttcatgttgcgttgatggacctcacagctcactggttcattacgaattaagaccaagccaatcaaataacctgaagaactaggcaaaaccttcaaacattcccactggcagttgcaggatgtttcagttgtaggaacatgaccaagaaaaccttgttgggatttagtatcgttttgcatccaggtctttgaaggataattgctagaccagaacttaataaaagatagagtaatgtcgtatatgctaaacgataccacctctgctgaatgcggaagtgaagattttagaggaaatttggcttggtattttccatcagaaacagatccactgattgtagtcagaaaagaacgaaaactgttctttgtacctgcctcatcatcctccggaactgaacactgagtaggacgccactctttccactccccatgcaaatctccagtgtccaatttagaattgtctgttagtgtgcttttgtaagaatgacaaaacccatgaagtgtgatagaatcatcatcagatacaacaagaacttcattaaaaattgaatcctcaagttggctagaggcattataacattgcccccatgctaaagacttcactctaggaatagaagagaagcaatcaaagacgactggactacagctatctgagagggaaggtgattcaacttgtgattgatcaacattggtcattgacaagataagatcccctggattataaaaccagaatcagtacggaaacaacaatatagtaagttagcagagcaatgaagggctccaacagggatggcagtggcagagaacagtgaagcagtaaaacctcaccatggtccgagagcagcccaaataggcgccgtgtaggagatataaaagcttctcgaaatttcgatagttcaagatgcggttgggagcttttccatctatataactgtagcacagcgggcccatcatctacttcacgagatgtagacattgttggtaggcacccgttcacctgctaatggtaccaagcaacattgcttgaataaaaacatacaaaaaaaactttagttgacataatacagaaagactgcacaatgcacaggaaattgtatcgcgtgctactgcatattccgacattacttattgcagataaaatggtatagctaactagccgctacaatgcacaggaaattgtatagcttgctactgcatattccgacattacttattgcagataaaatggtatagctcactagccgctacaatgcacaggaaattgtatagcttgctactgcatattccgaccttacttattgcagataaaatggaatagctactagccactattgcatatactcgccaactaaacacacagccctaaaaatgattcggccattgacaattacagtaataaaacagaacgcaatccagcttggcaggagcgtcacatatggggcataagcagaacccccaaacatttatggaaacacaagctgctactagcactacactacgcatcaacgaaacccagaagaaagtggataggttaattggagggatggaaatcaaccaaattatccactcatcaagtcctggaatccacgcgcgcgggagggaccgagtcagctagggctacgagtacgagagaacaacgaggaacatacctccgattcgatccgaacccgagacggataacgcaagcagaacacgaaggcccgccgcgtcgcctcccacctcctcgccgaccgcgcacgcgacgacgaggatgccccgccgctcgggggacgaggagggggtgcctgcgggcgcccttctcgccggcggcagcgcgccgaggcgaggcgaggcgcggcgaggccgccgcggctggatcagagcagggagaggagtaaggacggcgagagaggtagaagaaagccgtggagaaatcagagagaagagaaaccgaagagagaggagaagagaagaggagatgtggcatcgcggccatcggatgccaacgcgacgcggcacgtggcgtcacgtgatcgggggaacggaactgggcgatttgggcttttcgagagaagcacaccggtattgggtctgatgggcctaagtcttaacctttgggactttcagcgtgtggattaggcccatcaccatttcgacatgccggaaacacgaagactaagggcatggttgattgggtgtttcaagttgccacaccttaagttaggcatctatcaaaagtgtggtaaacaaaattctcaccatatcttttagctcaaaaatatgtggcaaagcagcaaagagctgcctctttgacacgctaaactatagaagcaaaacaaaaagggggctaagcagttatgacgtaactaacatgagatgcggcatccatccaaatagtttctaaaaaattcagttctaagtatttaatggataggtcattaacctagtatttgattcagttctaagtctattgtaaaatttaattctaagttattacttcctccgtttcacaatgtaagtcattctactatttctcacatttatattggtggtaatgaatctaaatagatatatatgtctagattcattaatatcaatatgaatgtgggaaatgttagaatgacttacattatgaaacggaggaagtagtatattttatgatatgagaagtaattagtaatacggagtacatctcacattaagcgattcattctttcttatatatttttcgagtgaaatgctttttttttcacaaatcaagtcgtctaagtgtaaacaagttggaagtaaggtttaaaaaaagcaattgtagttaaagaaagggtatttttcatgttgataaaagataagccttagttttttttttattgcttgaaagacgcacacgtgcacatcacgctcacacactcacaaatgatatatgatgaagaaaaaaaatagaattttgttgtcaaatgtaaaatatactggcaatgtttatcattagttacaagatgcagggatggccgtggggtgattgtgatcgaaatttacgtgcatgggtggcatgattagtgaaatccgggctgcatcatcagctcacgtgctgtgatagctggctactagctgcttgcatataatggcaaccgagatgcatggtgataaactcataataattgctggggcaaggaatattagctagctaaagtgcacctgttttgtaatctgagcttattattaagaacagtattatccgttgcatatgcatgttgacaggggtggagccagcttgtattattttatcctagttctctaaaattcaagaaaaaatatgaaatttatatggaaacttattgtcctacacataagactcgaggcctagctaccctaggcatggagccgtcactacatatatcttgacataacatctaatgtgtgcctaacattatatatcttcggacacagaatgaatatcgcgcaatgtgtcaaactgcaatgtgtatttgcactatgcttgaaactaagtgcgggagaaaaaaaaattctaaatttgcaacagattagttatttgtcgaatgactgcatgatattatatatttaattgagggtaacaaaatattttataataaacttaattagtagtttaaaacaaaatgtctaagcaatataataaatgaaagttcgtcaagaaaacatatttttaaatgaaaataaataatccacactaataatcatataagtttctgaaaataattgaattgggtgattaagcctagcggaaaaactagcccccgggtagggcaggcaaccgtccgaagttcgcgcgctgctagtgtttttattgtagattgttgaaggcttggtttagttcctaactttttcttcaaacttctaacttttccatcacattaaaacttgtctacacacataaacttctaacttttccgtcacatcaatcgttccaattttaattaaatttttaattttggcgtgaactaaacacaccctaagaaaaaattgatcaaccaccgaaaaatacttttaatcgctcacgatttacgaaactgctggctctgccactggttgagctaacatataaacatatggaagtaagagcaagtttaatagtatagcccactactaactccaaatcatctatagccaatgtaatagccaattcatacaatagttgcttgctatactattaatatctggtctcacctatcatacatacattacattttggagtccgtactgcagctggctacagatctgtagcccgctgctcttctctcaatttttttatctctttaaaatatgtttatagctggcttatagcctgctattgtacctgctctaacggaa

SEQ ID NO: 25624 - DNA, 10083 bp, Oryza sativa
tgcacccctgcaaagctagatttgtctagcctctattgttttgaatagaaaattaaatcttttggtcatttttttgtaaccttttaggagtctctgtatgcttgtcgtcaacatgctatgataagtttatatcagttcttttggagctatgatgtattcttgtatattttatgactgctaggatattatgttaaaactgttttaaaggtatcatcaaacaagttaatatagatattgctacctaccaaagttggaatttgattatgtcgtaaaatatatgcaccctacatgttttagcttcatattgacttatattttcatatgtgctccttcaactgcacaaagctggaagttcctgcatctgaagccactattgatgccactgcgcaaggcattgcttccatgctatgtgctcatggtcccgatgttgagtggagaatatgtaccatctgggaggctgcgtatggtttgctacctctgagttcatcagcagttgatttgcctgaaattgttgtagctgctccacttcagccacctactttgtcatggagcctatacttgccattgttgaaagtatttgagtatttacctcgtgggagtccatctgaagcatgccttatgagaatttttgtggcaacagttgaagctatactgagaagaacttttccatcagaaacctctgaacaatccaggaaaccaagaagtcaatctaagaaccttgctgttgctgaactccgaacaatgatacattcactctttgtggagtcctgtgcttcaatggaccttgcgtccagattactatttgtagtattaactgtttgcgtcagtcatcaagctttgcctgggggaagtaaaaggccaactggtagtgataatcattcctctgaggaggtcacaaatgattcgagattaaccaatggaagaaacagatgtaagaagagacaaggaccagttgctacattcgactcatacgttctagcagccgtttgtgccttatcttgtgagctccagctgttcccttttatttccaagaatgggaaccattcaaatctgaaggactccataaagatagtcatacctggaaaaaccactggtatcagtaacgagctacacaatagcattagctcagcgattcttcatactcgtagaatacttggcatcttggaagctctgttctccttgaagccatcatctgttggtacttcatggagttatagttcaaatgagattgttgcagcagctatggttgctgctcatgtttctgagttatttcgtcgatccaggccatgcttaaatgcactgtctgcgctgaagcaatgcaagtgggatgctgagatttctaccagggcatcatccctttaccatttgattgacttgcatggtaaaacagtgacctccattgtgaacaaagctgagcctctagaagctcacctgacccttacaccagtaaaaaaggatgaacctcccattgaggaaaagaacattaactcatcagatggtggtgcattggaaaaaaaggatgcttcaagatcacacaggaaaaatggttttgcaagaccactcttgaaatgtgcagaagatgttatactaaatggtgatgtcgcaagtacttctgggaaagccattgcaagtttacaggtggaagcttctgatttggcaaacttcctcaccatggaccgaaatgggggttacagaggttctcaaactctcctaagatctgtactgtcagagaagcaggagctatgcttctctgttgtctcattgctctggcagaagctcattgcatctcccgaaatgcagatgtctgcagaaagtacatcagctcatcagggttggagaaaggtatggtcattcctgcttataagataccagaataatgctatgaagaccgtccttggttgtcagcattcttatacacaatgataatctttgtttttcatgggtaggttgtggatgcgctttgtgacattgtttcagcctcaccgaccaaggcttcagctgctatcgttctgcaggtcaagatattgttattgttatatttacatacttgttatcatatttaaaagcttcatattgtatgtacctttgaaaaaaaaagttccatactgtagcttcttttgttctcatttcttggtttcaaagcatcagcatcattaccgatataaaatatacccatttcctcagtcatcttccccgactcttgtatctttcacaggccgagaaggacttgcagccctggattgctcgagatgatgagcaaggtcagaagatgtggagagtcaaccagcgaatagttaagctgatagcagagcttatgaggaaccacgatagcccagaagcattggtgatccttgctagtgcttcagatcttcttcttcgagcaactgatggaatgcttgttgatggtgaagcttgtactttaccacaattagaggtaacaccttcattcatgaggtccttaggtgcaaatcccagtgaagaataatcagttctactttgtatggttcatctcgcttactgaccggttcatctcgggatcaattacgagcagctattggaagtaaccgccagagcagtccatctcatcgtcgaatggggagattcaggtgtatccgtcgctgatggcctctccaatctgctgaaggcatgtcctcttctctgatctcactcacgttcatgccaaacttactcatcatcatccatgatccatcatcctgactgaatcttgatatgcagtgccgtctatcaaccaccatccgctgtctttcgcaccccagcgcgcatgtccgtgcactcagcatgtccgtccttcgcgacatcttgaacagcggacaaataaactccagtaagctcatccaaggggaacaccggaatggcatccagagcccaacctaccagtgcttggcagcaagcatcatcaactggcaagccgatgtggagagatgcatagagtgggaagcccacagccgccgcgccaccgggctgacgctcgccttcctcaccgcggcggcgaaggagctcggctgcccactcacttgctgacaaggccacaccatgactgtcactgcaagcagctgctgtaggatcagcgagtaggaaaggatgacttgccggccagtttcctgagatgtgatttaagactgatattagctgatgttcccaagcatgatacggggcttgctcccaagatgtgatttttactttacttttggttaatgtgctaccgctgacattagatgttcaagcatatgaaaactgcttgtgctgtaacttgtatgtctgtaacgtaaaaatctttccatatggtaaccggggaagcagaggtatatccttttctgctgttgtatctatttccagtttcctgctgaacttgcaaatgaatattcagcaatttccgttttgctcgtagttcgtgaacgttcagcggtggatcatctgtaactctcatttgtttatagttcgtcacgaaaatatggttccgactttctccttttttttttttttttgattacgagtgttttgcacttttgcaaaaagctccacgcgtttcgacggaatatcgcataggtcctcggaccgtctgacaccctgttatgttttttacgtataacccctcgtcctcaaaaaaatacaatgcgaagaagagaaaattccacttatagggtgttatgtttcttacgtataacccctcgtcctcaaaaaaatacaatgtgaagaagagaaaattccgcttatagggtagcgctgcaaattagaaacaatgaatataaacgatgcatttgattcggtaaattcgttaaattatgcaataacacagcagacagacccgagtaataattgacaagcgtgagatcatacgtgttccatttccaccaagcgctcggttttttgagaatttgatttgatggaaaacttactctagcagaaaagtatcaattatcaaaggacacagacttctctgtttacattatctattatacaagactttcttctaaccaatgtatggtctgaatatctgtaaggttacaacaccttttaactagaaatcattcacacaccaaaagagagtgcaaaaaaaaaaaagggtgaaacaatgctctcaggctctctgaaccaatacagctttaacagatatacatggaacacagcagtaaattcatcaacaactaatgcaccatcctcgtcctcctgatccttgttaaccagagcatggtttttgcaagcaacagaaaagaactaatattgcaagcacaattacgctgaagcaaaggttgcagcttcaatctttcaatcaacacgcgggacctgaaggggactttcttggttgtaatgtacaagatgtcagaaaaaagtgaagatgatatcgacatcttacaagctttgcattgcgatacccagatggagaggagcatatctatcggcaatcgatgggacttctccagcaattaaggtgatatcagatcttgaaggctccgggggaactaagcaaacaagctgcgggttttcatatggctcacatcctcaacaagcatcatgactcatccatggagggttcatacgagttgcagtgcatgaaattctgatgttggggaggatggttgctttgagctccaattccatctggtagggagttgatagtgccatacgctgaacaatgaatcggatgatgatttgagtgtaaattttgccgcaatgggttgggcggagcatttaacacgccggcagtttgtgtttggccagtttgcgctgtatgggagttaagtgcatccgttacattcccaaaagagaacgaattgctttgaatatttgcagaaggaaattgacatgctggctgtgcacttgtatgctgcaatgaccccggcacctcccctgctctgtgctcaatctcagtctgtgcgtagaagagaagcatcaggcaaggatttgagccgcatacacatactggaataacaacagagctaggggaaaaaaaggaaaaaggaaagaaaagggaacgctatggcctgcctattgtactgaatgaattctcaaaaggcaatgtggttttgatttcagcaccttcagtgcttcactaaacattttcatggctcttatgtacatacatctgacgtaatacttaactagtacaattgtttcatagtataatctccagaccctggctatacaaattgtagatgtgctcgaaactgaatcattattacacattcataaagattatactcatcagacaattcacagttgtagtagagtcacatttgatcctattggttagccagcaatgtgtgacatgatccacatgcaaaaatcattctataaattgaacactagtaagtcaccctgactctcaatctttgcatatgacacaaggcattggctagcataaatgtcaaacagggattaaactaaagaaaaagataaagacaaactgacctgcaggaaagcaactagatcggcaacagacacctccaaaccttcttgatgcttgctgcaaatccatcgatagacattctcctgccaaaattcagaaacaggattgaatcaatttgataataaaatcataagttcacaatatggaagcacatccaagaactcagactgatggatttccaacaatttacaactgcagaagctaatttcaagatcagccgcagcatttcaccgagaaactctccaatcccaccataccaaaccacacccataattctcagctaaaaattcgtccagaacataaattcccctatccccaacgcaccagcaactcgaaagaactcgaagcaggatcccatcccccttcgcatctccgcgtaaaatcccaaaactaaaccggaccccaagactcaaggccccaagaacgcagttcttcaggcgactcggccaccgatcggtggggaggggaacgggcaggcggaggccaaggacgtaccatggcgcggcgctcgccggcgcggaacgacttctcctgcgcggccacggcctgcccgtacacctgcgacagcgcgttggcggcgcccctgaacgccaggtgcatctcctcctccgcccccgccgcctcctcctcctccggcctccgcttcttcgccgccgccgccatcccgccctagcgaggaagcttccaaacccccgttaccccccacgtcggcgacgcacggagacgaggacgagccgtgcgctggcgctgccgcggcgtgcgcgtggcgtggcgtggcgtgacgcggcgatggcggcgtcgtcttatggtggtggcagtggcagcggcgcacgaggcccccgtggaccgggtgcaggtgggccggcccaaactgtttgggcctaggaatggaggcccaaactacatgggccaccaaatggtggcccatttagagtcgtagcccaacacgtctgtcatactgtacgggtataaatacgggcgtaccatttcggaggggaggcggcaagtgaacaaaccagagttcaaaaatttcccaaaaaaaaataaaaaataaaaatccgtctcttccgcctccgacgattcgctgctcgccggcctccgccgcgggcgccgcgaagccttccggtgaactccggcgacgggcgggtgtggggattcgcggccttgagggttcgtgctcgcctccgactcctcgctcgctctctctctctctccgcggttgcggaggtcgggggtcttgccggcggtgggtgggctagggtttcgccgcctcgggttctccggggtccaggagatctagggttgtgagatcaggtacgcctcttatggatgaattcttgctacagcgaggtgactggtgggtacgcgcggcgtgatttcgtggttgaatgaaatgttgggctgcgggagaattcggggattaggtttaggggagcgactcgagaaactcaaaactcgaatgccagtttctgaaaggaacgtgaacgaatgaatgcttccgctggaagtctgcctttagcacattcggtgcatcccattgaattcctgtgcataagagtgattttgttatagttataattcacaattagggatcagaacaattatgccctagaaacttcagaacttaatctttctaatgtttgctagaatttatgctagaattcatagatataattctttcattaaaatccatagctcgttttcatcataagagatagatcagtgggctttcccattgtgtgtaggaactttggtgctggtccattatactaatgcttgaatgatatgatatgtatctgacttttttataattggataaaaggatttatttctgttgtttgatttttatttttatgtactagttgtctgattagcactatcgctgcaaactaaggaataatctcagagccgtagcagctaggtgttaactcttccccttggttaaaaaaaaaagatttagctcttccattaccaaaaaagttgtctgtcttgtgattttgggcagactgctaaaaaggtcctgtcctcctgaggtgatgctataaccgtgctctttgcagacaattaatggaactatggaggtgtggggcaaactaatgttggttttacaattttgcaggagtaggattacaaaattgcacaccagatagttttgctgctgaatatcagaaaaccatgaaacctcttcagcagcgctgtaaaccaactgatacaggaacggcggcaaaacttggtggcagtacgatgcaaagcctgaaacctggaaaatatatcaacaaatcatcaggtaatgtgttggaatcttgttcccaatttcctttactgtatggtgtacctgctgcacttatcaaacaaaattaaaatttgaagtagaaaataaatgtctgttgctacaattgaatcaagacagttccatgatgtcgttaggtgcccatccatatgccattgtttttttcgggaatacgcaaggagcgcattttttccattaagagaaataaaagttatttatggagtaaagtacatatgccattgtgtaaagtacatctacgagtaaaactggtctcaaactcaacatgtgctttacttttcaggcaatgctagcacaaaatacagaagagctggtgcctcatcacctcaattgtatactgaaaaacaaagtgcaccaaaggatggtagctttatggaagcactgttccatgattctaagaatgtgtctgctcgaccaccctgccattctggaaagatcgcacttcaactgttcccaatagatgaggagtttcagaagtccctgcagcaggtgattacttcagcttttgcaagatttctatgtgtgattattgtatacgacctcgttcagattccataatgtgtggcttgctctgtataattaacagaaaaaccacaatccttacctggaattgactgtggctcctcgaaagaaaatatcctcagttctgcagcatctcaacacaaaatggggcaattctcagtgtgcaagaggtgaactcatgctcttccctgacggtactaggcttgataacataaatggcagtgagagatggactcgtagtgattcttgcacagcagctgatgtgcatgttgctgttggcagcccttcgacatttcgcttaaggttcgctttcttctccagacctggtttacttacttttgtttgcatccatgcatatattgagcacaaaacttatggctgaatatcacatcttttttcttagatatggttggtttccacccaattttggggaacaaaacagtggagtatctttaggattagtgcactctgcaggcaatataatcgacaacgagcctttagatcctgttgtcagggaacagaaacagatgactgctttgagtgaattcccgagtaactttgctgcaccgtccactgaggccaacacagtaaagactatggtaagttcaaacgttatagttttctttcaatatcatcaattatattttgacttgacctaacactgattacatgttttcagaaacaggataatcaaagcaaagagacaccactttcatggattgactgcatatctaatataagttttggagcactattagctgaagctgcgccttctcaagacagcaagcagttacttccacaaaacaactcaagtctccaacagatacctcttaccgctgattcatttgatgctgctattgcttccctgattgctcggcaacaagcaagtagccagccgaaggtgtcaactccatccctttgggatgcagaagaaacgtgccatgcatttccttcccagaatcgaatttcacgcaggacacctggtacaactcctagcagttgtggtgctagtaccttgtctgtcctaggcacaattctggaatctggtacagacggtgagaaggtacctctattagccaccattcacttgctcttctaataccttttttcttgccaaggacactatgcatttgcttatcggcttgtctctgcagcaatgttctactgaagatagaagagaggaaccgaaccctcaggcatcactcttggccaatgatgacaataatgtgaagccagacatcccagtggtactcaccagagcctctaataaacattgatatgttctatttgattcttaaagagctgatctgattcttatgtatcgtcatctacttggtttcagtctgaatctactggggagccaagactgggagcatcttgttttcagtctgaatcgactggggagccagaagtcggagcatcttgttcaagacttttgagtggcaccgacagtttaagtgtgagcgatttacttgcaaacagcttggatgcattccagaaattctctgttttctgaagcgtagcttttatatggaagaactgaaattgcacatcttgtaaagatcaggaactagggtgaaacgtcgtatgtgtttcccagttcattaggagatctttttttttttgagggggcttgctgatctgaagcctcttgtgtagtatttttccttaaatatttagcgaaaagcaccacctttgtcatgtaaacctctgctaattgctactaacaatagccatattcatctaaaataatcaatgataatattgattgttactgtgtttgcaattttctgtatcgcatattcgtatgactaacaataatcat

SEQ ID NO: 25625 - DNA, 8367 bp, Oryza sativa
gttctgaacaactatggctaattaatactgttactctatcttgtgcagctgctgcctgctggtgcccttcacatattcacacatggcctgaatctgattcatctcatcaaactcccctgaagatgatggaattgaattgatccaaatcaagcaatatcacaaaatcagtaagcaaatcttgacagatttacagagtttctgaacagaataatttcacaaaaaagttacattcttgcataataaaaatgttcattttatgcataattagtacatgtatggctccagctacattaatagctcccgctaaactgccaaatggtagggttaaccgaacgggttatactatgccatttggctagaaaaggcccaaccccataccctgagaattaagaactgccgccgcatataaacaaacatatatattaatgaatgaggctttggttttatgatcaacagcacttttggtaggattggtgctagccagtagcaatcatgatcaatgtcttgattccagagtaatggatctcgattagcaatgataaacatcaagacaaaccgccaattgtgcctaagcatgcgccaaaatgtgctttttgttgtttaacagaaaagattaaagaatactggaatgataggaatgagcactcctaataaacttatttcaagcaaagcttactaatttgacccattgatccatctcgacactcaaatttaagcatatggcatctttactcaatgcgagatgaggtctcctttggaatatatgaatatatgaatttacatcggctcgatattattcgcactatacaactaaagcctaatatttttcttgtgaaaatatgcgataatgcatttttttcacctttaacactaaattgaaaagcttttttttgttcccacagtttttttagatggttttgatcctacagttggtggcacttccacatcgactacgtagggtcttcgacattatgtcaacttccaacatatgggctgtggtcccaattaaatcaacccaaaagtatttccttttttttttcttcaaatccttcatagtttaatcttggattctgtttgattataaatgtctccaaaaccttcaacaataggtgataagtctctctataaagttttttaaaattcttctgctggggaattttcttgtttggggggtagaaatttctacaaagcatccaagagtaggaaatctggtatatgaagcagatattataaagattgaaagattgaattgcacatgtgaatttgttgcaactttagaattgggctctccacttgtgaatttgtgattcactttacacggcgacatgagcccatcacctaccctactacttcatgcgcttacctctaggagcactaaggaattttcgatccagtaacactgaaaagaagatatgatgtttctttatagcagagcataatctttttttgacaataatttatccttgcaaaacatgacttaaagtctcaaaaagtgcaaaacttgttgagcaatggagcatttaaaatgttgatgggcatactgagagtcaacgattaggttgttctgtacaagttacaacttaggagtatacaacagtatcttcaagagcaggagcagtacagaaatgcttcaggttcaatggactcgactctatatcatttgctttgaaaaaaaaaatttgtatcatttcgtgactagcaaaagtaaactaatgtttattaaaaatatgtttataacctttcagctggtcttctttctttgaatagctgaggttgtcccgtcactcgtttctttttttatccagtaattattcaatattaacaaaatcttatgtgtcaggataaacaccggagtccatgggtgcatgagtgcatgactctgttcaccacgattcaaatctcgatgcctcacgaatattacgcatggatcaggatcctctgcagccaactgcaccatcctgtcaatgtgggcccgatggcctccgggcccacatgtcagtacaaaggcacggtacagtgactacggaggatctcaatcctactacgcatatataggtgggtttttaactatattttgataaaatcatagatgtagattttaatgtgatctgagatgtgtaatagtgtacgtgtgtctgccatgtaatcgaaaagaagaatatttgtgagggaatatgaaccatttctaaggttaaaagggaaaatcttttggtgtgagaaaataccctccaattatgtactcaacaaggagggaaaaatattagtagataaaataaatcccctttgatttggttaacaaaaatggttttttttcccaacaaagcaaaggaaaaaccaccctcccccctacaaatacacgaccgcgacgccactcctcccttcttcttcttcttctccctcacattctctcacactccgatcgctctcgccatggacgccgtcggcggcggcggctacagcccgcgcttccagcgccaggcctcctgctcctgcgccccctccatctccatgtcccgccgctacgtccgcggcggcttcgacctcgcgggcgactacgacgacgacgacgaggaggagtacggctacctcggcgccggggtgttcgacggtgtccaccacgccgacgggaagcccggcgcggcgtcccgcggcgcgggggctcctgcgtcggcgtcggcgtcgtcggggcgcgggtgcgggacgaggctgaagggcctgtggcggcggatcctgcgggagaacaagaagcggatcctgctctgcgccaccggctgcgttccggcgtcgtcgtcggcggcggcggcggcgagggtgccctacgacgcctacagctacgcgcagaacttcgacgacggcgcggcgtgggtggagccggagaacctctcgcgctccttctccgcgcgcttcgccgtcccgtcgagggtgctgcagcgggtcgccgtgtagacgacgacgacggcgacggcagcggcggcggcggcggcggcggcgatcgtcggagagaaaaccggtggctttctcgttcttgattttctttttctctcaatttctctcctttttttctcctcctcctcctcctcccaattttggagtcaaaaattgtgagaaatcatatctgtccccatctgtaaatgtcaactcttccatgcatgattccccgcaaaaaaaaaaaaaaaactcttccatgcatgatcagtaattgcagcaaaatttatgaacatctgccaaattttgcacataccagctattaaagcgtctgtgtagatatgtatgatcagaggcaagctttaaatttatttgacagcagtagacagcatttcctaaataacgtcaaaaatatatttttataaacatgaggattagtttgctaagatcatctgattagtttgatgcactaacatttattaccagaagatggttactatcagttttgcgtcttctttagtttttttttttcaacgagctcgtccaattcaaagtgagcacataataatttgcaataaataatgcaagttattaggtataataacccagcttggtcaaacatgtttcttgtagattaggtgatgtgcccttgcatgtgaagttgattggactactccccttttcatttttcaatgtaccaaaatgcttgcgaaatcgaccatataaactactagtatttcatcaagaggctgatagtgaggtatccaattttttttttagaaataacctttcacatgatcgaatactccatatttcgtaaggaggctgatagtgagatatatctaacattttttcctgaaataattttcacagtgatcgaatactgacagtagaagcgatccgagccattgatttggcatgaaaagaaacacatacttttcattggtcgaactcttgtttaatttcccagaaatcaggttgtaaattagtaaaagaagataacaaatctgataaaaacaaatttcgcagaaatcgttgacaaaaatgatactatcaacttgcgtatgaaagatgaggctggcatcacactataattgctgcccaaccgattgtttgaaagagaaaggtcccaaaaaaatatattcttggggaagccatcttggtgtgcccaaaatcaaatgcctgtcatcttaaagaaaaggcaaaggaaggaatcttcagccttctgatcttttgcggttcttttcgtatgctcatcatcttggtatgttggtaccattaattcttctttttttttcttcttgaagagttataaattggtattttgtttttgtttctttgcaagttggtcgatcatgcgttgagcataatataattgatgagaaaatagccatatatacaatccccaaaaattcacctattcagactgttgtgatcatgcttggtgatgtcaataatcacatcgatcacttgcctatttttcagccaaaacctatcacaattggccactagaccagtcgtgtgctacaatttgctatggtactatttggttaggaacttggtatggtagggagttgttgtattgtgagccaaaaggtgtgtattgcagctctcaaccatacaccctcatccgtcttagaaaaaaaaaaagctcgaagttgtttttttctaggacggctctccggtctataatacttgacacttagaatcaatggttgttgtccaacatcaaatattactgatcggaggaagtaatagctaatgattttggacatggtgagtgaagttatgaatccacaactctgccatcacctcaattggtagttcggtgcttatctaaagatcgctttttcttggtttcataatgactactactccatgtattcattgagcccactatgtatctccattgagccgaaaatgtttgatatgggcttgagcccactctcgctaactcacaagcacaatcctaacacattctcataaacacttttcactccgtccaaaaaatactcaacataggttaatgaatctgggcaaagagttgtccagatttattgtactagaagggatcaaatcccctcttagattaagtttttcttttgacggagagagcacacaagagctcgagcctacactgttcggctcgatcgagccgaggaaatgtcaatactattttaaaaaacccaacgttttacctcgtatatgagttcacattttacaactgatgattgacttattatgctataataatatgctgaatgaatgaatttattttttctcttctacttccaagaaaatccgttgccaagcaccttctttttcctagttttcgataataaaatgataagcacaaaaatattcgagtagtttttattttatttttttagctgaaaaaaggggtaggtggttaggagcgtagctatatcgatagaaaggcgccgcgcgtgctcctcctcctcctcctccgattccaatccaatccaatccgattcagaagtagagcgagcggcggctgcggcgatggcggtggcggcggtgcgggcggcggcggcggacgcggcggtgacgttcctgtgggtgctgtgcgtgtcgacgctgggggcgtcgacggcggcggtgacgtcgtacctccgcatccacgaggggatccactacgcgctcctcgtcaccgtctccctcctctccgtgctcctcttcgccttcaacctcctctgcgacgccctcggcggcgccagcttcaaccccaccgccctcgccgccttccacgccgccggcctctcctccccccgccactcctccctcttccccctcgccctccgcttccccgcccaggtataaactactcagtctcctcccaatccccctcgctttcttctccttcgattgctgatgagaatttggtttggcttggcaggccgcgggtgcggtgggtggggcgatggcgatctcggagctgatgccggagcagtacaagcacatgctcggggggccatcgctcaaggtggatctccacacgggtgccgccgccgagctggtgctcaccttcgtcatcaccttggccgtgctctggatcatcgtcaaggggccccgtaatcccatcgtcaagacctggatgctctccatctccaccgtttgcctcgtcctcaccggcgctgcctacactggcccatccatgaaccctgccaatgtgagatttcggttcttcctttaggtttttttctagttactgatcttggtatattattattatcaaaatatatcaacatcaattgctctcacttgcacgacgctactattatgcaattggtttttcaagacaacatggagctaaggattaattcggcacgatgcttactactatgcaattggtttttcaagacaacacggagctaggattaattcaggagcacccgcgatagtttggtagcttgttgatgaattaataggaaacggagtcccaagtcatttgtgccaaaaacctgagtgataaaaatgttgatcgtgcattatctatccccttttatggtgcttatcaaacacgccgtcaggctaagctctttttatttatgttttttttgctcttgttttaaattactaagcaacaggtcaaatgaagcaactaaatagatgtaattttcaaaaagttccactctttccttaaatctccttcatcaggaaggagtcagtattattattggacgtccacagttttggttggagtgtacacaataggcataaaaccgttgccagtgatctcattaattaaaaaccttgcgtgtttatgaggaaaaactatggaaaaatagtgcctgattatacttatattctgcagagggtaactcagttaatttctatttggtcactcctgtccacttcaattaggtaatttagtggaaattccttgtatacctctgaaatcgagatctttgcagagttgagaatgcattgcaaattgttcctgtaatttgaattcatgctactgtattccatttatacatccagtaggatctgatgttaagttgccgctcttctcatttgccctttttggctactgttccttgttttctggtaactaatcttggttaaatattatctacaattccacaggcgtttggctgggcatatgtgaacaatcgccacaacacatgggagcaattctacgtctactggatatgcccttttgttggcgctgttcttgctgcctgggtcttcagggccgtgttcccaccaccggcacctaaacctaaggccaagaaagcatgaggaaatcaagcacaaacttcaactcaggagttggtacagatgttgggtttgaagaacccaacattatttattagctagaatggtacaaggaataatcctttccaccatatttaattcaaagtaatttaggtaattagcttcggaacactgacaaacccaagagcatgcacattaatttgattggacgacctgaatgtaatttcaatcattcattggtcttgtttgctcttgaactggtggatggtatgaatggatattataaatttatcagtaattagtttgtgtgttcttgtattctctacagttcaaggtatcagtacttgctcaatctctctcactagcactgagcttggtttccttttcgaagaataactggagattattcttgatgatatttacctagagacaccaagtgtcagtgctatgcttgtcttctagaatacctagaatccgaatggcgaatgattatgtgttgctaagaaaatttgtctatgtaatttacagattatcataatgcccatatgtgtattttgtaaatcttttcaacacggacggacacttggccagtgcactcttcaaattttcagaccagctgcagcctacgagtgtaataaccataatgagattttaaaaaatcgattgattatgttagcctgtaagtatgtaagtactactccattattgaaataaacatgtatgatgcatgttcacaaccacttctattagaagctaaacaaaagacttgcatacttgctgggaagctagattgaagcaccatgtcactagctttgccatgatccatgatagtacattagtactgcactactgccagttgactggaatgcatgtggcaccagtgattagaaagaaacaagtaggaaatgcagtgcatctctgtcactagggaggcattgatttgagctttgaggaggataatgtgcatgattagtttagtggctggtcactggtctgtcaggctgtcacatgggggccactttctgttattagacttttgattgttttgcatcagagttgtggtggtgccacccatgataccctttggatccaagtatccatgtcatttccaactatctgctacttttttctatgtatatttttttcttcatcaactaactaatgcaccaatatgatcagttgctagcttgatctagcaag

SEQ ID NO: 25626 - DNA, 7773 bp, Oryza sativa
  unsure (1)..(7773): unsure at all n locations
acgtaaacccaacccgcatctttgaagactgggccggcaaatctagcagattgacgaagtcgtggcgcccatcttcgaagactaggttgacaaatcctggagattgacgaatttgtggcgcctcgctgtcgacggggtacatcgcctaccactgaaagcacaaagccgttaaattctggaaaattcgctctcatagggagttgaacttaggacctaagatactacttagactcttgtaaccactaggctactggccttttcgcgctgtagattccagttctgattatgcattgttcagagatcaagtgcagataacccaatcactacctttctgaatgaaatctaatccaaatagtgaaagctaaatctgttatgtctgaacagttctgaaaagctggaccagtcgaagagcttcattgatagccatagatacagctctgatctgagagcatttagccagcttaagcttgatcatttgcttctccgggaccaaattgattgacaggctgaattagtcccggtcccaagcatggcagatgcatttgtccgtggcatctgaatctcctggagccgacatggaggttgcctttgtagcagagatcatctcagtcaccagctagatgatttgtcgtggattattattggcttcacgtttcaaaataatatgatttctcaaaaagttttttttttctgttgtattgtttatttctttagatcactgggtcactggataagatatttaattttgtttggtaagataagatatttagctgtttaccactcctgcatgtggcaattaactatttgtcacttggatctacatatcttatacgtataaaggtccacgcgtcattgagatataagtgataaataattaaactccagtggcaaacagttaaatgcccaagataagatgctactactatgcaattggtttttcaagacaacatggagctaggattaattcggcatgatgcttactagttctatgcaattggtttttcaagacaacatggagctaggattaattcaggagcacccgcgatagtttggtagcttgttgatgagtaggaaacggagtcccaagtcatttgggctgaaaacctgagcaataaaaatgttgatcatgcattacccatccccttttacatgttcatctatttatggtgctttaccaaacatgctgccaggctaagctctttttatttatgttttctttgcccttgtttcaaagtactaagcaacaggtcaaatgaagcaactaaataggtgtaattttcataaagttccactatttccttaaatctccttcatcaggaaggagccagtattattattggacgtccacagtttnttgggnggttnttggggggnaaaggtggttaacccaacccggggaaaaaattttaagcataaaacccttgccagtgatctcattatttcaaaacctagcttgttgtttatggggaaaaactatggaaaaacagtgcctggttatacttatattctgcagagggtaactcagttaatttctatttggtcactcctgtccacttcaattaggtaatttagtggaaattccttgtatacctctgaaatcgacatctttgcagagtttagaatgcatcgcaaactgttcctgtaatttgaattcatgctactgtattccatttatacattcagtaagatctgatgtaagttgcggctcttctcatttgccccttttggctactgttccttgttttctggtaactaatcttggttaaatattatctacatttccataggcgtttggctgggcatatgtgaacaatcgccacaacacatgggagcaattctacgtctactggatatgcccttttgttggtgctgttcttgctgcctgggtcttcagggccgtgttcccaccaccggcccctaaacctaaggccaagaaagcatgatgaaatcaagcacaaacttcaactcaggagttggtacaatgttggatttgaagagcccaacactattagtagtatgacataaatccacgatgattacacatacatactggttaccattcagtttaactgctaggcttagtcattaaaataaggtctggtagtgacaaaataagctctgatggttaacctaaacacatttgaccttacatctcacagtcacaggatgtaagctaaaaaaagcgatatgttatgtgcatgataaatagcagaaatatactacatatcattcagtagtactccatctgcttgcgcttccccttggcgcttgctcctaccttgcctgcttcttcagctctctaccaaaacaaaaataaagatgactgtcaaaacagtatggtttaaatctgatcccgttgttgtatatgccccaaattaagcttgaacaataaactttgaacatttaaaaagagggaaagtgtgcactcagcagtacttcaaggcatgtagctaatgaggttagtggccatggcatcaatgtagttaaaggtaaatgtacaaaggttgctactgttgccagcatcagttaagattcacgttgcacttcagcatgctgcatcttttagaatcaacttaggcttgtaccaataatgtattcggtaattgttttcaagaactccctatattcattcattaggcaatataattcactcaggtttatattggagaaaaagactctcaaactaatacccaagcttaggctctgcataaatttgtgcctcttcgaataaacttagctcataccaattcttaatttgaaaattactactatcaaagttcaacatgagccaggtaattttcagtggttaagacaagagaaggaagtttgtattggataagtgaaaccaactatgaaaaaattctacactaaagagaacacaacatcaaccatgtgtcaacaaatcattcggaaattgatttcaaaacctctacaatcattaattaagtaattaattagacaattcactcaggtttgtattgaagaagtgaaacttagcaagcattccgcaaactggatatcttaagcttgtcccatataggaatagtacattgaaagcatcatagcgtatggctataaagtaagaaaaaatcgattaaaataagtattgtggcaaaacagtaagccataaatgcaaatgtgagaattaataagggtattgtactttttgtcgacataacaacaaaatgctacggaagttgctgatttttttaaaatttcagtttaaatttgagcctctgcatagtgcacactctactaaatcattgaatagacttaggctgataccgattcttaatttgaaaattactactagcaaagttcaacatgagccttgtactgctcattggttcctgatgagaagaccggaagagggaagctggcacacatatgacacactaaactgtgttcaatacctcaacataaatggctggccaaattaagatgtcaatattttttaattagttgtgcaagtgaaactaacttgatgtgacaaatataagcgtccacatatcacttacgtctaaaacaaacaagtatagaacagtaaaacagttaggatatgaagctagaagtacactgggtggcgctgagggtaagtagcatgcagtagcaagtaaactaagtacctggtggtcctgtaggtatgcagtgaagtcagtggcaatgagattgggtataagccactgcaattcaccatgttgagatatctttgtggaggacaggaccttgtttcgccgaatgtcgaagcggatcatataattggcaatgggcaccaggtcatcatcgacaacgacgatcccaaattcatcaacttgtgcaggtacctgctcgatgacattcagaatggtatacattaccccatcttgggtcaggctgaggacaggggaaactggtacaacacatggcaaccccatttgcttgaagctctcacttgcccacatctcttccacagataaggacctgctatcctccttccactccttgaaatcaggggacagaacccatgtcttgagcatcacctcattgggggggcaatgaatatcttccaagccaaccaaggcgacaaacttgacggcgccagagacgcaggccatggaacgccgggctagtggcatcatctgatggcggagcctgtgatggacatcgatgcaatacccagtgggcaacggaatgaaccccaacttggggccatccggtgccaagatgcggtcgcagaacaagatgccctgtaggagatcaacccagcagatgcggccgctgtccagggagaaggcgaggtcgatctggaacaagtgttttggaccacatagatgtgcagggagagggaggcggggaatggaggacttgacccactcgccgccgctcttcttcatggtcagcgatgaccatgcgaagatggtggcttcggggaggcccaggccggagttggtgacgatatcggcgaggatgtaatcatcggcagagcgggaggcgtcgacgaggacggcggtgcggccgaggtgtagcaaggtggggaagcgaggcgagtcgggcagcggggggatggcggtgagggcgttggtgggggcgtcgtagaggaggtagcatcccccgaggtcatcggagcagcctggtcggtagaagccggcgtagatgacgacgatgcccttgtgggtgctggcgatgtcgccgtcgcggatggatcccagctgctgcgcgtgcgcgggcgtcggcgacatcatccgcagggagctcacttgcggaggatcggcgaggaagggatggggttccatcgcctccatcgcctctcgccgactcagcagccgcgctctgctccatccgatgactatgcctgcggcatctttccatgtgccgtcgggtaactcgcgtcctccgaaaaacactactctctccagcaacacatagggaggcctagggtttgccatggttgctgctgctagctagggtttggtccaacaagaagaagattgccaccagcggcaatggactggtgggagaacggggaaaaccctctctcggtctcggccaagagacacagacggacggacggagatctgactgagtcggagacgcggatcgcgccgttgctggggctggacggttagatgtgctactcctctgctcccaacaaaagacacgcaaaaaggtcttccttcgtggaccaggtgcagcgtgaaccgacctcctccttatttttcttctctagttcaacaatttatttatttattattattattattactcattaactaaaaatgcatgttcaggtaaaggctattttaatcaattattgttagatttttttaatctaaaaagtatatgggatttttattttgatactattgatatataattttggactcttattgggatgatggccatatttagaaaaacctatggcttgccatctctgggattgaggataaatactcgccattccatgctccactagatcaatatggcgtggagttcaccggtgcaagcaaggcctgattaacactagtagggtctaactcttcacgatacataccgatagctgggtctactaagtttttcttaaaaataatacgatggtttaggccagtgatcttgttccatccaagctttgccccagggaaaaatgtatctgtggggtagttaaagctcttccaaaaaaacttctaaagagcttgaggggtttgttaggatgagatttccactatttaagagcataacaatggtgttgtttgtggtgatgttagcttgggtagtccaaaggacggcactggttgagcggtttaagatggcaagatttccattacggaagattgttagctccaatgatgcgggatcatcaatcggcttatccctatttgcaacccatgcagaagttttttggcaacctgattgaaccatattccttaggctgtgtttagttcagcgcgaagtttggattttggttgaaattgaagatgatgtgactgaaaagttgtgtgtgtatgacaggttgatatgatgaaaaaggactaaagtttggatccaaactttggatccaaactttggaactaaacacagctttagtaccacttgttagtttttccagacgcttttgtacctgtgttgaagaagccgagtgcgtaccttgcattttttgagacaagcttgtcatcgttggccaacgtttggccagctgagatggtgtccgtcgtggcagaacgtatccaaagattcgatctgatttgaacttgctgcgatgctacgaaaatgaggagagccatggtgaaactgtaggataggtggtcactgctcttcacttcttcttgcatttttatagaaggtaaatgaggcccatagggaataacaagttaacaacgaataggccttgtttagttggctaaaagaaaatttttggatgtcacatcggacgtttaaccggatatcggaaagagttttcgggcacgaataaaaataactaattttataactcatcaggaaaccgcgagatgaatcttttgagcctaattaatctatcattaacacatgtgggttactatagcactttttggctaatcatgaactaattagtctcaaaagattcgtctcgcgattttcctcctaactgtgcaattagtttttatttttatctatatttaatgctccatgcacgtatccaacgatttgatctgattttttggaaaacattttagggaacgggccttactaatgttggagggcaaaatggtacagtgatgtccatcagtgtcagtcactgatcaggcagccaatccacacgatgccccaccaatcaatacgcctgcaccattttatgaccaggaataaatgggacctgaccagggttcaacttaccgttcataaccgcaccgcacggttaccgcggttaccgatcttaccgcgaggtacaaccgcacggttactgtggttaccggccttaccgcgaggtacagtaatagaaaaaccgcggtaacctccttaaattcatataaatttaaaaaataattcaaatttttgataaattttacacggtttcatacggttttcacgattaccgcgcagtaaccgtgcttatcgccggggcgcggtaaccccgtcctctgcggtttgggaaacgctggacctgaccgcatgccgtggaaactgaaaacagacttctaccattctacctactctcaacacgcaaaacgagaagttttatccctttaataccctttacctatctatcactcttactatttttttcaataattaagggtttttttagtcattcttactctctactaattccacctcaggatgctaggaatgaatttttttttggacggagggagtagtaaggggtgtgtttggttgggaggttttgggtgaacgggagatggcggcccattttttttttgcctgtttggttggtgggcggaagtgggattgggcggcccaaagaggaatatacctcgcagatgccggatgcaaccgcccgagcggccgggcgagcagggcgagcgcccgaggtcgggtcgcttcaccgcgcatcagcgacagccacaggtcaagaggcgagagcgcggcgacggaaggcgaggtcggcggcggcggctgcagcggcggaaggcggggatgagcgaggtcggcggcggcgcgagatgcgggcggaggcggcggaaggcgaggttgcagcggcggcggggagggccgaggtcggcggcggttgcggcggcggaaggcgaggtcggcggcggctgccgcggggaggggcgaggtcaacggcggcgcgagatgcgg

SEQ ID NO: 25627 - DNA, 16865 bp, Oryza sativa
gagggatgaggttggcggcggcggcgaggaggggcgaggtctgcaacgtcggagaggcagagccacggcggcggatgcgaggcattttttttctttttcttttttctcattttctttttttttctctatatgtgtatttgtagtatatatatatatatatatatatatatatatatatatatatatatatatatataatttgtgatttgtttgggaatttgtgatttgtagtatatatgaatttgatgggggtatactcacctctcaaagtgagaggtgactacacctgctcatccaccctactccctccaaccaaataaaaaattgaatcgccaaatccacctttatccctacaaccaaacaaaaaattgtatcaccatattcacccaaccaaaaaactggatcgccatatctaacaaaatatggaccgccatatcccatccagccttgatcgtaaaccaaacacacccaagatttcacaccaggttctcgttcgtgccgttgccgctacagcactgctagcttgcaataacgctgaagatcagttctagattctgtggtaacttgtgcatattgatttttatttttgtctagaccatcacgatctttgcatcactatccccagggtcattttcccagtcaagccaccgtaattccacacagtctccatgccttggatgttttgcaaagcataacaaaagatcttattagagatgactattggaggcgtttggttggagagaggaaatgcaaagggtaacggaattagaaagtggtgtgaatggaatcagatcgaacaaaatcctcctgtcccttttttttattgtgcgtggtgtttaagtcaagcacatccgtcgaattaactgagcagaaaacatgtccaattgtgatgcaagatcttcagactttaccaaaaagtacgatgccaccctgaaatatccccgaggcatgatgccttctatcctactagtagtacggatctagaacaccctttgcatactccgatcataaatatttgacaagatttgatcaaatttgattgctaaagcttcaaatatctgaccaagtcaatgcctagtttaaaataagaaagaaaatatgcgtaggttttcatttaaaagtactgctcatatcgtatacgaaatttacaaacgtactaaaatacaaaattgatactcaaaaaattttaaaagtttggtcaagttcgagcctccctctatgctatcgtcgaactttatcgcaccctccacaccattccatcgctattctgttaggatctaaccgtttgatagctctgacatgtgggctcgggtaagaaaaatatcgctattgccctttcagttacgggccccacctgtcattctctcacctctctatttcccctcttctcctcttcatctttctctcgtgagcagcggtggccggcagccggtgacgggcgacccatggcggcggcgaccgaggaggcaccctcaacctcaacctcaccatcggccccttcccccgaagccccagccctcgcggccgcccgcgcgcgcgtcatcgtcgtctcgacgcgccacctcctagcaccatccaaactggcggcggcgaggcccacacgccggggagatgggagggaggctcggagggagagggacgtcgcgctccatcgagtcacatggcggagggaaggggtgcgatataggttgtcgtcgtcgcacagcaccaccccgtcgtcgtcgtcgcagcgccgccctcgtcgtcgtcgtcgcagcgctgcccccgtcgtcgtcgtcgcaacgccgttcccatcttcgtcgtcatcgcaactgccgccgccgcaacagccgcggcgtcaaggtggcaaggcagccaagcggcgccggtggccagccgaggcggtgctcggtggcgcggcagcaaggcggccaagcggcgctcggccttctcctcgctggctcgctcctgcgccgcatcgccgtgctcgaccctgccaccgccgccgtcgacgtaggtgacgccgcaccctcgccacgcccatcggaatctggcaagctccacgccggcgaccttgccaccgccgccgtcgacgcaggtgagtagcggggtcgtcgtcggggatgcgctggatcctcgccgccatgggggccgccgaggaggccgcggcgtccgcggccgccaccgccgccgtccagtgctcttcgtcggtggtgccctccgtcccggctctctctctcttctctctcaaccctaaggacaacaaagtcatttgactgcgctgtttgacactgttaggactaaaaacagatggaatagtgtggagggcgcgataaagttcgacgatggtataaagggaggcttgaactttttagtgacagaaggcaggggtcatcttttttaacgcgcacaggtaaaaatctccaccaatcaccatatcacccgcgtatccttgaattgaattgcttccctgttgcaggcaaaagcaaaagtaaaagcagctggacagctggttgcgtgtggctcgctgggtgtgtgtgtcctgcagtaatgtgtgcctgtgaggtgcaactactgtacaagctaggggtagctagctagcgcctagggttagcgcccagagccccagaggaaggcataggctatcgatctctccctctctgccctgcctttcttgttcgctcgcttagagagagaagcagcatggagagcggagggccgggcgggtagcagctcccctcagttcccctcagttcttcttcctccctcagttctttctccacctcagtgactcccacagagaccatgattcactccggcggccgcggccgccgccgccgccgtcgccgtcgccgcgggagcaaagggccgtacgagcgcggcggcggcggcgacggggaccaagctgccaagggctgcatggacgcggcggcgacgggcgcaaagacagttctccggcgactctacgctgtgcaagaagaaggtgatgatccgaataaaacttttcttttacgctggtgttttttcgttctgtcgtgtgcgtgtgagcgtgactgcgtgagcccttagatcttgcattctcacttcatctttccccatcacaccctaaacctcaaacgcatcacgtactccatacaccacactatcgatcgagaaaggatgagaggtactgctcctagctagcctgagcaccgcagcatgttcaactgttgtaaaacacatctaaaaaatggtttgaaaaatcagaaaaagaaaaatcaggtgcgcttgacaagatgcgagcaatctctttcttgctatctgcccttgcttataatcttttctttgggttgtcttgactgcaggacaacacgctggacgaggtgaaggaggtcgtccatgtgaagcaagatgctcctccaccatcttctttcttgcccaattcctcggtaacaccctctaattgtcgcatatataatttcgtgcaccgctagagatttggatgaaaccgccagtttaatttattttcgtgtcggtgttcacccccccccccccaggtttaatcattttcattacggtgttaaaccacaagatttattatgcaatttggtgagggtggaaacctgacaggtttatccatttttgagttattgtagccgtcaaggaaataagttggaaccgccagacaaagcaaataaaattttaactgcaaccactatttcacagctccgctaatcaaattgaacatgacccattccacctgccaatcaaaattactaaacatccaacagttcaatagttgaaccatttaattaataaaacatccatcaatccattacaggtctgcacttataagctacattaccttagcaccacatgggcacaaggtaataaaacaacatactgcatcccaaataccaaacacatcaccaagcaaaatgttaggctcctatctatttagtttcaaccataccaaatggtctcgatggaactgatcaatgttgctcttgtgtagctttcgttcgcagcaattttcattcgctatcttcatagtcaccatccagatcactgaaattattatcacaatctatgttgaatatgttgtcaccacctaggtcagtaaacctattgttgtcattatcggagtcaacgttcctgcatgtatcagcatctgattcctcattgcagtgcgtaccatcgcccaagtcatcatcgtagtgcatgccatcacccaagtcatcatcgcagtgcataccatccccaagtcctcatcgctacccatgccattttaagtcagagcaacaatgtgataacctcatttttagcttagagatcaatctgtatacattaagtaatgtgtgcgccatttttttaatgcattgctgcacttcatcttactaacaagttttaatcaatctcgcatttgtttttgttgtcatatgttgatgtttatatgctctttttgctgattcttatttgcaggggttacaatcattatttgtcaaggcatgtggggttaatatatctgtacaagtggatttatctaacacaaaagttgattatctaatcaactctgcttgtcaaaagatgagagtaaatgttaaggacacatatgcagtattatgtggaaagattttagagtacaataagtcaataagtcactgtcagactatcctttatatcggaattcaacgattgaaatccgttttcgaggaagagccggccagtgagtgttttttgtttttaagtgatgttaatttcctatatttatacatgtctctaacattgtaacattgtgtgtcttttttgtaggcccatgacatttgatgagaagtttgatgatatccatgcgaacacatggttctacacggttgatttagtacctgcacttcaacgtcaaactcgtacaaatccgccggttctaccatggttatcagtaagatacttctcggactttgcatcatacaacatccaaaaggttttgaaccacatcactgcaatgcactgggaaaacctgagctacaatggcgctttcaatagcgacaacatcatatttcacaatggtgctgttaccatccagggtgttcttacagtacaatttaatggtgtgacatgtgcaaaagattttgcaaagctttattccatattcattgcaaaatttacaccacatggtattccattgtactttaatgatctgcttgagtacttgaggaattgtccaaatggagagaattccaatgatgaggctattgtggcatttattatcaatcacccctgtctccaatcttatttagagaggatgtcacaattagagcatcttgataacatttatcctagacatcctggacattctacaacaaatatatctgctctgggaacattttcttggcaagacaaagtcgtcaggtcccagaattacgtcgtgcttttatttatggtcccaatggaagagcatatttggtaaatggagtgtggcataatctaaatcctttgtatactaatgatccaaaaggatgccttcactttgcaaacaacttcttgaaacatgcacaaaacagagtgagttcagtactactccatttctactgttcaaaattttaaccatcttacatgaagttaatattttcctgtcctatatagttcatgttacatgaagttgaggctgcattttcaaattgcctggaggaatatctaccccatgtattaaaagcgatagcgcgccttgctcaacataacccccaaggccggcagtatctagttgacgtgtaagtcgtgtagtctttagcatgtattaattgatttcaaatacaaattcttttgcacgtgaatttagaaagtggattgttatttcttttttgcaggctttcgaacaaaaacgcagataaatcgtcaggaaactaggttggagagatttcgtgacaggaaactagattcatagatgtaagtaagacaaattgatcaaaattgacttatcattatattcttcagaccatcattgcattgttatgttgatatgtaggaagcagcaatctggaggtgctgcgaatgagtcgtatcttgctcgcctcatggaggcatgtatcttctttgtttctttggaccggtgttgtatgtgttgcagcatggcgggatggcggcatgctggaatacaaagaaaaacaaccatagttgttgtaccgtatgaacatcactgcattcgctcttaatttagtagtactagtaacttgttgtgctgcaggagtactactattatcattactacatgtttgtatgcctgtctttttggattgttttggtttggtttctgtttgaattggtagccgcttgctcagctcaaccgagccagagataagaggccctgcctgagcgtgagcgatctgcttgcttgcatgagctgcatgcatatctcggcatgcatggctgtcgaccatgtctctcggcatagcggtcgagtcgtcccgagctcggccgaccatctgcggtgacgaaggaacaggaagccccaccatatcaggcgcctcccgattcgtcgcaatcgcctccctcgctggatatgccggccgcaagctcgcagccgccggatgcccgtccgctccgaggccaccctcttcctcggcggcctccactcctcctcctcttggtcttagctggccgctaccggcctttccttttctttttcttctactagtaatcgtgcacgtgtaatatacgttttcgacatataaaagtactaaaatatcattgcattttcctgcaatgtcacgtaaaacacacagaaccagtgattgatcgaaaaggggcacacttggtgcggccagagaatttgtgattgggaactcatgatcccaacatattcaccccgataaaatttcactaaatattcttttgagctattttaaaaacaaaattattttttgttctttgtatgtctctaccctgcgacaataagtcgttatgatcatttgaaaattggatgggctgaatagtcgagctgtttgagcatgacacaagcatacaactccaaggtagtataacagggaattgatctaatcatactgaaaggttctgtgctcgttagaaatatgaggtccaacagataaaaatgtaatatatgaccaatcagagatatattattttaattttttgaaccttttcatttttagttttaaaaataaaccttcccaaaacttaatttcgaatatgaaccatttttgccacgcgcaagtgtgtatggtgtgactattgtatagccaagtgaggcgaggcggagtggacaagaaggttaaggtttagaaataagtatcgagatggtttatttttaaatttaatattttaaaaagttcaaaaaataataaaaattcccaatcagaagcgcgtaaccatacttctgttgtctgttgcataataactttttacctacctaagagggtggcgcacaatcatttatagttctcttcacaagaatatggctgtgtttagtttctgaaattggggagaagtttggggaaagttgatagtttggaaaaaaaagttgaaaatttatgtatgtaggaaagttttgaatgtgatgtgatgtgatggaaagttaggaattggggggaaatatgtactttcaaagtgcaagtcacagaggcggaaagtcagctccggccgcggcggtggacctcggcgccggcgccggcggatggggccgaggtcggaatcggccagcagatggggccgaggtcggaaccggccgcggtggctccgatggcggggaagaatcagcgactccggcggcggcagtccacgcagggaggatttccagcgaggatgcggcggcgtgtgttccataagaaatattagccaaataaatgaagctcgataaattgtatgatgaaagaatatactatctttagtccgcagaatctcagtatgcagtatatcagctcaatcacttgaagctgatgaccctggcacctccgcgagcgccggcgtccacaaccgcagccgcgcctccgcgaaacacggcctcccccgctgccggccgtgcctccgcgagcgccggcctccaccgccgtggccgcgcctccgcgagagccggcctccaccgccgcggccgcacctccgcgagcgccagcgtccacagccgccggccacccctccatctacgctctccggccagatctggcgggggcggcgccggatccgccgcctctaagccgggaggagtcaacaccgccgtgtcctagccgaagacgacgcgccaccccatatactagcgcacgtgaatcaactaatcaaagcaccaaacaccaccctgatattgtttaccatcttcaacctcctcaatctcacccactggccagttggccactatagctaggctatatttggttttcttcaatgctaaattttgacaagtacaaaatcctaagcaagctttggtagtgtcaattaatttctttcacaatttatatgtgttgttggtatattttggtagcaaatcctatcttactataaagtcatcccccactaactccttaagcttgacatgcaaagatgtcacatcatcatccactaacaagatgccacatcatcatccactaacaagatgccacatcatcatccactaatccactaattaacaagataccacatcatcatccactaacaatcatcacatttaaacatcatgcaaacatgctatatctttatagttattataatttaagagcttttcaaatacaaacatgttaaattatcatccaacataattcacataatgttttaatgtatatctttattatatagttcatcctcacttagttagtgcttaaatgattaatctatggttcaaattatttttctcattttttcctctaactaagtcatatcacatcaattgtttttagcctttagatgattaatctacggtccaaactatctccctacttttcttcttctgtaaagtcataccagcttactttttacgtttgaatcatcattctacatactatttgaatttaaattatcataaaccacatcagtttacttaatctgatgttatctagctatattatacgttatctttttttatcatactaaattcctgcagcaatgcgtggggtttcacctagttaaatactagttttaaagcaccaacaatttaatagcgcatattttagctccagaacaaaatggctcccccagcgcgtgctctctcttttcttttttctttagtagatttgtgctccaagataccctaaccctataccagtccaaaaattaaaaggaaatcgtggtgcccaaaatctcggttccagtgacttcacttccaacaaccgtgcaattaaatatgttctctatttctagcattaatataatctaagttttcctaaaaaaatcctctgtgctatgtgtattagagcgactgcaatagaatgaaatgaacggattatacaagttgtcacatcgtatttgtgcttatgtagaggaagaatgagatgagagaaaaaaaaacaggttagtagccagatgtagcactggattagactccgataaataaattatgtgagatagattaaatattaattattgtgtacaactaattttaatttttgaagctaatggtcgacttgtatattactagctccaattttaatgtatgacgccgttgacttttcgtccaatgcttgatcatttgttttatttaaaaaatttataaaattatcatttattttattttattgtgacttgattaatcatcaaatattctttaaaaatgacataaatattttcatatttttataaaaattttaaataaaacgaatggtcaaacgttggtaaaaaactcaacggcatcattcatacattaaaatacggagggagtagtataagctttgctgtccgatccgggggttacactcgtgtcaatctgcagcctgaagccaccctccacgcaaatctcgttcgtgctcctgtacgtcaacccaaccagggcggctgcatgccaaaggcgccgggtcgtcaacccaacccggtgttggtggagcccatgaccatgaaggaggtgcggtggcgtgttacgtgcatggtaaaaaaaccggaccggggtcgacccgctctgaccgccgggtcaccagtcgaaccgccggttttttatttattaatattactagcaaaaatgtctgtgcattgcaacgggtgaaaaaaattctaatgataatatacgttttacatgcataatcatgtcaatgacaatgtttgtattttaataagcaacatgtttttttataaacaatgtttttttctcttgcgcgattttctcaaaccatttttcaaacatggcgcatttctttctaacacttttttcctagcatattcatttgctttttttactgacgatgaaaaccatatttttctctttttttttcttttcttttctcgtgtgttttttgcatgttttttctgacaattattttctcgcgcgttttttgcttgttttttcgaatgttcttttttgctttttccaatacaggagaatatataacgaaataaaagccgtgtagtagatgataaaaaatcgatggatcatatctggctcaagtgtccatcaatttagcgttttttctgacagttttttcggaccgatttgttttttttaatagatgatgtttttacacgattttttcaaaccattttttagaaatgacgcgttttttctgatagtttttcctcacatgtttttctaaaaaaaatttaccgatgatggaaatattttttctcgcgtgtttttttattttttatggaagatggaaaacctttttagcgtgatttttttgcgcttttttctgatttttctcacacgtttctttgaaccgtttttattttgtcgtgcattttatccttttaaatagttagattagattatacatagcgaagagatatatattggttagaaatcggaagttgtttcaccccttccattttttcctcacgcgtatttttattttatgcaaaccatttttttcttcctagagaaccggtcgaactttttagatgtttttttgaatttttttcgcctttataggaattagacttttttctgtttctaaatgaatcagatctagcatttttttcacttttcttttgttttttataggatcagatctacggttttttcgccacttaggagaaacggagttttgttgttgttgtttttttttctttttctttattttcttttttgttcggtttttctttttctttttatgcagctttctgcctttgttctttcccttttattatttttaaccaaaaacgacctcaagtatcttattgcaagattatagggacttaaatgtaaatataaaaattacagggactcaaatgcaaaagtatagatccaaaaattaaaatcatataaaaatggaatgctctcaaccggtaggttccgtttttgcaaacagatcttcaatccggcacatcaattttatttttcgtttttaagggtgaatcggatctagagtcggacttttttttccatttctaatagggaatcggtaggagtcggactttttttcgctactttttttgttttgacggacggaggaaacatcattttttaagtagtagagatatttgatttgtattatttttaatatagaaccatcacaaattggtgaaaatatgcataaataaaccagtatatcttttattacatggtcacaacataaaaaaaataaatatggtgtggtaacataatatattcatcacgtcatactgcaataggaaaaataaaaacgggttcgatacttaaaacccgccaccggttcaccggttcaagcaaaaaccggccggttttttaccggatcgattgcaggggcggtcttttagttgaaccgaaccgtcaaggtggccggttctggttttttccggttcaaccgcccattcagtccggttttttactatggttacgtggagctatgcttttatgcgtcgtgtcgtgcgggtagatagatgccacgcagcgatagatggtgcatgatcagcaggaagcggttgagggcactcacagtgtaagccatggagcccgtacccctagtccaaaaacttggcccaaagacacccatcccatagtgcaagcacccctggttgtgtggtttaactggatcaagttactgatgaggtaacacagcccacagtgcagaacccaacccgtgccccagccaaacgaacacatattaattttccccatctaccccttccttctggatgcttcggttcgagggcctctcccccgtggccgtcccctctctcccatgggctgcccccctctctaggtcgtctcctctctccggtccgacaagccgcgttggtgacacgatgccttccctcaccgtgggctcgttggccgccactgtccctttcaccaccggctcgttcgtcgccgccgctggctcgtcggccaccactactggctcacagacaagcttatcgatcgccgcggccgtctgctccaccggcaagatagtgacgccaccagcggcgcaccgccgttgtctttgccacctcggccgtcattaggccccttgttgccacccgagacttcgccgccggccaagctccgcagtgggccacctcctgtgctaccccgcgcatcaccactaccgttgtgctctccaacgcctccagcctcgtctaggccggtggtggtggccgctgcggtctatgcgccgtgcatgttgctgccgccgctggcgtggccgggcctctcctcgccttggtctatctgtgcgccttgcacgtcgccgccgccgccacgatctctcccatcaccgaggtcggtggtggcgcttgacgtggtcttgccgccgccgccgcctcgctctcctccgtagccgatgccactagccctctccttgtcgaggccagtggtagccgctgcggtatgtgcgcccctgtctccgccgactgctgcaatctgtgcgccctcgcctttgccggccctgtcctcgccaggatgcgtgtcatcgcccatgccgccgcgatctctcccatccagtgtttgaaatttctgttcttcggaaatttcgccccccccacccccaccgaaatgctaacatctcgcccgaaaattttggttttttgcaattttttgtgaatttggtcaatttttattcaaatttattcaaaatccgtcaaaaattcaaaaaaaatcatacaaaattttttccgaaattttggttctatcgctcagctgcggcagaactgctgattttgaaatttaaaaccctgctcccatcatcgaggttggtggaggcggtcgcagtttcaccctccccattggacgccgacgatttgattgtgccagtagtagggacagcaccggctgctcggctctccccaccccatccctgcctgaaggcaccgtcaagacgggtagccgccacggggcgctggccgtggcggggtcacctcctctctcaagccaggtcccactggtcggctactctcggccaccgtcaaccttgcccttgccaccgactattcccttggtcacgggggatacggttctgttcgacgttccgatggtcgccctagatcatgatggtcggccgatggcgcagctcccgttttcggtcgtcgagaatgccacgttgcgcaccttccttgccaaatgctccaggtctatgcctccaagtctggccccgctacccctgcctccggcgcctgttgttgccaccgtgggggtagtgccgaagcgtagcaagaggattgcggccccgaatgactcgacctcatgcgtgcagcccctccctcggatcacgccatggccctgtcttcgctcttctccagctccctgcctccggtgcaggccggagtgtagtgggaccccctaccccacccttccttgtgataggagtttttgtttctttcttagtagcttatcttccttatatttgtttttttttcttttttttccttgacccctgtcaacggccttttgactgtgtgcgttgtgtaatcaaactctgctctcttcttctaatatattgacgtgcaattcttttgcgcgttcgaaaaaagatagcccaaatgtacgcaagatcggttaggcttcaaaagaccacacaacttttaatcaaaggttagatattttttattaacacaataaagctaatagaaagtgctcgattagtatagtgcaatggcaatgggtgtatgatttcaagtccgagttctcgtattcaatactcaactcactcataaatagatatgagtgagcaaaggatggcgctcccatccatggtgttttttcgtgtttcacctagggcagctagccgtagccgcgaagcaaaggatggcgctcctatccatggttttccaaagatctctgcggccgttatcaagacgaacgtggactggtgagagcggtgaatcggtgatcatcgccaggttggctctcggttcctcattggttcctcctcctttgctcctgatccgtagacaaaagggtgaggaagagttttatctaggatttggttttccactgttgtaaactgatcatatctttattctgctgatactatggtggtgtttgaatgtactgaagatgaagattaagtgtttcacgtaaaatgaggtgttaataacgtatggttaattgagttttaattattacaaacttgaaaaatggattaatctgatattttagaacaactttcatataataagttttcacacgaagcacaccatttagccatttaaaaagcgtgtcaccatgtatacttggttgattaaaactatccgctagtacttcgtccttccgtaccgtgaaagatatgaacaaataagaacgtttgtagcccaatactcattagaccttgttcggttgggccgggaatggccgggatcggggcccaatccccgtggatcatcctggcgaggaaacaatcccggcccatgcgaaattgtgccttcggttaaggaataagtccactttgactcccttaaaagtaacccgaatctaatatgtgaccctcaaccgcaaaaccggatagaatgactccctaaactattgaaaccagtgcaatttggttttggagggtggttttgctgatgtgacgttgacgtggcaatgttgacctaattttcgtcccacgtggcgcttacgtggcattagaattaaaaaaaactatggacccacatgtgattcacacataaaaagtattgtgggccccactgacatgtgggcctacatgtcattctctctccttccccctccctctctccccgttctctctctttatctcccccctttctcttcaccttctctctcgtagcgtaatctgcaggcaagggcggcgacggcaagcgggagccggagcggcggcggcggcgatggctgacgcggcagtccccatcgccatcgacctcgacctcggcgtatccgcatgcgtgatggcggcggtctccgaggatgcaatccacgaacccagcccggcaatccggccaacccccacaatgctccacgggtcagcctcggcagagtcgagcagcagtacaacaaacacaccaatgtagcagcataggagaaggcaagcaagcaagaggatgtgtatagctgtatagctcgattacttcctgctcatcaaaaatcatgtcgagtaggtgatgatatgcctcgccttcgtcccaaggcaggcatcgctacatggccaaaggcgaggatcagtggtgaacccagaacaaaaatgacccggggtcctatgcatatcatagctctagacaacacacaatattaataaccaatatgacacatagagtaatataattaagtgccacacagagttataaagtcataggaatgaagtgcttactgaaatattgatccaccatcacaaaacgagcaaaaaaggataaaaacctccaaaaccacatattgttttgcctagaaaagagaagagatcacttagtaaaaacatcatgtaaacgtgcctttaaggtctcaaatcggtgaattactgcactgttggtaactttcatcaattcttgtttctcaacatagcaaataacacaatcactcaagtgttcatcactaatgcgattgcgcaaatacgtcttcacaattttcatggctgaaaaacatctttcaactgtagcagtggcaacaggcaaaaccaatgctagctttaaaagccggtaaaccaatggatagcaaatatgttttcttgtgtccaccattttttgggaaagctgacatatagtttcaatgttagcgaatctatcatctccacgcacatcagcgatataaagagaaagatgatgtctaagatccattagttccccatcatcaaaatcctttggataaagttttgctaaactcatcaaatgctctaaattgaaatcatgaaatgattgcctaggacttaaggcagctgcacatatgagtaactgagatgttttctcattaaagcgattgtccaattcttgaagcaaccaatcaacaatttcgttaaaacaatcaacttcaaaatgatgcttgtttgtaatcccagttttttggcgtggcctctttggatttatgtatgcatcctccatctccaattctgaaatgtcatacttctcacaaaagttatgcacctcagctaaaatagattcccaaccactcctcctaaactcatccaagtgatttctagttgattttacacaattaacagcattgacaatgtcttgatcctttctttgtaaagttacggaaaaggtgtttgtgattgccaagatattcaacataagctgcaaataaaacacaaactgaaataactgaaaataaacaaggaggccagctgcttgcctactatttttgtcatccctgtcattctcttccacatactctagaactttaacagttgtagggaacaatt

SEQ ID NO: 25628 - DNA, 703 bp, Oryza sativa
  unsure (1)..(703): unsure at all n locations
ttcaaccaaaatccaaacttcgcgctgaactaaacacagcctaaggaatatggttcaatcaggttgccaaaaaacttctgcatgggttgcaaatagggataagccgattgatgatcccgcatcattggagctaacaatcttccgtaatggaaatcttgccatcttaaaccgctcaaccagtgccgtcctttggactacccaagctaacatcaccacaaacaacaccattgttatgctcttaaatagtggaaatctcatcctaacaaacccctcaagctctttagaagtttttttggaagagctttaactaccccacagatacatttttccctggggcaaagcttggatggaacaagatcactggcctaaaccatcgtattatttttaagaaaaacttagtagacccagctatcggtatgtatcgtgaagagttagaccctactagtgttaatcaggccttgcttgcaccggtgaactccacgccatattgatctagtggagcatggaatggcgagtatttatcctnnnnnnnnnnnnnnnnnnnnnnnnnnnnnnnntaaatatggccatcatcccaataagagtccaaaattatatatcaatagtatcaaaataaaaatcccatatactttttagaataaaaaaatctaaccaataattgattaaaatagcctttacctgaacatgcatttttagttaatga

SEQ ID NO: 25629 - DNA, 9308 bp, Oryza sativa
attgaggttgtatttctcaagaaaggaggatttcagattttcagtccacagaacaataatatgttatcatttattatgactcaccatctaaaatagtcacttctaatacccagaggtgcagcaagcaatatgtctgtgatccaaggagatagtggcctcaatggcttccggtcaggttcatttcttggagaaccgttagcccttttctccatagactcacatgatgaggcctgatcagatgtgctgctacattccgcttcactatgttggtgatcaactttgaagattggcctgttgtagtgagttagaactctaagaatttctccacaggccaaggcccactgctccgagtactctttctgcataaaagttgcatctttatgagcaagagtagtttgataagctataagcagcacagtttagatataatattgaaatgcacagcagaggcaaaatcttatcaaacacagagaaatgaaccaataaattggaactaaccattagagtaggggccttacctcagaagtatggctaaataaagagatgaaggacatgaacgggaaaccatttctatcataactgagtgtcccatctatgatgcgtgacagaatcggatgcacaactgcatggccatgctcaggatgatgaagaacaaaagttgctggaaatatgagaaaaatatgtcaaactctttcttcaattgtttgtggaacatgtattgatcactggatcaaattacctaatacttcatctacaaggcgcttttcttttgatggatagcaactttgaattagctgcaagcatgcaagaaaaagaatgcaaaagttaacacactggagaaagattttatcacagaagatactaaacatgcttagagatacagtacctgagctatatcttcagggaattgctcactgtcagctgtaaactggccaaagtactcaacataggccagaatttgtgccttcagagaggagacgcaaccaagtttcccattgaggcaagtatgttcaacatatagaatttctaacaagaatcaaataggaataatgttacctgtttttgttgtgaatcctgtggtgggggccagaacagtgatgagaactggagcccatcaatccacttctcatttgaagctgacatacttggtagctcaagagcctgcccaagaaactgagagaattctcaaagagaaagaaagaaactacacaaactgctccagttagcaataaaagcacctgtaatcaacaccacgttgaagccgccagttagttcatccatttatgccaccaaagtccaaatcttcttataagctacttgccttggtatcaagaaacttcgagcaagaaagttataagagtgctatccacttcattcaatcaacccccataacgggggtctgcatctcacaacgtgacacgttatcatatcaaccaatgccaaccatatgagcttcagagtctctacactgtaatatatcgcacaacaaaaaccaaaaaaggaggaaaatacatgaattttaattaatgcaaaaaaaaatttactccctccgtttcatattataagccgtttgacttttttcttactgaaatttcttccaagtttgactaagtttatagaaaaatatagaagtattttcaacacaaaaaaaacatattatcaaaatatattcaatgttagatttgatgaaaccaatttaatattttagatattgctaaattttactataaactttgtcaaacttaacaaagtctgactaggaaaaaagtcaaacgacttaaaatatgaaacggagggagtagaaaaaaactgacaaatgaaaagagagggaggtaatgcaacgaaaattgcataatcttacaagcgcattattttattgtcaagtacaactaaattcataatcaaacgaaaaaatatatctaggaaaaaggtggaagctttctcgtttttaattatcgaaatgaaaaggtacatgttgcaatcatttataaggtaaagtttaccataacatttagttatggtgcaagctcacatgtcgataaatatgttaaggaaggcatcatagaaataggcaaatttatggtaatgctaatggatgtggtgtacagaaccattcacttggttcctcgtaggctcctatggcttatcacacaaaatcaatagatgtgtttttcgtgacatttatacttcatttgttattccacgtcactcatcggtctgtttttgttggtcgattataaatgtattgtctaagacagaatttaatgatgttgttctatcttgttattctttctttttttggcaagcaaagattctatttcgggtactatgacaccgaaccaaaaagtatattacctaaagcatagaaatggaaaatatataggaacaaaacaggttcttcttttggtgtttaattacaggtgtctctgctcatcggttggtgtctgtattcacttccactgttaacgaaatgaggaagggatcccttgttactgtttcaggggaaaaaatattaaagcagagctagcttactgcgaattaattttcagtaattatccccgcacaaattacatccacagccgtatgcaccacatctaaacgcctccacgaagcagcaaaatccagctagaatcaacgctactcgcctaaaaaaaccacaaaaacctcctgaaattcgcagtaataagcatccatctcgcgttgatctatccgatgccacgaattattacaatactaatcagctcaacctcgccgtcaaatttcaaaactaatttccctttcacgtcttcaaaatcccaaccgcatctaccaccaaaactctctccccccaaacaaaaatcccctcaacataacaccacaaatccacccgaaccacctcgccccccatacacgacaaccttagaaaggccatcatcaaaaccagcctaaaaatagttttaaagaaaaaaccaccaagcacagcacagaaaaactaaaaccgcacgggaaaaataaaaaagcattacctcgatcagcctttcaaccaatccggacctcacgcggcgtagacggcggcggcggcgaggggatagacgcgcgcggcggcgacacgggcggtggaggaggcgcaggggaaggaggaggagagagagagggagagaaacggctcggaggaaggagaggcgagaaaaagattttttccggggatggtggtggtggtggtggtagtggccgcgctatttcccacccgcgcgcgcgcgtggggtgggggcccacgcggcggttccgggtcgccgacacgtgggggcgggtgatgtggggcccacgtgtcggtgataggcgggtggggtagctgcggggtgagatacttattcgtgagtgcggcgggggggtgggaaggctttgcttggcttggcggatcgcctcctggcgattgctgacatggccttgatattttcgggggtgcatggcatgtatgtatgtatgtatgtatgcttggtgatcgtcatgcatgaccccccatggccatggccaatgacatggattttgtggttctagtccttgtgttgtgagattattgcgaaatggtccctatgatttttgaggtactatcatggtaagcggttaaagtggaggtatatatccattttcttttgcaagtgaatgattactttttttagagagttgactaaggctcccatcggttgtcattttacccaaaatgacttatttggcttattagaaaattaaaattaatttataagtaaaacttttgtagatttgttcgtagcgacttaaaagccaacattaacaaaaattacgttaaaagcatttcaaaatcaacttcaaaatcaagttcaaaaattcaaattttggcttattctttggctgtttaggccaaacgatggggctataaaatttagcctctgtattcaaactggatctacacggttaaagtgataagagcaaatttaatagtaaagtcaacaagttgctataagctcctattccatgcgtcccaaaatacaaggttagttctattttcctctcatctctctttctctctctacaaatttaggctgagttctttctccgaatttttcaactcactttcctcgtttttcacgcgtacgttttttaaactgctaaaaacagtatgtttttttgcaaaaattttatatacaaaattgcttaaaaaatcatattaatctatttttttaaaaaaaatagtaaatggtttattaatcataagaaaatgtgtcactccattttacgtgcgtaggaggtgagtttccaatctcacctcccgaaacacaacctcaatgtttctatgttggagtatacgtagagatggctcttgttcgagaggcaacaatacacgttttcttttatttctttcctccgtatatgtttatagttggtttatatctaaatagtgtacttgctcttaaatgatagtgagattgcatgttccttgagcttctaaacaatgtgatttgtatgaaaaaatttgcatatgaactttataaaaataccattttaaaacccattttcagcattgtaaaatttaatttattcattggtgccctcgaacagttatcccaaaaatatccatccatttagcttgcaagaatagggatagtggtgataggacaatagccatttggaaaaaaaataggattattataggacattttaggactatttgaaaaaaatggctgttaggaatcttgtctcgaaaataaattgcgaccgttgttaggaattgagagaatgatacaagtaaaatgcatattctcaatggtcctttaaaatgcaacactgctatactatacttgatatatttcttctttgatttttccctgcatttagatcttcatgttggagtactagttaagaactaaaatcttaacaccacaccaacatgaagccttgattcaacttcttggctgagcgggcatgtttctcaaactagtaaataacatgtttaatttaaagaatttacataaaatgcttattcaaaatattaaataaatcatttttatattgtaataggtaattaatcactcgctaatctaagtattggacgaaacacattttagtactaaaattttggacgaatattgtccaaatttatagtagtagaatttatctcatccgttattattatgttgctatattataggatgtacgaggcttgatccttaaaaaattaccagcaataataaagcgtagccgacaaagtctagtgcttagtacaagtgcacaatactaggttctaccactatatatgtaattttactaacaccgagtcaaccaagccatcagaaagaagggcctaattataattatcgctaatgacgcgtcagacccccgaatatttgaccgattagcatgtcaaccgttggatggaaggacgtggccatcggacggcctcaacgaggaggcatccgcttcgctttaccttctcgggaacggcaatcggggtgacgtcaccgctacgaagctggacggctgtagatcacggatgggaggtcactggacggtggtgcgacgttgccattttttatattttaattgctcgctcgtcctcgtccattattgtcgtggtgggccccacccattggctaattgcgctttagatctgtgtgaattgtgattaggtcgaaatttggatgcttaatggagtaattaacaaagcagagtagtagtagtattaggtttgatgcatgcatgtgtctcactatctctctttctttctttctcgtgatgcccccaccttgtgattaggttgttttgtggaaatgcaatgggctatagctatggctgatagatccatcagatcactcgaattgatatttcctcgtgacctgcaatcatggaggcagaaatgttatcattaattcatttttcacatgtaaaccgggagcagtaatcgtatggatatatacaaagtatgctgatcaaactgtaaattacatgagtgtagtataaaaaccactgactttaggcccgactcttttttgcttaacggatgaatggacgaaaaatgcgcacactttcaagcatgcacttgttgaatgaatatatgagtttgtaattactaacatacatggctgaatggttgtagtatctaactatcttctaatcaagttaatctaattagaccactgaagaaaagccatagaaatcttataagatcccagctgtaacattgttcgatgcatcttgctcctctccacacgtttgcaaaagccaaagttgcagcaccagtggcacattaaaatattttcaaggaacaataattaaacaaacaaagcaaagacatcacaccaaaacttacgtacgctaagaatctctagtcaaatatccaagcaccttctgctttagaactctctagaaccatctagcttttagcttactcctcgtcttcgcagaaaaatatactactcctaatcaatcttagcttaattaccacggcgcaagttactaaccgggtttcgcgggcagtggacctgagagggaatatccgatccgcatcggacggcccacaggcgtccacgctcgccacgagttgacctcgcggcggtaagtgggatgcgtgggtggatggcgacggcctggggatgtgggcccgcgggggcggtgccacgtgtgaagagaaggatggcccaggtggccactgttggaacgtgggtcccaccatacctttgatttgcaaaataattatgccatatctcgtgctaatatatttgtttgttttgggataaaaaatttttatctatgtgagagagctagcctaaatcattacaggtgagttggtgagatgagaatttagaccggtccaccaaacgagatgatggtacatttagacactactctctctgtgaaatactttatctttcttttttgccttcactacataaacagaaatgcatttcggctgaactcattctggctagagcgcagccaattcaaacggccgtatttagtactccatccgtttcataatttaagacattttagcattattcatatttatatagatgttaataaatctagacacacactatgtgtctagattcattaacatctatataaatgtatagtgtgtctagattcattaacatctatataaatgtgaataatgctagaataacttacattatgaaacgaaggaagtatgtgttacagtgcaactaaactggtctatattttataacaagtgaggattatactatcttactactctgagttgtgagtaggacaagtgtctggttatgtttgcaacgatgaggcgaagttgtctacctagtgtttttgctgtgacttgtgaggccacacatgtgcaaaggctgtgtgcttataactatctcgaggattgattcggagcggcaagtaaccgacggtgtttggtgcaaggaattcaatccaagcaaaaaaaaaaaagaaaaagagaaaatctatctcagccacgcaaataattactcagcccaaatcaaagagctccatcaattagcctaataaaataaagtaaaagtcaaaatttaaatttcgaacttgattttgaagttgattttatgacattgacatttaaactgctacgaacaaatatataaaaaattatctataagttattttttattctctaataatctgtgttttggtctattggtgaatacgcacaagagatgaggctgaaaagccattgggcatagacggacaacacggggcgacgtgtccgggaggcgaaggcgcacggagcacaaatccgccttcgcttctcctcctcccgcggagaaaggggatgatggccaatgggaggggagcaaaggatattttctctctgatgacaagcccgcgtccgcgtgtcgacccggggcgcgcacgaataatttaagcaagcggggagacccaaccgagaggggaggggacggccccacctgtcagcgcatgcatggatggatggatggatatgcctagccccggatgggtagcatgggcgtggtggggcccaccagctctctcaacttgtcatgttggtccctgtgagattactgtatctccttcaccctactacttctaccctgcgatattggcatcacaccggttttttcgtgctaagactaacctgaataaaaaactgtctagattcgtattattatagtatatcagcatcagatactgggttggttttattaggaagaaggaagtttaaatgttattttcttcgtcccagaaaaaaaaaaactcaatctatgagacggaggggtactacttgcatcccctgtgatcctatgattcttcgctttgtttagttactgaaataaataaaaaaacgcattatcattacataaattggttcctaaaatctgcaatcacttaaaattgtaagatcacatactgcaagagagtatctagccaggatatgcagtttcgtggaaaacccattgagatttgtgaactggttttttgatttcgagccagctcaaaattggtcaacatcaaggaggagttcaaatggtttttgagaaattcaaatctgaaatagtagatttgattgaattcaatcaaaatttggttcgacatctggctggcagcagcagcagcagcagaagaactattacctccaaaatatactccttgaagtgaactgtccactgtcgatggaacaaaaaatgtttgtctccaacgaggtcaacttcaataacagtccaaacaaagagagaaaaacatgggcgccggcataacacaccagcaagcagattggtagtttgggagtacaatacaagcagaaagactgcaaaggtggactactggtgggccctgaacacattaaactgaatacttaagcatatgaaacgtgcagtacagtatgtagtacttgccactaaattgtgcagaaacagcatgctcaactcaggtgactggatgccaccagtggcgaagccagaataaaaattactaggcgttcttgatatgcttatatactaatttttaagtaatataatgcttaatataactaaaacacctagaaataaataagctatccggtgtccggggacaccgggtagatacatgtaggaacgcccctggatgctaccaaccgtgtgttactgctactagtaatactagtacgacataaattgtactgaatgcgatttgaacaatgatcctgtcaagtgtcaagaaattaattgaggtggtagaggacaggtttaatataatccattattaaaaaagaaattaactgaggtgctctccgtatcataaaaaacatgcatatccatattaatttcataatattaagatatgaaacatttcatatt

SEQ ID NO: 25630 - DNA, 6389 bp, Oryza sativa
gcaaacatgggtaaacctgtcaaagactcaaaggtcctgattgagagggcttccagttcctgcagcttttcccattagctcagcttcccagacaatttagattatcagaatatgtagttagaattcaaaaaataaactagaagccaaaagatagaaaaaaaacttctccaaattcttagggtccccttgaatcacaagaataaaaaaaaatagagaaatagaaaaaaatagaattatgacagtattgcaaatataaaacaaaatattacaaaacaacacagaaaacaacacaagaatgaccgtttgattggaacacaaaaaaaaaggaatttgagaagagataaagactcggggcccctttgttcgcaggataggaaaaccactgaaatggaattagttggttctcattcccatatgaatgaaaaaccataggaaatacaatgggagtaatttgatagtgccatgagaaaaataaaggaaagttcacaaagagatcacatctatcattatttttcctctgaaatgtgaagcacatgaatacaattctatgagaatttttctttctttcctatgaattaaagggacatgtaggaaaaaaaaatcatacaaatttgaatcagagtttttctccaaaacttacatgaaatgaggcattccataggaatttaatagggctccatagggtacattccttcgattcaaaggactatataggaaaaatcctataagaattaaatcctctaaaatttgtatgattttttttcaaattaaagggattttaaaaaattggttaccaaccagctgcttattataattttagtctccccaaacagggccaaagttttgctgacacctgggagatagtggtggtactgtaatgtacaatggccaatgggggatagctgcttcagattagccaacgcaaacagataggttcgctgtccgctcaaccaaaagatgataaacatgaatcacaaactgttgctggacatcatgctatccatatgtcgcgatcgacctttgcattccccaacttgattagttagtctcgcccgggtttacctttcgtcctttcccatgaactggtaacgcggatttccttaatttttactcgaattttctttttggaatacaaatttctcaaaaaaattcgattttttttatcgaaatctactttttgcccccatgtcgaaacctcaaaaatttaatcagaagataatgcttaatatatgctatccaaaggcatcgatcgcatatcggtcggtctgctgtatggcccagttggatctcaatctactcaagttgccatttctcagcccaaaagagattcagcgtggatatcaattgggcccagcccaaagctctacagatagatccccctcttttccccttcttttcttttcgtgtacaattttccctttccctgatttaagaatatggaatatatccttgaacacccccacccccccccccaaaataaagcgaatatatacaggcttaacatactataagtacactaatgcatgcatgaataacgtataatgattgtcatacagaagacagtatacttacgtgctcatgatcaactgataaaaggtccgatcagctaactgataaaatgcacgcaagaaaggaataaagggtttggacgatggaaaagagagctcaacgtacagacagatcgatcgacatagatcgagagggaaagagacatgagagaagcccgcaagttatgctgtccatccatgcgggcgtccagctttttttcatcactatttcaccggatccctaaactgctgcttgtattcatccatcacctacaaacaggacagaggtctaacttctaaatctattatataattaaaggaataggaaaaggagcctccacgttcgctcttatagcctagaaattctcacattaatcagagaaaaagaaaaaaacagagtccatatagaaatacaatttagaaatagctcaaattcggaattaaaaaataaaaaatattagaagaggagactagagtccatatagaaatacactttagaaatagttgaaattcggaattaaaaaataaggaatattagaagaggagactagagtagttattacacattagtagttttgaaaagttattgcaaaatttaaaattatgttgtcagtgtaatatattttaataatataatgagaaaacatatatgctattatatgagagaaaatataatgatgctagctgcacaatttgcacgggccaccatgctagttaaactttaattaagagtcggatttagaataaagttgtaaagtactagtgtcttgaactccgctccatcgcactagtctatttcatgagaccgctcaacctctctagtccatttcattttcatgagagaactctaacccgtttcgctctcttttttaggtttgagttgaaaccgtttgaatattgagatctacttcaagagctacaaacatttgcttaataacccaccggctacagaaaactgtactccataatattactcggctacgtacaacaagcgctatatataagtaattatcaccagcctaactaactaacataactatgataacggtgacaaattaaacaacagtaacagcaaatagtaataataataatacacacacaagcatgtgatatcgaaatgcagtcgtcgatggatatatgaccagctagctgatcatcagcttgtggatcggagtcggagaaggcgaaggacgacgacgacgacgacgacgggagagctaggtagaggaagcaagctaccagatgaaggtcatctcggcggaggcgcgggcggcgtcgtcgtcgtcgcgggagggggagtggacgtggcggccctcgtaggtggtgatcaccatgcgggggtcctccgccagccgctccacccgcttcttcacccggcagttgtcctgcgtgcaccggtaatagctcctgcatatatatatatatatatatgcaaatatatatccacaatcacacacacagttaaccacatatatacttcagtacgtgtgtgtgtatatgcgtaggagtgtgtaaatttgctttaaggttatcacttatcaacaagaaaatcgattttgattaatcttgccttttcttgcaacacaacgcacagatcaaaatatagtatagtaatacggagtagtattgaattagggactaactaatacgcgtcgctagtagcctagctagtaaatacatgttcggatgacatccaaacaactttttagtacggagtataacatactccaagtagttctgtttagcgttatggcaacggatgcttttgctagctagtagatctacgcacgtcctaaagcttagatatacctttctacccggtactgctcgtgctactctattctacctacactctacaaatatggagtatagtttttatgtagtcggatttccaggtgaaagagagattacaagtattctaggaattggtatgttaaagtacaaggagagacagatattggaaaattctcaatcatggcctgaccctgctgacacaccaactagctaggccatggagataatattccaggctacccagctggtagcatcattcctcatctcaaacctaaggggcatagatattgagaaagatgtggtaataattacagggtacaaaaatcttgggccctttgcaaagctcaaatccaccttttcatcatctcatggccctttacccaacagtaaagattctccatcagctcccacagccaacaaaaagcagatatatcacacatccaatatatattcactttaaggcaatatcataattgttttttcctagaattttcaagcaaaacatgaaaaaaaatcagcattcgaaataagaacatacccctccatctaaaaaaaagtctaatactaactatgaacctggacacatatatgtccaaattcgtagctaagggttgagttttatggaacggagtagcatatatcaccacgcttatactttcatcctctcgcagctctacataagaacttgcatgcttaattatatgttggcctcaaccgtctaaagtctctctactgcatatcaacacccacatataatacctacaattgttcgcatgaacctactaatatacttctatatgtccagattcgttgtagtaaaaagtggcacattcaatgtttgattgggttttttttgaacggaagaagtaacagcttacacatatacgtacaggttgcgatcaaattaagttgtctcataaccagatgtatttgtgagacttaatttgctcgatcgtcgttacgttgacacaatctcgacgctaattaatactgtatgatacgatacaccagattatccattactaatactaccctgcagtattagttttgacaatcaagaaagtagaagaaaaatgaggatgattgccaatcgattggaaaagtcatgggtgtgttgtagtagtggtgtgtgagccagaggaccggatgggaggagagggtttctgagtggcatcattgcaaggggctaatcagattggactggatgctgggctcatgtctgctgcggtgtgggtcaatgctttggcactacctgtcatgatcaccatcacgcatagacagatgttcacacaagcacagaggctcctaggtggtctgccaggagatgatatagatcttgtcatgtcatttccatcaattttatagtagcatgaatagtagggctgtgtcgagttccacgttaaatttagaagctcgaaaaaattagaacaatatcacgaaaaagttagaagtttgtatgcgcagaaaagtttgatgtgatggaaaagctgaaagttttaagaaaaaagttggaatataaacaaaaacctaggtgcaaactttatactccctcgttgatgtcactagctacttctgattatcctaaaataaatttaattttaagtaatcattatatcatatcagagtttataaaaatacatagagaataataaatatattaaaaataaataaaagggaaataattacattaagattcgataaagtgggagtattctagtctttatattttgtattggtatatatggaatgagtaaaaaatgaactttggtacatagagtaatttttttaattattacttcttccgtgttaaaatacttgttattgtaggcaattcagccttattaaatgatgtcaatatgattaggagtagtacttcagagtgacaaatattttagaacaaattttggaaaaaaaaaaagctactactttctccgtccgtccaaaaataagtgcagccgtaagaatctgtgtccaacatttaacgtctgtcttattttaaaatattataattttttttaaaaaaatcacacataaaatactattaatgttttatcatctaataacaataaaaatactaatcataaaaaaaaaatcaaataagataaatggaaatgaacagttcaaaacaaaataaaatgtagaataaaatgcatcctccgagtgtccatatttatagaacaaaatagaggtggtattaataaatgtagaataaaatgcactcccgagtgtccaaatttatagccatgggtaattcttttttaacgaaggaaaagtatattcatagaggtagattaggaggtttcataaattaaactgcacaaaaaaatgctttgctaattcagtatcataaaattatccgatagtaccaattaagattacaaattactaagatagtttgcttttcttctgttgcgacagttgttgtctacacatgggatgagtggacgttagtgggactgttagatggtgcaatgagcattcaacctactaagttaggatgcacgtcattctctacatgggagctcagttggtcctacgtgaaatggactagtcgatcgatcaatttcattcttgaacagaatgaaacaaatgtagcgcaatctgacccaatctagctattctggagtgatctaatcatctacctgaagcaaaatatcatttgttggtggttagttggaatattagtaatcactaaaaaccggggaaatagttgcatattatgtataaaatcaagcaatcaatgccaaagttattccacgaaacaaaggaatatagatatatatgagcgagaaagatacactggtggagaaaccatctttggtcggtccggcaaaatccacaatagtcccggatccaaaaagaaccgggactaaagattgtttttagtcccggttataaaaattttgatctttagtcccggttggtaacaccaaccaggacaaaagatgatctttagtcccggttcatccgctgtcagatgtatgtcagggggccgaggatctttagtcctggttgatgtcaataaccgagactaaagatcaccacttt

SEQ ID NO: 25631 - DNA, 10575 bp, Oryza sativa
ggtcgcgcccggcggagggcggcggcgccgcgcgcgcgggcgggcagcggggcttcgggcgacggcggccggtggggccgcgcccagactgcgcccgttgttcgtggcgatcggcggcggcagcggcttctttttttttttaatttgtgatgattcactgtgatgtatttgactgagaagttagaaatttgtgattcattgtttggatctgtgatgtatttgagaaatttcttaggatattatgatgtatttgatttgtgtgcataagtaactttatgattgtgatgtggatttggtgatgtgaatttgggatgttagttagatttgcggattgatttggggatttgcctacttgattcgggagaaaataaaaatgaaaaaagaaaaagaaaaaggaaccatctgcactgccgctattgtctctttagtcctggttgggtaacagatccctttagtcaaccgggaataaagatgtatctttagtcccggttattttaaccgggactaaagatggacatctttagtcccggatccttactcccggttggaaaatcggggttaaagggggttctcaaccgggagtaaagatcgtttctccatccgtgatagtacataacccttataattaatcatcaatatcctaattaagcaaactagttacatatgtctatcttgggtacgtagatatagacaggattacattacattagtgttccatttaagaggtgtagacggcaaagggaccagacataacaaaagccatctcaggaccagctttgcaaacactttacccttttgagatccaatgactagcactttagaaaaaggtaactgtgtaggagtagaaaggttgggatagacttggctctggttgcctagttgcgaccaaagcgcactgagccagaaatgtttcataaacttagtgggggtaaatatgtgatgcaaaccccaaacctagatgaaaactcatgtaaagatcgataaaaaaaattgtataaacatattaaaaaccacacatgtagataatacgatgctacacaaccatatataaaatcttgtctaaacttgtcttcgtttgtgagatataaaaataataaagtttgaacaagaaaaatgtcttgatgatttgtccaaaaaaaatgttatttttatatatgataaacaaagtgtgtaacatcacctcatctacatgtgtgattttttttttgaatatagacaactttttagtcagagtttacatgagttttcacctaatttgtggtttaattacaccgcatatttgcccaatttagtgagtatagtgagttctgtagagaagctcatcttagaattattcatgtattccactactaaattactgagtgcaaagtaaaacctatacagttaaattacggtcgacctatatacggataaatattggatggcaaggggaatatatttatttaactagaacaaatgtccgtgcgttacaacaggtgaagtctattttaatcttattactgttatgttatatggtttagttaagatgaaatttactgtgggagttcgtttggatatatatttttaaaaaaaatcatgagctgcagttaagtccgattatcttaagttagcatgtgagtttttttaaatagacttcttgtatgatttcttatgtattaccaaaagtgaacgatattaaaaaccgattcaaatacggatatatatttccaaaaacaaacgaacttaaaaaccgactcatacatgtatgacgtaccaaaataacggcaaaaacatcttaaatttttataatagtagagttaggatcggagtgtatatttttggacagtgaaatcttcccaaacaatcgatatagcacaataatacacaacaaaccagacgactgttttgacattaattaactactcctaattaatgtaattttatgcaagttaatcatgaataatttcattgtttgatctgatctgcgctcgttaattgttttgcagcaaatcaatttatgttattaatccttgtctttccattgcagcaaaaaaacattctccttacatattttggttccatcttttttttatcactttcctggtcttgctttaatattttattgagggattcataaacaacacatgtattttacagcatggatatagctactagctccttcctcaaaacatatgcgcattagctgcaatatgcaatgcatatatataaattattatggacttggttaggttgctagactaaaaaaagcaatatatacgtgaataaatgttatcatcattcggaatcatgttaatttgtacatacgtgcaagtttgaatttggtgataagacataaagatacgatacatagggcctgttttaaatccactggcaaaatttttcatactgtcccatcaaatgtttgaacacatgcatagagtattaaatatgaacgaaaaaataagtaagtacatagtttgcgtgtaaattgtgagacgaatcttttaagcctaattgcttcatgatttgacaatgtggtgctgagtaaacatctgctaatgatggattaattaggcttaataaatttgtctcgcggtttacaagcggaatctgtaacttgttttattatcgtctacgtttaatacttcaaatgtgtatccgtatatccgatgtgacacggcaaaacttttcacccatggatctaaacacggccatattatatatgggttctgagctctgaaacagttcatgcatgttagtaattcaccctcaagtacagctagaagtagagaatgacgaccttaattcacttgtctaatacctcgaacaatgatggaaggagaattcttggctttaattagttccactccattatttttcccttaaagtatcacacatgataaaaaaaatgaattcaaatttaatttcacagggaactatcagaaacaaaatcaactacaaaaccgcggaattcggaattaatatttattttgtcatatataaattaacatactcagtttggagttcataagttcattacgaacaatctgaagataaatgagatactatatatatacgggagattcacacatagagtgactgtcgtatatatatatatatatatatatatatatatatatatatatatatatatatatatatatatatgctatacacgttagaactctcctggcaaagcataccataattaaggagcttatgattcttagcatatactccctccatcccagaatgtttgacgccgttgactttttaaaatatgtttgaccgtttgtcttattcaaaaaatttaagtaattattaattcctttcctattatttgatttattgttaaatatacttttatgtatacatatagttttatatatttcataaaagtttttaaataagacgaacggtcaaacatgtttaaaaaagtcaacggtgtcaaacatttagggaaggaggtagtatttttctacgaggaaccattgattattggctagctatctagcaaaagtgtcacacaccatgcatgggaagaatggcagttcaaaagccctagccagtgagatatataaaaccaattaagctatttattatttctcaatccaaaagtttagaacattatgatgggggaaaaactttggaggtagaagtatttacagaagctctagctgaagccttaattcctcacaaaacacgtcaggcaaacgatcatgcaacatccatatgcatttttatttgcgataaattggagttaatcaatcaattcgcacatgagatcttcaccctctcttcctaaatcctgaagacttgactagagttggactttgtgttggttgtaagggtcgagtttaagacgatctcggctgtgtgccattgttggcttagtggcggtctgtcacgcttagtggcggccggtccgatgctagccttctcctggttttatgtgttggtgttgccggtgtgtgggtggtggtatatattttttatttttcctgattacgatattacagggttgtaatcttataattttttagtgctctatcaatagaacctcataccgtctagaccagagtcgttgaaaaaaaatcttcacacgtataaatgtctgattcagatgtaattaagcatgcatgttgtgattgattttgattcataatgcaaaacgatcaatatgtgtagagatgttagttagttagtttaccttgggtgctgggtgttcttgacgaccttctggccgtacttgcgccacttgtagccgtcgtcgagcacgtccacgtcgctcatcgtcttgaagcagaatctcggctcccgcaccttccgccgcgccttccctcctcctcctcctcctcccccaaccttcttcatcctcaccgcgccaacccccagatgatgctgcgccgccgccgccgccgccgtgttgttgccggcgtcgttgatccccatggcgcccatcgccgccgccgcctcgcccttattccccatctgcggcctccctcgatgatcgccttcctcgcaagacctagcacggcaataacgtcgtcgacatgggagaaaaggggggagagagagagagagagagagatcgattggttgttacggttacttaattactcgtaattaccatggatgcggcggcgacgatctcggaggaggcgcggcggcgtggaggccgccgccgtggtggtggtggagggtgggaggagagggcgcgtgcgaggaggcggcggcggtggttgggtggtggtggtcgaggacgagggggctgtaacctaggacgccatggtggtggtggtggtgagacggcgtgggcgtgggatgctggaaggagaaggcgacggtggtggtggccgtggccggggcggcggcggcggaggtcgtcgacgaggaggccgccgccgccatggtggtcggcggttggcgggcggcgccgtggtggcctagcgccatcaccgccctccctggtgatgggaacatctctccctcttctctctctccagtttctctctctgattattttcgctgtcttgtttgcttttttgtgaggtgtgagtgtgaatgtgtgtgatatccggatgtttatagggtgtgggagagacaagggattgcattattatatatcatcgaggaaattaagacaaaacaaaaacaaagtcttctcgaacttttacatcacacgcattctgaacaaaattatcaacaccttatagttactccatcatgattataatcggtcatgaaaattgatacatacatacatacatatacatatacatatacatatacatacatacatacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggcctaaagatcatctttagtcccggttccacacaaaccgggactaaagatcatctttagtcccggttcgaatgctgtcaggacctgtcaggcccccccgggatctttagtcccggttggtaacaccaaccgggactaaagatcttaactttagtcccggttggtaatcccggtgatctttagccccggttggtgctaccaaccgggactaaagatcttaactttagtcccggttggtaataccaaccgggactaatgatcccggtgatctttagccccggttggtgctattaaccgggactaaagtcccacccctatatatatgtcttcttcctcctccagctgcccgagcaagcttcaaaatttcttcaaaaaagaggggaggtcatgccaaaatttctattaaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttaatttgctaaacaaggttttataaaatagttgagaaggaaaactctagtgaaagttaatcttaaataatagaaaacaaactaaaatgaaaattaaaagaagtaaaacaaattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgctagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcattaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcttgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacgatttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgcaataaggggtattcttccagacaatgttcgggcaacaataacaaagctatgtgcattcatgaacgcaatttcgcagaaggtcatcgatccggatagattagaagcccttcagaatgaagtggtgcaatggctcccgggttgtcagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtagccgtgctcatccagaggcaagcgtcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgttgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtattgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaagagggacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgcaaattataattgactggagaatttttaaaagtattaaatttaatatatttttaaaactatcattcatatattagagtttttcacaatttaatttactatctttcatatgctacttatatatgacgcatcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattatacacaaaaacactttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaacc

SEQ ID NO: 25632 - DNA, 1356 bp, Oryza sativa
gccgccgccagatctcccttcatgcatctcgatctctccgatctcgatctctctctgtcgcgccgcccgccacgagacgccgcgccacgacgacgacgcgccacgccgccgccttcgacgccgcgcaacgccgccgccgcatgccaacgccacgccgccgccgccgtcgccacgccgccgccgccttcgccgccgtgcgcgcaatgccgccgccgccacgccacgccgccgccgccacgccacaccacgccaccgccgccacgccacgccgccgccgccacggccccacaacgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagcgaacgaacgaggacgaacgttaacgtgaaatgcaatatatatatatatatatatatatatatatatatatatgttacttcgcatttatcctaatacattttttttatcttgcagaaaagacgtgttgtcggagtcgtccgtcaagcctgagtggaagagctagccctagaaggaattggagcagacaagtgacgtaataatataaatgattgttatatttgtaatgcaattaattaagattattagacctgtaattagacttatcacgtaaggttgcgtagggttctaatgtacaacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccggcaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaa

SEQ ID NO: 25633 - DNA, 2109 bp, Oryza sativa
cgctcaacccagctgatggctcactggtgttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgtatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattactttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggacgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatccttcctgggcgacaagcggcgtctcgtgcaccatctcctccgggtccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggccccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagtctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctatgaactataccagctggacgccctcgacgtctctattatgagttgctggattttgtaagtatatcgttcagttagatttcttactatacgtctcctttaattaattaggtccttgtatataagtagaccatagaaaataatatacccccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattgaactgtcttcctacataccaaatttcattgccgtacgaacttgctaagtgtgtcatatgtaatgcatcccacgcacattgcaga

SEQ ID NO: 25634 - DNA, 16190 bp, Oryza sativa
  unsure (1)..(16190): unsure at all n locations
ccacatttaccaacataacgcaagaccactgccatttgttccttgtaagacacatcccttgactcatcaaccagcaagcagaaaacatcattcccaacttcttcaagaatataacgcagtacctcttttgcaaagcaacgtatgatgtcattttgaatctttgaagatgtatactgactgttaccaggagcatttttacctgcaaccttgtgtaaagctggattttgctctgcggtataagcatgaaattccttgaaatttcctttattgagagactcctcactctcatcatggccccgaaaaggcatacctagcttcagtaagattctagtaacatcaattgagccatttaaccgagtataataagcaattttctcagcattactttggttgttcaaagaaacatcaatgtgctgctcttttttcagtaaagcatcacaatccctcattgcttggttatgaacactatcaatatcaccaacatgttccttcaatctgtgttttttgttccaactagaccacccacttgtaacaaatgcatcataccctgctgatttcttattagggtctctgaacaaaaagcaataaaagcaataaactttatctttggactcactatactcaagccaactgccaaactcatcataccattcaggattaaattttctatctctaccaccaatatttgtaacagggagatcatccggacgaggttgacaaggcccattgtccaagtattttcttcttaccatctccttttgattgggatgataatcctcaattcttttccttttgccaggatcaaattgaatctccacttcccaattgatatcttcaggaacatctcttctattaaatgtagcagcattatgtctgtgtgatggctgcgatggggcaacatcttctccatgtgatggagattttctcttgtaatacttttccataaattcccatgtcaatcagttagctaaccacttagctcactgccaaccagttattctagtgcaagcaccaatcagtaagcagcgatacagaatgtggacaactaaaaaatgattgaataaattaaaatgttttgatgctcctactctgacagcactaaagaatattgaatgaactaatgtcctaatccaataatctgaattctggactaatggtagaaaacaaaccttgcaagttgcaactggtggaagactggaagtcgagcgtacgcgaatgcatgctgttgccgctcgccgtggcctacacgcagcgtgtcgtcggccgcgcgggcgcggtgcttgatcttgatcttgatctgagtagagcagcgattgagcgaaaagaaggatcgagcaagagcagcgattcagggtgtgtttggttgcaagccacactttgccacagtttgccacgcctaaggttaggcaaatttgacaggtgtttggttgtagccacagttgtggcaagattctcctccaacaaattgggtcccacgtgtcaatggctcaaaaaagtgtggcaagattcccttaggcttagtaagttgtggctaacaatttgatcacctcaccttagacaagatgtgggaacttttgttggcaagtaatggtaaagtgtggctgggaaccaaacagcccctcagtgtctcgagtctcgaagagtaccgacgactgacgaggaaaaggagcggagagccggagacgcagttaattcagtctcgagatacacggcgtcgtttcaccttcccacgaatagttgggctctagttgggctaacgtgagctttgatggattgtttctttagttgggctttagtaagttatctggacaggccggggtccaatccaatttttttttgggtgtcccatgctgtatatacctatatactataacttgacacaaaaaattacccggtgtccggtgacacctgttaggcctacataggcccgcctcatggagctcggcctcctcctggcgcctggcccgggggctttgacctctatggctgggcgtacagtgagggactccatcggcaccacagtggggatactctttggcgggtgcgctccttggcgccatcaccgccgctgccggcactgaacgtgagcaggcagatcaccgggacgctaaccgacttgacgctgcgcgccatcatgggggagtgcggcttccggtggcgtgaggagttcctggagacactgggtgaggcgcagaagaaggcgactaggttcggcgtcgctgacctgttcccgttgtcgaggctcctccccgtcgtcaggagcccgagtggtgacggccggcgggagctgacacgggagctagctggagcggcgggcggcggaagtgggctggagctgacggaggctaggaataatccagcgcgctagtcagaggcagctgcagccgcagccgcctcgttggaggtctgtggcgtggggcggtttccaccgtcgccgccactcaagcccctcctgtcgccgcctccttttgttccgcctccacccgcgttagctccaacccgccgccgcttcagctcccgccggccgccagtacttcggcccccgccccgccgccgctccagccgtgctcccgcggacggtggaaggggagagaaagagagaagggagaaagggagggaggaagaagaaagagagaggatgacatgtcagtggactccactttttttaatgacaaatggatcccacaaatatgtttttaattaaatgtcacctaagcgccacatcaagaccagactagatcaacaccgtcacgtaagcaccacgtagcgaaaccaccgtccaaaatcgttaagggagtcaaattgcaccggtttcaatagtttggggagtcgttctatccggttttgcggttgagggttacggattagattcatgttacttttaagggagtcacagtggacttattccttcggttaatccctagcatggattttagcccagcccaccacgggatttccctgttctgtaggcccaggaaaaaatcacctactcgagaggagcggaaaaattcctcgagaggagcggcggcgctacgaagacacggacgcgacggcgggggcggagcgcggcgcgacccagaggcgacggctacggcgacggcgacggcatagctctcttctccggccgccaccttctctccagtgagcacgcttcccttccccctctcccctcctctttcaaagttagggtagggtttccttctcttctccctttccggctttcccgtcgtcgcacgcaccgtgccgtaggggccggccgtctggtcgtgctccggcgccaatgccgaccgcgtgttcagcttcggctctggcttggggcttgggcttgggtggcttcggcttcggcagcgctttgtccttgttcggctccggcggtggcattgccgggacacgggagggttcttggacgccagagaggagaggagaggaggagaaggaggaggagagggttcttggttcttggcccgtagccttcaaagtgtcggcaccctccacgtcggaatctgagtcatgtagttgcagttgcaggtttgcgaaatctgaaggaattcagagtcatctagttgcaggtgcagtacagaagagtttcttctttcttttactttccaaagttgcaggattcgaacttgattcttctcaagattgcaaaatctgaagaaattcagagtcatgtagatatagttgcagacttgcagtgcagagattttccttttttccttgtctttgattcaccaagaactagttctacctgattaccaagattggtactgtatgatagatatgtatgttttatggttatagattttttgagaactcatgttcaagtcttttgtgccaatgataagtttagctgcaactcatggccaaaatgaacataactgaaattcccaaaaaaaaaacaacaaggcaaattttagggagccagcaattcagttttctgtatttgagtaaactaggtcttcttggtatcttctattgcactttgatacaggaacggccaaaattgttgaagcatattctagttattgaaacagattctatttcatgtcatgtccaacatgtttaagaatgccaaaagttgacgatgatcctagttcgtgtcttgtgcataactttgagttgtcaccaagttctttttcttctctagataccctaaaatcacttatatgtatcctacactgatgcaaatcctagtttttacatgccatccgcaaagattgttcctcagccatagttaccactgtttacttttcatttgaatttaattactgaagtgtgttcttcataaatgttgaccattcttatctatagtaaattactaattagtacagtatacatgttgctttccctttttgaccttttgcctgtagctgctagataacatagcagtctccatttctctgtactgcaatacaaagtcaaaaaaagcatgtagccgtgcattgacaattattattttattgtatatctatataagttgtatatatgatctctgcatcttctgaaaatgcagacaagtcaagataaacatgatttctgcattggccatatatatttgttatacatgatttctgcatcttctgaaaattcaatcatctcaagttttgtttccttttatctgtttgtgagataggaaagctaatgtttactcattatgctttgtaggttccatgaaatcgactggtagggaaattccagataatttatttgatggtagtaattttctgaagttcctgaagatttattgcttcagacagcatgacgaaagtcagggcatcattatagtgtctcctgctgctcagctcattccactcataaacctgtttagtttgtgatgtatctgagttacaaaaaatgtgtttaaactgagtgctcccacacagtgaaatgtgtgatatttgatactgtcgacatcattttttttctttgtacccatcattgtttttcctgtgcttctaatctgcaatactgtcctgacaagctttgaagcatcgctgctcatattagctgctcgttacagccattgcaaatgaaaactttgacgtaattctggtctgattacagtcggctgatagaacaaaagcaggtctgctcgaaggagcagccatgagatttatcatattttgatagctaaaatctctggctaaaacgaacatggggtttaaaagagggaataggagagagcaagggattccaacccccatagggattgagtcgagtgacatatgggagggattcactcaatccctccctggatatattccacttggggattaaatcctaaggaaccgaacaaggccttaagtgctatgagagcgcttgtgcagcccatgtagagttcgttttgtgcccaccagcccaacatgaagaattcggacaatccaaataggaaggaaaaagtatactttgacccccctcaactatgacccgagtatgattcatgacctccaaccacaaaaccgggtatatcgactcatccaactatcaaaaccgtgcaaactatatccctccctaggtggttttagaagcggttttggctgacatggcgcccacgtggcggtgttgacccggtcttcgtccctcgtatcgtcgacgtgtcgcttatatggcatcagagtaaaaaaaattgtgggaccgacgtgtcattcgcacattaaaaaaaaaccacccacatgtgggccccacattttcaatccccccctccctcattttttcctctctcaccttccatcagccggctgaagcacgaagcacaagctcctccctcggcgacgctgggggagtgagacggctcggatcgagctactctactcnnnnnnnganaaccatatccagaacagtgaaagcatatgcaagcatgcatttgcatcgatggatcgatatgtacgtatgcccaaattaaagcacggctagctccttgagagcctccccctgaaggcgaacggccggcgagctccacccccgcgcgcggacgccggcgagctcctcccccggcgcgcggacggccggcgagctccacccccgcgcgcggacgccggcgcgcggacggcaggcgagctccacccccgcgcgcggacggcaggcgagctcctcccccggcgcgcagacggccggcgagctccacccccgcgcgcggacggccggcgggctcctcccccgagtgtggacggccggcgagctcctcccccgtgcgtcgtcgccgtcgccgccgccccgcttctactattggaaggtgagaggagtggaaaagatgaaagagagagaggggggagaggtgaggatgacatgtgggcccacatgtccgtgggtcccactattttatttttgtgtgaatgacatgtcggtcccacaagtttttttattacatgtagataagcgacacgtcgacgacacgcgagacgaagactgggtcaacactgccacgtgggtgccacgtcagctaaaaccgctttcaaaaccacccaaggatatagtttgcatcggttttgatagttggaggagtcaatatacacagttttgtggttggaggccatgaatcatactcggatcatagttgagggagtcaaagacctccgaaataagttcactttgggtccctctttgggttcctctatttgttgcccagtccgattttcatcccttgctcgcaaaatcgggtacaacaggtcccccaacttatgaaaaccaggtaaacgaggtccctcggtggttttggctgaggtggcactagggatgaaaacggagcggatacggacggataatgctcataccatattcgttttcatattttttgccggatacggaaacaaatacggatagctcgaatacggaaacaaatacggactatctcgaatacgaataagaatcgaatatgatcggacacgaatacgaaaacaaatttttctcggaatacgaaaaccaattcaacttctaatagaaacaaatatcaacatatataattagatcattttatataaaatatagtataatttataaatatttttaaaattttaaataatattaataatgtggactagtgttaagagatgaactattattaaaatctaaaaaggtatattgaaggtcatagagttataaagaaatggggtatgtctggtggcttctgcggatatccgaatagcactgttcaccggatatccgaattattatccgtatccgacctgataccatattcgtattcgtatccgagagaaaatatccgtattcgtatccgtatccgaactatccgagaattatccgatccgagaggtatccgtattcgtttttatccggagcggacggaaactatccgctccggttttatccctaggtggcacctacgtggctcattttgactaggtctttgtccaacgtgtcattgacgtggcgcttatgtagcaattagaaccgcaaaaaataatataacccatgggacccacgtgtcagttgcacacacataataataaatggtgggcccatgtggacctctacttctaggggaaggacccctgggcggcgagtccaccgacgccggctaccgcggctcgttccacggcacgtgggagttcgccagcgccggcaagctcggcctcgaccgcccgtgcgtcaactcgttggcgtgccggaggagtggaggcagctcagggccagccgcgtcctggtcaccacggcggatcactactggttcgtggagagggcacgctcgtacgcggaggggatcaagaagtgcgagtgggacggcgagctggagttccacgagaccgagggcgagggccatgtcttcttcttgcccaagcccaactgctactagggttgaaatcttcttcttgcccaagcccaactgctactagggttgaaagtgattcggataatttccgaccgaccggaccatttttcggatacagattgtttcggttggatatattcgaaaattttcggatacggaaacaaatacagatatttttttgcagatacaaaaatgaatatgatataggtgatatccgtcggaatcagataatagtcggaaactatccggtttttttcaccggatatctgacttacaagaaaccctagaagtctccaattctccatccattcagatccagtccactcccagtctcccactgtccagtcccagacagagtcccacaggcgcactcctcacctcctcatcggccggcgccgccgccggcgtgccctgtcggcgccgccgcggggccaagccgtcgtcgcctcctcgctgcggggccaagccgccgccgccgtcgggaccaatcgcctcctcgcccagtcgccacatcgccgccgtcggagcaaccaacgccggctctgccgcgccccatcgcctcctcgcgccgtcacgcgccacatcaccgccgccgggccaagccaacgccgccgccgcggcgccccatcgcctcctcgcctgccgagccctctggcttgccacatcgccgccgcaggggcaaggcgacgccgccgccgggccaagccaacgtcgccgccgtttgtgttaatgattgtgtattcatgtgtgattatatcataaataggcttgtgccttgcggtagtttgttctgcaggctgcagctgtggctttaccatgctctatgaattttacatgtgttttcagttgaaaaaaaactgtggttcagacttcagagtttagactaaaaagattggttgacagtatctggcatgcctagtagtgctttgccttttcacttcacatgatgatggatggtatttcataatatcagtgtgtgcaagtttgtagttgtttattattaattgctaaattttgaaaatattgatatgtcctattagaaaaaataatgagttatatttcttcgttgatttgtgatgcttagtttgaggggtctttatattctgattaatattcgtcaccgtattcgtttcgtttcgtatttgctccatatttgtattcgataatattcgattccgttttcatatccgggtatccgtatccgatttcgattccgaaaaaaaaaatgaaaacgaatatgatataattagtttccgaccgtatttgatccgttttcatccctaactgcgacaatgccgtcaaggagctcgccgtcgtgaccgatttcgtccggcgctgttgaagccaaccgctttggttatccctcatgtcgccgctgagcgattgtactactactcgtaactagtaataaagggaggaatatactgtctatgattttgattcttattgatgatttgcaacattgaagtggaaaagaaaaggaaaattttagttgattatgaatttcctaagtgggtcaaggttcagcatagctatgaaatcccttttgttcatttctagttcttcgttgtctgacttaccaaaaaaatgtgaaaggtcgacggccgctcctctaccacccggcaaggtcgacggccgcgacgatgtccgctcacccccgcttcgccgcccctctggcctgctcgagcggtcgccggcgagcgcgatagatgtgcgcggggcggtgggtgtgcgaggtccgcgtgctggggcgccgcggctgcaggctctggctcggcagttcgacggcgccgacaccgtcacgcgcgcgcacgacgccgccatgcccgctctccgcggccgtgcagcgtgcctcaacttctccaactccgcgtggctgctcgcctacgccgcgctgtacgcggcgctcctgtcggggggcggcgccgaccatgcccgccgccgctgccggagctcgcctgctgcgccgcccacccgcgccgtccgctgtccaggaaggagagaggggaaaggaaaggagagaggagtgaggctgacatggggcccgtgtgggccccaccattttaaattttttttttgtgtgcagcgaacatatggggccacgctttttattatttttcgtagatatatttgtcacgtaagctccacatcagtgccacatgtgatggagacctagtcaaacaagccacgtaggcaccatgtcagccaaaaccactatcaaaaccgcctatggacctcgtttgtctggttttcgtaagttgggggacgggtcatacccggttttgtggtcaatggtcgacaaatagagggacccaaagtgaacttattacaagaccttcgtctccacccacatctgagccgccccgattcagtccaaacccaaacctgctttggtccgtctcaccaccaaggcccaaataaaaatccaacagaaagcccattaaatattgcacaagtccattatggcccaattaaaacccaatagaaagcccacctccatctccacccacatctgagccgccccgattccaatccaaacccaacctgcttgctctcaccgccatggccgccaccggcgattccgccgccgccgccggcgaggtccggcgcctcctcgcccacctcgactcccaccagcagctcctcgcctcctgccacgacgcctggtcgcgcgcgctcgcccacttcgcctcgctcgacgaggacctcgccgcccgctccgcgtcgctcgacgacgccctagccgccgcgggcgcctccacctccgagtccctcgcggcgctcgaggcccgcgaggccgccgtcccggcgcgcctcgccgaggccgaggcggcgctgtccgcggccgtcgcggaggccgggtccgcggagcccccgcccgccgacgtccgcggcgcgctccggtggatgtgcggccgcatggacgcccccgcgctgtggcgcttcatggcggcgcggcggcgggagctcgccgccgtccggaaggaggtcggccccgccgtcgccgcgtcggtcgacccgccccgcctcgtgctcgacgccctcgccgacttcttggccgcggaggatggtgcaggtgaggaccagttctgggtgctcggcatactgctgcgctcgttgtttgattccgatggccggaagccgccggagataggagatacgctggttgagagggcggccggagttgccaagaattggtcagagaaatttgggatcaagatggaattgtatgcaccggataacaatgaggtggagatgacagaagcgcctttggtggagaacgcaacagcgacagagaagaaagaagagcatgtagatgaggaagaagaggaggaagaggaggacccagaggaaatggtgcccgcgtcggaggaagaggcagatgcagaggaggtagagaaggaagaagaggacccagaggaagtagagaaggaaggaggagaggcggaagccaaggtggccaatgcggcgaagacaggggaagtagagaagaggaaagtcgaggaagataagaaggcgtcgggaagagaggtgaaggagggagagaagggtggacaggcagaggtgcagatattcctgcagatggttgctgcatttggactaaaagataggtatgatgtagatttcttgaggcggctattagttgataatggacggaggagggaacttgccagaatcgcttgcgtccttggtttcgaggatagcctcagaggtaatggtgtgttgcttttatctgttgctttcgctttcattgaactgatttaagaacatatcctaggtttgttgaatcgagatcatagggcaggttatgaactatatcaataagaattaaaagtactactgcatatgaggattataataatcttgagtcaatacctagattgagaaatatttgggctgttacttcaaatcggcaacttaagcatcaatttctttctatttagatatttgttcttgtgatacttcagtggctacctctttagttaggagtcgaaaggtcttagcattggtgctctgtaatgaattgccatttcaagtattgtttctattggtcttcttatggcaggatataacgcaaataataaatattccctttcaggcagtatacgaaccgctgctcaatctattagttatgaaatatctttttgtgtgctagcaactgattcattaaaacaggctactttttcatctaaaattcatcttcattcactactatccttctccagcagaggaaactccccaaaagtatagggctccatagtctctgctaaaagagtatggacttgaaatttaggttactgaagagatcaactcatcatggctttgtttgatgtagagctacaatttgaatgatgaagtttcacaagcgatatctgctatcgctgttgataccgtgatcttatcttgaactaaaagccatcacaactgatttctgctatttttatcgatgggctgcatttgaatgcattttttattgatgctttgtttactgaccaatatctactttccagtgataaagtgatttctgcaattactttgaattatatcaatcttttgttgagttgattttgaacttcgcacaatttaattactaattttagtcatttcaattcatctatcacggttagcattattttaacctggagaaaataaaacatgacaaaactaatatggttttgtgtttcagatgttattgaggaattcataaagtcaggaaatgagatagaagctattcatatcgcccatgaggctggtttgcttgagcgatttccacctgtaccgcttcttaagtcttatataaagagaataactaacaagactcaggttgcactgagaggtggaagacattcaaattctgttgtggtaagactctccattccatttccatcccaatatatcttcttattactgttttgtgcatgattctgtttaggcagaggtatttttcgttactatgttagcacatgattctatttagtcagaggccttatgtattactgtttagcatatctttttgcatgactcatttaggcaggtcctttttttctctacttgaagcctccacctgcacgaggagttccttttttatggtctatatgtgatttaatattactactatcgttgtcaaaccacctatgattctgtcagtttgtgacttaatattagcaggtttagcatgctagcagtacctgcataccactttctgcgaaaccctgcccggtctaccttcagttcttaacagtttattcgaaatgtattttacctgagttcttaacaaataacagcccagtataaggctgttgagaattttggagagctgttggcctatatatctctagtccagcctgatctctagtgttggatttacttggcatttcttttcatggacttctaccgtattttgtctcttgcaccaaatcttttgttatttgttctgtcctacattagtatactctcatactaaagaagggctcatgttttctttctcaggaagaggcaaacaactcggagtgcaacgcctacaagtccatcatcaggtgtgtcgagacatgccagctaacatcagcatttaacctcgatggcataaggaagaaggtcgcaaggatggagaaagagaaggctgacaggaggaagccgagtggcatgaacagattccagaacaacaagcgagctcggggagcatccgggcctcagtccttccctccctccaagtactcaaggggctcgaactcgaactacgggtcatcttttcggaacccggcctcccactctttcccctacaccgatcgtgccggttttgtcggaccggcaccaggtgctcggccgcacttcgcaccgggaagctccatgggcacgcgccgtgctggggtgctgtacggtggacctggagcgacatttggagccggccatggctatggtgctggtgctgggcatcaatcttaccatcactaaagatggtttagactttggactggatgttgatgttactgaatgctcactgttttcctgggtaatacaatggtttatatatgaagtcatggactggtgaatttttaggacatatatcctgtgtgattattgtttggtctgaaatttgctttttactgatgggtggtattgaaggctgcgtagtacgtagtgcggtgatatgacgaggttgggcttgtctaatgatccgcacgatatattctggtatactctcctacctgctgtgttgcacgggggtccctatgagaaaaaaaaaagtaatcaccacggttattatctactatttgattcctcaacctactactcttactccagtgcggaatgtggtaaatcatattataggcattttcatatgaaatacctactccagtgcggaatgtggtaaatcttattataggtatttttgttctgattcatatatttcatatcttgtattaggttaacttatttaagatggttggggtttttttttatcttattacgattaaatatttaaaagtacaattggcatcacttcaattatgtcgctgatttcaaccctttcaattgtgtcaactcaatcgtatatataagtcatatcgtatgtccgttccatcgaaagattgcatcatttaatttttgtcactcatgcaactactcgatatttctaataaacattaaagcataaaaaatatcctataaattatacttcttattgtttgttattgaaagatctttttgtcgctcataaattaggtcccatataatttcttggaggggcaaaattctcaatatcgtggcaaaactgttatatacctcgtcaagctggaagggttgcagcattcgcttacttagcttctgcacttaaggttgtctttggaatcatatgtttgcaatatgcacagtgcgcatggaaaacggagcagtccattagtgcgtaattaattaagtattagctactttttttcaaaaatagatcaatatgattttttaaaacacagccttagctactagttaaatgtacagatgcttcggtttacgcatcaaataaactaaaactaacccaagaaatcaaaccaacggcctaaaaattaaccaagcacaggtctaggttattcattcttggctgtcaatcgcctcagtttgcagaaggttttaaaccaatatatacctaggttcacacaaacaaacataaaaaatgctggtaattaaatttggtatttcatagcatccaatacataaagacatgttactcattgtccagaattcataacatactggtgctcgcggagcaacacggaccggttggctccaacagttatttaagatttaaggagcagcttcgtcctatatatccacttatagatatacgagcaacaatttcaaaatggtactcaagctgactagctatagctacctgtaataacattcaaaaaataaaatacttgagctttccaacttgaatagagaagcgtgtgtaaatttattatcctaccaatgtaaatatatacttaaaatatcatatatgtaataatggaatatgagtattgacgtaaaaataaaacattttggcctaaaacctgcgataatttgaaacaaatcacaatatatggggttttatgtcacgtgtaccctaaaatttagggttttatgaaatttgtgtgtgtgtaaagagagagagtttctgcacaaaactttcacatgaaaagtataaaatttgtactcaaatttcagaagatattcaaaataactccaaaacaaattaataattaataaaaaagatagtgcacttagtcccgtacgctcaaggcctagctgaaaataatgcttaagtcaaatagcacgtggattcacaagtacatgggcagtgttcgtacggtgtgggtagttaactaaatcactgacttataaaaagggaaaggactagtgcctaaatgggtaagcgaaaccgttatgctaaaaaaggagcacccagtgttagcatacgagcaatttcatccactctacatgtcatctcgcttgtccatgccattaaaagattgcttcaatcttttttgtcgcttataaattagggcaaccgcaactccttgatatatccagtaaccaataaagcaacaaaactatcctataaatgtacctctcaatatcccacaaatcaataaaacgacaaaacaatcccataaatttacacctacatcttgtttgtttgcgccatcggaagattgcaccttttatcactcataatctaggtatcatgtcatttcatggaggggcaaattttttaatagcgcggcaaaacagttctctcttgtcaatcttgaagtggttgttgacttagtttcggtcgtaaaatatgggtattctcaccctttttcacccaaatcgaattctcctcctgtggctactccttagatctagagcaacaagcaactcaaca

SEQ ID NO: 25635 - DNA, 10628 bp, Oryza sativa
  unsure (1)..(10628): unsure at all n locations
tttgaagatctggaggcactatctgattggcaaccgctgtgaagtatatacggaccacaagagtctgaaatacatcttcacccaaccggatctaaatctccgacaacgaagatggctggaactaatcaaagattatgacatgagcattcactaccatccgggtaaagccaatgtggtggcagatgctttaagcaggaaaagctactgcaatgccctatgcaccgaggacatgtgtgaagaattgcagcaggagcttgaacgtctcaacgtgggaatcgttgaacacaggttcgtagccactctagaagcacggcctacgctcgtggatcaagtcagtagcagctcaagtgacggatcttgagatagctgaactgaaaaagaatatgagggtcggaaaagcccgggacttccttgaggatgaacatggcacagtctggatgggagaaagattgcacatgcctgatgacaaagagctgaaggatctgatactcaccgaggctgatcagactcaatactccattcatccgggtagtaccaagatgtatcaagatctcaaatgaaaattttggtgggccagcatgaggagggaaatagctgaattcgtcacgctctgcgaggtttgtcagcgagttaaaacagaacatcagagcccgcaggactattacaacctcttcagatcccggaatggaaatgggaagaaattggaatggatttcataacaggtctgcccaggacatgatctggccacgattcgatataggtagttgtggatcggcttaccaaagtcgctcatttcatcccagtgcacactacttatacgggcaaaaggttggcagagctctacctcttgcgaatcatgtgtctacatggagtacccaaaaagatagtatctgatcgagggagccaattcacttcaaagttctggcagaaattgcaagaggaattgggaacccggttgaatttcagcacagcctaccatccgcagaccgatggtcagaccgagcgagtcaatcaaatattggaggacatgttaagggcttgtgcacttgattttggtggagcttgggacaaaagcttgccgtatgcggagttctcttacaacaacagctaccaggctagtcttcaaatggcaccgttcgaagcgttgtacggccggaagtgccgcacacctctcttctgatatcaaacaggcgaacgtcaactgttcggaacataagtgctaacggaagcggaagagaaagtcaggaccgtcagagagaggctaagaattgcccagtctcgacagaagagctacgcggacaaccgccgaagggagctcacttttgaagccggggattacgtgtaccttcgtgttactccgctccggggagtacaccgttttcaaaccaaaggcaagttggcaccacgcttcgtgggaccatacaaaatcttggaacgaagaggagaagttgcttatcagctagaacttccattcaatatgatcggtatccatgacgtgttccacgtgtcccaattaaagaagtgcttgagggtacccgaagaacaagccgattcagagcacatcgatatccaggaagatctgacctacgtggagaagccagttcgcatccttgagaccagcgaaaggaggactagaaacaaggtcaccaggttttgccgggtttagtggagccaccattcagaggaggaagcaacctgggaaagagaagatgagttgaaggccgcccatccgcacctcttcgccagctcctccgaatctcggggccgagattccgtttaagggggtaggtttgtcacaccctgaagttctcctcccaagcctaaattgaatttataaatggtcccaagaaaatatcggtgtaaaagcaagagtaaaccctaataaaccaatgcaaataataatcggaattggcatgtggaatttttcttgagttctacatgtcgaaatttgctaacaagatttttagtggaattttgagagccctagaaataattttaaccaattaaaattgagcacatgcaattttaaatcccaggataaatcctttcttccttttctttttcttttccctcctttttcctcttcttgggccgtcggcctagtccgcccgccgctgcgcgcgctcttttcctccttgtgggccggcccaagccgcccctctctctctccgggacgccgacaggtgggtcccacctgtcgaggtcgtccccttcctccggccgcccgccccaggtcggcaaccgccgccgaaaccgccgcacccacctcctccgctcctgccgcgcccacgccgcgccgtccccgcgtcctccccacgtcgccgccgtctcccccgcgtctcccggcccgcgcgcgcgctcgcaaggggcgggattcgcattttgaatccccccattatctctctctccaccccacgtcgcaggtcaaaaaggaggctttcccggccgtttccacccatcccgcacctataaatcgctgccccgagcctcctctttccctttccgctctcgccgctccctcccgtgcttcctaccgagctcgcgccgctcgccgccagcgccaccgcttgccaccgcactacggccacgtgctgcccccgctagagccgccgccgcgctaagccgccgtcaccactagcttcgccgccgcaagatctttcccagccgccgccttgcgttgccgaaatcccaccaagaccacatttccctcgcgtcgccggtgagtcccctctcccctccgactccggccgacatggatggccaccgtggggttttttcctctgcgctaattcctgtcctcccctcccctaggtgtcgccgtcactcgtccgcacctcggcatcgccggacttcgccgcctccctcgttttctgccgccggtcgccgccgtcccctccggtgaggaatccctcccccttcctttccttccccttcccgcgtgcgccattgcttttggccgcgccgctgctccggctgtgcgccgccgccttcgcgccgtccgccgccgccggtcgccgccggtggtcatgcacgccgccgcctctagccatggccggccggccggctttgaagccgagccaagcccggcggctgctccctgcgccgtccgatcggcccgaggccgatccggaccgtcggtcccgtggaccggcggtggaccacccgcgtggccccagtccacggtggaccggccgctttgtgccgctgacccgtggggcccacgtgccggcgccccctccctctccccttgcgccgctgacatgcgggccccgcatgtcggcgccacccgctccctttgatgacgtcagccctgggcatttattgcgcaataattcaattaaggatttttctgtttatagtaaaaacacagtgaatcttctaaaattcataactaattcatccgagctccgtttaaacccattcaagtcttagtaaatcaagaaaaatatgtagaatccattaaaattggttttgttctctgtttcagtagtattatagcgtgtttgtattgtttgctatgtatgtcacttagattccggctcttccgacgctccggtgtacttcgagatagtcgtcgaggttcctccagcagtagagcaaggcaagtcatgccggtcacttgaacatgttgatcctatattgcaaatgttctaatgttttccttcaaatactgcattgttttacaataatactatgtgatgtttacctactgttacagccatgctattttggtaccatgctcctttgttagcttgggttataacatgactagatattggactagggattgcttagccatgctttgttcaactagcacacaaaggggaaaatcctattaatgtatagactgtagattctaatggtaatgttggattagtgccaccgcttcggtattggttaattaaaataaatcacatggtgggctgtgggtgcatggttttgttggtcgcacccatagcagttaaggaccggttcgcgggatgccctgtaagaacttatcatacttaccacaagccagtgtgggcaacggctgggcttgtagtgtagctttcctctacctgacgcatccaggcaagggtgggcgtgatggagtttggatgggtcctgcgatggcctatgcggcttccggattcatctaggcacgagaggggactgcccacggccttgcgaggagtgggggtgaaacctgaggtgtggtgtgcttggttagagggggttatgcgaagggtcctgtcacggcctctttctagtatgtcgtggtggcatgccggcgcacgaaaacgtgtcgtggggttgtgtcttgtgggtacagttgtacacctctgatcagagtaaaactattcaaatggccgtgcccgtggttatgggcgatcaaccagattcaccgtgattagtctcaccctagtttagtctaatgaaattggatagtataggtggatggttgggcctgttgcaatgtggtatagcgttggacagtggatgattaatattgattaattgttacaactgctttactgctttcaacttctgtttataaatgctcgttttatgcaaatgaaccattatagctatcccttgataattccctgcatcatacccctattccggtatgacttgctgagtacagttggtaatactcagtcttgctctattttccccaaaccccagagtttgagtatgcgtcagatggtggtttctccgaggagtaggcttcgtccgtgccatcgaggatgcctgtggagtggtgttcccgctgtagttcaagtcaaggcttagctccagttatcttttgtttttccgctgcatttatgtaaaacttttataatgtttgtaagacgtggatctgtatgtcaactttgtcgtttgtgtaccccggccggtcctggacggggattttaatgcacattctgcttggaattctattcgaaaatttctgggcgtgacaccgtatctagcgtgccagacccaggcttgatccttcccctttgcgagaagggaaaccggttgcgccagctcgacgtggagaacgtagaggcgcccaactccttggcgcaccctacacagcagctgtcgctgtggatcatgcaaagtgagaacaccatcctcgatcaccgtcttgcaatgcgcctcatcaagctagccaaggctgaccatgttgctccgaagcttggggatgtagtagacgctagtgagcgcgcagtggtcaccattcttgcaagcgaacagcaccatgcctcgtccttcaatccagactctcgacgcatcaccaaacttgacagtgccgcgcacggtggtgtgaagctcggagaacacatcacggtagcccgtcatgtgatttgaagcgcccgtgtcaaggatccagtctagatcaacgggctttccttcatcctgaagagaaacgtgagcacgttcctccttcagtgtcacctccccgtcagtaatgacaggatcggtagcaggggcaagctcgcacacttgcgccatcagcagtgtcggctccccttcgtccgcggcttgagcaggctcggtgatgagaaggtttgcctgagccagtttctcgcgggtcntgcgcttgcgcctgtgcaaccaggtgcctgtgggcccaggtgaccaagtttgccacagtaccggcatttgtccttggacacattgcggtttgccgcttgggacgaacctgacttgccgtcggagccgttgccgtcgcgctcgcgcctgctgcggtgtggttgccgtgagctggacgccctccccccggctgagttctgcccagcttccttgtttgagtgagcaggggcctccttttcgctgaagagcacctgacccgcgtcctcgccatcagagtcggggtgatcgtcgacggtgagaagccggccagtcagatcctcaatagaaagcaaggtcagtgtttgatgaaaacaaaacaacgaacacacagaaaatagggaaaccctgtattgcctttttattaatcatgattcattaacatgaatgtttacaaatacatgagggctcctgtaggagttcgccttttgccttcgtgaggaatgcttaatggagaggtatcttgacaggagattccgtgcagtccgctgattcccggcgctagcaatgaggcggccggttaattacatctataggagcgagcctatggaacacctccgattaagctgcgctttgtgatcgtcaacatcaaaatttggttgctcgccgaaggttgaggttggttcagatttaacggtgaatatagtgaatgtggaactgatggctttgttttgccaaaacccagtcacaatacactatcatcatgttagtatacggagggaatttggtgaagcgggtgacctttgcctcatcggtgcccactcatgtgccccggccttcatcaaacatggattttgtgattgcttttgcctcgtcggtgcccagcaacggtatatccagttcccgtccattttagacgtgttaatagtatagtgacctggccttgtcgacactcggccatggtttcatctaacctcgtcggtcatagacaaatggaatgagttaatgactgcagccttgtcagctttagccaatatgttatccggactcgtcggtctcggacatagcacaaatattgataaattggccatttcatctcgtcgacactcggccatgatgtcgacgtgtgttgtaaatctgcatgccttgccctcctggcgagcattgtttttgttgtcttcaagaattttgagagttgctcccatccatctggtagaatttagagagagaaggaattgctcccgcacatgacatgcacaaggcaaatctataattgttccggtatgaatataaatatgtataaatcatggttggtccgatgccgattagactcaaactcatcccaagtttatacaagtaaatatgcacatccgatattttatcatgagcgagaacatcaatatgcataaattatggttggtccgatgccaataaggctcaaactcatcccaagtttataaatatgcgcatccgattttttatcatgaacgagaatataaatatgtgtaaatcatggttggtctgatgccaataaggctcaaactcatcctaagtttatacaaataaatatccaactccaatatttgataacttagacggtccaaccccacgaggatcggactcgtctgcacaccactgatgatattttcttgacgaaaaacaagatcgatctgcttgttattcaggacggacgactcgccggcagagatgccatcagcgccggcggctctctaaggcatattgctgctgagccgcgcagcggtccgccgtctatgtgtgcttctcggtgacgacgtgtaaattgtgtatatgttggatatgggtttgtgaaactataagcagatcagagcacacagcatagttgcctacctacgtcttctcctctgccagccgcctctgcgccggggattttctcccacctcctgcgtcgtgagggacagcgccttatataagagtagaggcgacggagtcctcgcctaatcccttccgagatttcagcaagccagcgaaatcaagcgttaattctctggataagccagcgcgtctgttaatccaacgacctgcgcgtgataaaaagaattttgtgctccagataaaaagaacgtgtgtgtgctggagataatcacgaggattaacttggctaattgacggtggatcccacacctcatagggtgtgtttggataatgggaaatgaggggtgggattgggattaggaaatgaatgaagggttaggattaaatggatgagggagaataaatggttaggatttaaagatgagtgggaaatcatttcctttagacatttgccaaacactgccataaggataattaccaaccggtgaggagcagcaaacaaattaaggatatacgaggttaacactggttgatctccttcaaatgtttatatctccctaatcatatatcaaatatgaattctgttggaaccattattttccaatcaaaacatacaacaaaacgagtccaattttgaatatgtttgaacattgtatgatatttgaattttctggtcccacatgtcgtagagacatgtttcacgtgtatttcgtaaaattgggctgcaaattaatgcccaatgatatattattttttctatgaattttggtataaaaattcatcaaacagtgagatcaatcaaggtttcaatcgatagagccatttggcgatacctccggggaacgacgcgaagcaattttcaaacaaccttctcttcagacagatcatctccaaggactggagacgaaggctgaaatcctccaggtgttcgccattcttgaatcgcatggactcaaaagtttggcgcagcttctgtgctcgggactccttaacacgatctgcgcctactcgcatggatttgagcgcatcccaggcgtctttggcgctgtccttctcggcaagcggccggaccatctcagccggcaccgctcgcaagatggctgaaagcgcctggcaatcttcctgatacgggacatcgccggtgtcgacagcatcccacagaccttgagcctggagattgactcgcatcaacaccgcccaatcggagtaatttgagcgtctgagtattggatagtagacggagccatcttccttaacaatccgctgcacgacgagctgtcgcccgctcacgcgcggcggagacggcgagagccggcggcctgttcgccggtgagtgcgagacgaaccgctggcgggagcggacatggctctgataccaaatgatagcaaagcccaagattgtgaatcctcactctctctctcacgcgaattctctgaattggaaagacgatgaacacgaacagagtttttggtgtcgcgaaccaaccagcgacgttttctgatgctcatatatatagcaaatatgtacagactcaaactgacaccactacgccatcatccacgacgatgcgaccacgacactgaaatccggatgactcgcacacgacgcacgacccggaagactcggcttacaggaaaaagaaacagagaaacagacgccgaaacagagtctgacgaaactgaagaaacgacaacactagacacgttacagtaaccgataatacgacacatgattatagctgaagctaacagaaattccctaatcctttcctctccatcatcaatttcacttgttgaatgccgaaaattgaatctcttttgatgagttggatcttgtctcccggctgttcatcttttctttcttccttctcgatcggtcatcttcttcctctggccagcaggaggccgaagtcccatcagcaggaggccgaagccccatatctcatttcctcgcatgcagttcgaaccagcccgcctgcgcgcttcagctagccccggccgtgccatcacatcaccagccaaatccccggcgaaacccctccatcaattttctccaccaaagccaaaaaatgagtaaccatcatcagtcagtcacctcaatttccatcgtctcagctaaaaaaatgaataaacatcttccggctggccgctcaactccctgtcctcctctataagtagatccagcaccccctccttttccctttgcagaccaccgttcctgccacaccgtgccgtcgccgccgccggtcaacaccaaggccaaggccacctcccatgcatcttcctcacctccggcgacacgcctgcatccctccaccggccgttcgctgcgaacttgcactgccgcctctctctccatcgtcgtccaccggaccatgtcttgctgctattgctgctcactataatccggcctaggttcctgcctcgggacatcgagtagacgcggttgtgttgcagtccgatcgagtgagcaccaatgttgccgctgtcatcgcaagcacgagctgctccatgggaagatcgagccggcatgatggtcgtctcatttccagcactgctaccatcgttgggagatctctcaattaccagcgaatggcgcagcactgttatgccatccacctctgtcgtcttccccacttcctgcgccgtcttccatcaagccatccaccatcgccatcaacttgttgtcaaccacccggcattgctgccacctctctatcgtggtaagcacctgcgccgctttcacgttcttcctccctaatcatcatctagtgtgagaaaaccattttggttatattcgcagatcacaaacaatatcatcgttgcccagtttccaacatagctgccacctcaatgtcctcatcagtggttaatccccggtcctctcccatgtgttgtcgttgtcgccttcgtgcagaggtgctgctgccatcgtggaatggtgccaccctctcgccctcatgatagctgcctaaactaggattcagaactggagacacacaagatatatcgacggggatttccaacgaattccgccgccgccaatcgccactaccaagttctaaatcgataaaaaggtttacaggagttgtgtgtttagttttatcactcccactcactccccacacacgcttacagtctggcacttgggccgaataaccactcaggcttacaatgcccattctggtccacttaaacgaacattcccccttttaagtctactactctccctt

SEQ ID NO: 25636 - DNA, 1345 bp, Oryza sativa
tttcataaggaccaaagaacttgaaactcagcttgtgattagccctggctgctactgaagtttggacatatggctgtaacttcaaatagacccaatctcccactgcaaaagctctaaaacttcttttcttgtcagcttggctcttcataaactgttgtgctctgttcaaatgttgctgcaagagttgtatcattaaccctcattcattcaacaactgctggacatttggaagttcacaagagttaacagtaatgcccaattggttaggaatatgcccatacaatacttcgaaaggggttttattcagtgtggagtgatagctagtattgtaccaatactcagcccaaatatagccaggtggaccatttagttggacaggaatgagtaaaacaacgcaaataagtctccaagcactgattcacacgttcagtctgtccatccgtctgagggtggtatgcagtactcatatgaagtttagtgcccacactgttaaacagctgcttccaaaagtggctagtaaagatgcgatctctatcagaaactatggccaggggtaaaccatgcagtctaaaaactccttccatgtacaactgagcaacgtctgcggcagataatggatgagctagccgtaaaaaatgggcatacctagatagcttatcaaccaccaccataatacagttgaatcgcctggaggttggaagcccttcgataaaatccatcgtgacaatttgccaagctcccaatggaaccggcaagggttgcaataacccggggtacttagaacgatccggcttcgcttgctgacaaatagagcactccttcaccttgagcttgatctgtttcttcataccaggccaagcaaaaagggccttgatccttcgataagtcacaggaaatccggaatgcccaccgatgctactgtcatgcaaggcactaaaaattttctattgcaactcaatattctgtcccaaccagattcgtcctctgtatcgaataagaccatccttaagttggtatggagagtcagccttagagtgaatggctaattcagacagtaactaagtagccttggcatccttcaaatacccattaacaacctcttccagccaagtgggcttacaaaccgaaatagcaaccacctccaaagaagagttatggtcacatctggaccgggcatcagctgcttcattgtggattcctttcttgtaacaaattttgaactgcagccctagcaactttgtataggccttttgttgccaaggagtatgcaagcgctgatcagtaagattcatcaagctcttgtggtcagtgagtatagtgaactctgcatactgaaggtaggacc

SEQ ID NO: 25637 - DNA, 1040 bp, Oryza sativa
tttaccccctttccatttcgaatacccaatcttaaaatcctgggcctgcccctgaagggaacaatcacgattccatggaacactaaggtagcttgttaacttccccaggaatctagaggatcacttaataaatttctagttggattatataagttgttcagtacatcaaacttatatgcatatagaattgtatatgtgtgatgaagcttattggcaaaatttgctatgagacatccaaaaaatatataattagctgaggtacaccgcaagaacgcgtacatgctgtgggacaccgaaaaaactggtaattagcctgctggacacccatgacattattttataatatctaagaaaaatgagagagaaacagttacaaaagtatgattttatccttgcctgccaagccctactcgcatatagcaactgcacccccagtcgccgtcgccggctaggcgactctctggtgtttcaggtgtgggggaggggggggagggagtatgcacacctaggcacggactacgcatcattcccacactcgtcgctacttcagcgcgagggccacgttggcgctcatgctctgccacacaccacacttgcaggcgagcgcaacgtggaccacctcctggttcatgtcttggccaccacgacgtcagtgctatatgcgagacacacatggcaaataagggcaaaatcatactttcatgactatttctctcttcatttgctctagttataataaaataatattgcatggtgctcagtagctaactaccagttttttacgatgtcccacaacagatatgtgttcttgcaatgtcttcaagctgattacacgttttttaatgtcctataataaatgttgccaaacttatttgcatatagaattctcatggaaacatattcgttctcttcgctcccattacaatagaaggagatcgttaaaagtgcatatatgtgtagttagagttagagtcaaacacgaaccatggatacaaggtataatcatagagataaatctattctagcatatattttacacc

SEQ ID NO: 25638 - DNA, 244 bp, Oryza sativa
gtgtgtggcaggctggagggaggtacactttacctatctctgcatctcgtttgggctggagttcgctgcgaatattcatgtcctgtagatcaaggcgcgcgttcaacccgtcctttgtcttcccgggaatattcaacatcaggccaaccaaactctcacacacattcttttctacatgcatgagatcaatgcaatgacggacatcaagatctttccagtaaggtagccgccaaaatatggattt

SEQ ID NO: 25639 - DNA, 423 bp, Oryza sativa
aaaaattaaatatttcatataggttaaagaacaccatatattttttaattgttgatagactacgtgcaaataactatagaaaaaatatggttatttaagatttattattgtttaaaaatttgtataactaaagaaaaaagaagaagagattggataggaggggagggaagacgtacctacggacgtacgaacttgagttgtacgtccagttgaaggatgggcccatggggagaggagagggtaggggagtttgtggggttatttttttaataaaattctaatagacaaaaatattggacctaccggtttgttaagatgccatatagcggtttaggagtatttgtaggagtacacatggtggcttaggagcgtttgtaggaagtttcttggacttttagtatataatagatagatagataatag

SEQ ID NO: 25640 - DNA, 982 bp, Oryza sativa
ttaccatcgatcaggcgtgttcctaccttgacgaagtggcttttgtggggcccacatcttggccgcatttacgatagcgctgcctgtagattccatcaacagggcaatttggctggactgatgaaaatacattaaccatggatggtgacgtgtccccgagtcccggcgtccgggtgcatgaattatgagtagatgattgctccagtccggcggattgtaccggtaggtaatagtatcggaaggtacaaaatcaaatctagtcgtctaaattgggaaccggaaaagagaatagggaagggtattgaacatttgaagtcactcaaattatagtaatcagtaaatgacagaggagagctgctggatgggagtaaatctcttatgattaacaaggaagggagcccgcccatttacgtgggcatgtatcgtagattgtatttcaaaacactataaggatggaatataaatcagaaaacattttcaaaatataaactgaaaataaagcccgcagagatacactgacatcttatttgttgttcaagaaaaagaatggtaaaataaatcatacatcactatatatatatatatatatatatatatatatatatatactgtaagggaatgtaaattttcttacaataaaaaagaaatatatttaccgtaaaatagatggtatattttaatatactactaaatatgataagaataagaatacatctcatatttaaataaaaatcattttgtcgtggtcatatataaactcctctattgttattgttttaaaagctatgtgcatttttaataaatgaaactgtattagtaccactaaaataaattatatattattaatacactaaaaaataatctacactacttaactcgatgttcatcacttatttccacatcatcgactgtatcaccaaagctttcttatataatgccctgaaacattggttccacatcgacgaaccgtgaccctaaagac

SEQ ID NO: 25641 - DNA, 373 bp, Oryza sativa
cataatcaggaagatgaaaatgagcatgacatgtttataccttctccattgggcggtgaaatggttgatgtggatcacgatctgctgcaagacatgttacgtgatgttgaggacctagcccagaatgagagagatggaatgaaattcagcaggttggtaagtgattccgagacgcctttgtacgctggatgcaaagcaaaacacactaagttgtcagttaccttgaacctaatgaaggtaaaggcaagtagtggatggacagacaagagtttcacagatcttttaggaattttgaaggctatgcatcctgttgagaacacattgcccgagacgacatacgaagcaaagcaggttctgtgtccactggggttag

SEQ ID NO: 25642 - DNA, 729 bp, Oryza sativa
tttgtgttccatatctagcgcggcattgcattcttcaagttgcaccaagagctcaatcttgcgagcttcaagctgatcaatattggatttgatcggaccttcagatagctgatcaagtttggttttttcctcatgcacaagctgccgattagcttggattgtgacctcaatctctttgcgctcacggcgttcggctagtcttagcttggctttttccagcttgaactgatgttgctcgagataagcggctggagttaggacatcggccaaatcttcgggaatcagagcctgaatttcatgcagccgtgacctaattgatccacagtcaactaccaagctatctaaagaagaggcttctagccgatgagagatgtcttcaagtgtttttcttacatcatcggatatgggagctagggctttgcttgaagtgtcttcgtctgcctcatcaaggtaatctctgatatcaaaagagaagatatccgctacaacctgcagagacaatttcggaaaaagtaagagttgggtaaattatagccgatctaattgttgagacaaaggaaaacttactgggatagcaggagcagctggttgttcttcctccttgatgtgatgactccccacagccgatggagtctggtcacttgacgattgctatacaggaggagaagcaagaggaggctgtagaatagacaagtgttatatagagccggttgagtttgattaagtaaa

SEQ ID NO: 25643 - DNA, 1770 bp, Oryza sativa
atctgctgctaagaaaggggatcaagccgacgggaacttacctcagcatactcggctgaaggcgcatcagatgggttggtgcaggacgacatcgctgcaggcggaaatctcgccgaagatgaagtcacctggaagtcgcttttgcgtcggaggaatcgctggagagagagaagacaaagtttcgcttgagcggtgaaaacggaagtcacggtgtgagatttctcgagggtgacgtttaatatttaaagcatggcagtaacggtcggaaaacggcaaagtgcgaacttactcggggtcgatttacagcaaatccgaaacattaccaaatattccggacttggggggcatgtgttaacaaccaaatttggtaatatcggcatcgggaaagaatattagatcgaagcaaagtcggaggcggagattgagttcagaaacagagcaggaatcggctggagtccagatcggctacgattaggatcggctgggtctgagtcggactaggtaagctgatacaaccgattccgataatgcaacttgatgtatgatattgggttgaattaaggcgcttcaagatgattgccgcacatggatagagtcttgagaagtcaattgtatctattaattaggatattttatgtaatttccttagagatatgcttgggcaaaagtctgccgtaaagacttatggtatcttagagtttgttaaagatattagtcgtgtccgttatgggcatatcttgtaattctcgggtataaatagacccgagccctatgtaacttttaacacacacgttcaatacaatttcggcgcatcgccaccctttttgctttagttttatttcgacgagttcttgctttcgggttgagctgcatcggtttcgatcttcaacaaaaggtaaaacttgttatgacgacttgtgttctcgggattagtgcttccatctttgtgatactctgatctcgtttatgtaattcgtcgaactatcatatatcttacataatctctggcaataccactatctaatctacaatcggctaacatctgtcggtagaggacagccgattaggttagatttcgatgttgacgtagattatataagatatctaccactctatgaaacttccagcagcttgattgtctagatattgttcttcttttcatacttaatgctgtatcagttgagtttgatctattaagtcgtgcttaaaaaatcaacctctagcctgccttctagttgctgattagggtagcatcagagtttcagccgatcttatctgatttaactatatttactctatatgctttattgacatgttaaatctgccctttattttaagatcttattgcatttaagtatattaggcctttatttgatatattctacttgctttaatatcttagtatagagtggtatcggagtattagccgatacatgctagatctatatgatcggctatgctatgaacatatgtagtcccattattaatatatatttcgatttaagtgatttatactgtctcggcatggcgtccgatctatcccaatcacttgatttaagtatatatcgatacaaggagtatatattgcgaatacttacagccgatcgagtagatttagttccttcttatttattcatgactgccgatcgatacatatataacatcggctcaaagataaatgatatgtcatctgcacctagccgatcgactatcatttatagatttaaccgcggtttctttgcttctattttttgttgattacaggatcaa

SEQ ID NO: 25644 - DNA, 1403 bp, Oryza sativa
tgtggccgtttgacaggtacatgggagttctaaagtcgtacattcgtagcagagctaaacccgaggggagcatcattaaaggttacacgaccgaggaggctattgagttctgtgtcaattacatgtccgatgccgatcctatcggagttccagcgtctcgtcacgagggaaggttgtcaggtgttggcacaattggaaggaaaagaattaggcccgatcaagcgtcgtacgtgcaggctcattatgctgtgctccaacatatggcagaagttgtcccatactttgaggagcacttagcgaaaatccgagatgagaacttggggcgatctgatgcatggattaacagagaacataattctcggttcaacgaatggttcaagaatcgtgtgacaatgtccacggatgtcccaaatgagacagtacaattgttggggatgggaccgtcttggaccatagacacatggcaaggatacgatataaatggatacacattttacaccgtcaaacaagatgacaaaagcacagtgcaaaacagcggcgtccgtatagatgcattccaggatcaagttgggtcaaacacatactacggccgcattgaggagatctgggagctaaactacgtcaagttcaaggttcctttgttccactgccgttgggtgaatctacgcactagtgtcaaagccgacaaggaaggtttcactttagtagatctatctaaggtgggatacgccgatgaaccatttgtacttgcgaaacaggtcgagcagatattctacacaaaagacccttcaaacaagaagatgcacatcgtgagggatggaaagcgccaaattgtaggagttgacaacgtcgtcgatgaagaagaatacaaccataatcttcatgtaagacctcacattgaccttgacgatgatccccaagagtctgtggcatatgctcgttcagatcataccgaaggcataaccttatgactgatgcatttatacttatctattgtaatgaatggagtattttgttttattgcaaagacttgatatatgtagtcattaatatggctaattttgttttattacaaatgaccaaaataaaagttgtagatcttgatgagatgatcaactttgttgttgaccatatttcaatttgaaatcatttagtatttacaaatgctgttaattagatttgtcatattgtcgaaatcaatttcaagctattgggaaaaaaattatatagaataatgaccaaaataaaaatagtagatcttgaaaggctctacaactttgttgttgaccatatttccatttgaaatcttttactatccgaaaatgtattatgactaataaaatgaattattacacagctgctatatattttgcacccacaacaaatgaaagatggaaaatgag

SEQ ID NO: 25645 - DNA, 4415 bp, Oryza sativa
caaaataaaagttgtagttcttgatgagaggatcaactttgttgttgaccatatttccatttcaaatcatttagtatttacaaatgctgtttagatttgtcatattatcaaaatcaatttcaagctgttggaaacaaagttatatagacaaatgaccaaaataaaagttgtagatcttgataacctctacaattttgttgttgaccatatttcgatttgaaataatttactatccgaaaatatgttatgactaataaaatgaattattatacaacagctatatattttgtactcacaaatataaagacttatctgggaaatggaaaaatagtcatcagtgacgggccttagttcaagcccgatagagattaatctatctctatcgggcattatcttagggcccgtcacagatgagtcatccgtgacgggcctgactgtcatctcaatcgggcattagtatggagcccgtcaccgatgagtcatctgtgacaggccctacggcaaagcccgattgagatgactcatcactctaatataactagggtttctcagatcggatcgaaaatttttctaagtcccgctacagtttcccgcctccttagaaccctagcgccgccgtcatcctccctcgccaagcccgccgccgtcgccaccgagcccgccgccgtcgccaccgagcccgccgccaccgcagtcgtcctccctcgccaagcctgccgtcgtcaccaccgagcctcctcggccctccattcagacctccgccgccgagcctcctcaccgacgaccctccccccgagcaggaagccgccgccgccaccgagcctttacaccgatcggaccagtgttggccttcctcgtcgtcgccgcccgcgtcctcaccgacccacgtcgccgacccccatagagcacgacgccgcccgcccggtgccgacctgcccgatcggcgtctccaccgaccggcgccgccctccaccgagcccgggcgccgccgagccccaccggccatcctcaggtgagtcctccatcgcgtcgccctctactaactgtgaatgacatgtcattgaaatgtggatgtggatgatatgtgattgaactgtgagtgagacatgtcgatgttgggatgaaatgtggtgcatttatgaattttgtgatagatgattgtagtaattgatgaaatgtggttcatttaactttatttatatgcaatgtggttcatgttgggatgaaatgtggtttattcatgttgggatgaaatgtggtttattcatgttgggatgaaatgtggtttatttaagttgggatgaaatgtggtttatttatgttgggatgaaatgagatttatttatgttgggatgaaatgagatttatttatgttgggatgaaatgtggtttattcatgttgggatgaaatgtagtttatttatgttgggatgaaatgtggtttatttatgttgggatgaaatgtggtgcattaatgaaattattgtgaaatgtggttaatagattgtaataaattgtagcactaaattatgtttttttttgtttttttggaaaaaagtagataatgtctcagcaaggcgaaccaatgtcgacgacaactagtgggtcctcaagggcacgtactcctaggacagggaacaaaattcctaaggaacggttccgcataacagcggtggacgccgtagggttgccgacatctccaaggaaaatattgagccgatttaggtctatctgcggggtcatagggaggcagaaattcagtattctgtaagacgacttcaagctcatgccggccgcagagaaggacattgcttggctaatgttcaaggagagctttgattatcctgcggagcatgaggaccgtctcaggcgggctgctttcaaggttatgggcactgcttggaagaacttcaaaactaagctagtcggcgagttcgtctacaacccggcaaatccagatccaagagagaaatttccttggatcacagaacaggtctgggaggaattccatgcgaagaagtcgacccccgagtccagagctagaagcgaggcatatcgcttgctccagaccaggaaccagcatccgcaccggcttggtaccactggatatgccggtaaggaagaggaatggcagcgtgaggatgaagaagcggaggaatcgtgcacaccgctcgtgtttggcgatatcccacaccctcgggctaggaactgggccagggctaggtaccagaaacatgatgatggcacaatcttcatgccaaatgcagaagatcaacgagtatacgaagctatagtaagtgtctagtcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaagcgttgggcaacaaggaacaccgtggacggacacggggcattgggtcttctgttccttggaagtatggatttccagactacgcgtggcagtacaagaagcggacttccaacaaggcggagaaagatgcacaccttgaagccaagatccaggagtcgatacgagctgagctgacatctgaattcgacgaaaagctcgagtcgatgagggccaagattaggcaagagatccgagaagagcaatagatcccccaggccgtcgttgctgctgcgcacaaagagttaggaagtcccaccgaaaaacgcagcagttgcgcatcaactgagttggcggaaaatccaacatcggtcgacagcgccgtcgaccacataacggtaaccgtgaacttactcaatacatgaaagacgtaacaaatccatatgatatataatattctaaaaaaattgattaatctatcacaggaaccaacgagctgcaccctcacagttagggtgatgccgaccttcactgttccagcagccgagggacttgcgtacaagccgaccccagagacaagagtgcatggagcgcaactcagggccgactgtgcaaaagttcaagtcgactcggcgaagcccgaatacgagctgttccctctgaagtatctaccaaacgacgaggtcctctcactaggaaatgcccgtggtaccttcatccaatggcccaaggacctcattgagatcaggttacagcgaggccaaccactgcaccaggcggtcgtccaccaaagagacccgcttctactccttcagcccctcctgctcaagatcgtcatgcacaatcttacaatgtgtagttgcagtacgatacggattttggggaggaccgaacggaggccgacagcaaggcgattaatgaacccccaccgatgaagaagagcaggaaggcacactcttccccttagagaattactctcgataaacccgaagcaaaggggtgaggaaggggaggaaaggtgcaggcctcgcttctagctccaagaaagctagatctgggcaagagccaggaagagactaagggcaaagaggtcaagaagaaatacgtcgctccacaggagttccaactaggcatgccattggttggagatgacgtgcttcccgcaatgggcaccgcttgcaaggaccttcacttatactacatggagaaatctaacgccaggaagccaaataaagctaccgatatccttggacagcacgatggaaagccattccttggtccaacaaattatatcgtggtcgacttcaaggatcttttcgacctctacaggctccgagcggtggacacaagcctccttaagtgctactccttgtaagtattgtcgcccaactcattctggtaataacaatcggtttaacttgcttacaagatcgttgatcctgtgtgtaggttaagttggcaatggtgtcagaagcatgcaccagaagttgccttccttgatccacaagtggtcactgtcacaaatctccataatgaccgtcaatgaatggtcaactacatctacgacaccttgtggtcccgccgagacaaggagtacattatgtgtgcctataatcaatagtaagtgtgttaactaaatatacacaacagcatgacacattccttgagtacttaattaactttcactatattaatgccgcagtgcccattggatccttctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttcccggtgaagcaacaaataggtaaccagtgcggattccatgtgtgccacaacatgcgacttctgtatagagaaaaggtgaagactttggctgagtttgaggtcg

SEQ ID NO: 25646 - DNA, 28318 bp, Oryza sativa
caagaaaatcaaaatgctaatcactgtctaagcttaaccacaagacaagatcagtagcaatggagatcgatgtaatttacttctctccaatcaacagttcatccgaacttggtaacggcgcccttgacggaatcgatgggcgcagtacggtgtcgatgttcttttgatttcttgttaaatatgtgatccgaattttgggcccacaatatattcggattagtttcctagtagcactttatgtctatcctattaggtgtctttcttttatcccctatatatactcttgtaagccgtacaggaaggggtgacgttcccattgttattcccctacgtttgtaatcaactcctctataatgatgattgccagtcggcgcccgtggttttttcccgtaagggttttccacgtaaaatttgtgtctccgttgtgcatcgatttttataacatctctgaacgaagcgattgtcgatctccgacgccgtcgccgggggccgaccgcctataggcggccacacgcggccatggccgaagcaccacgttcaggtactccaagaactcaccctccatctcatcaaacgaattcgccacggcgccccaagcttaggaattgagcaggaagctttcccgcatgagctcctactgtggatcgcatgagtccgtggtgccgccgccgcgttattccggagggaaatactatgtaaccgcgtccgtgtcgccaccggccgccggacctcctcccacctcgctccagtgaccttctccccacccgccagccggattgcccggagaagagaaaaagttagagagagagagaggaggaaggaaggggagggggaaaagagagggtgctgaatcctaacatgtggggctcacgtgggtcccacgctgactcagctgccacgtcggataaaaccggggtcaaaaccatttaaggacattaagtgaacggttttgtaagttgagagatgtcatatatatggttttatggttagggacgattttgtaactcgatgacaagttgagggaccttcggtgtactttttccacaaaaaaaaatccccacagggcaaagccaaggccagcagccacgcccacgcagcctccagactccaaaaccctaagtcaatggataaaatagacaaatgggccaagtgggcttttgctaaagtgataaatgggccattttatgcatactgcgtaccggttcagctacctccatcgctcctgatcttcttcctcgcgccaacagagacagttcttcacctcttctcttctccaagccttctccagctactcccatgggatagatgctatataattaattttttttttgcaaaaatcagatggtaggctcgagcctgatgaagcctacctcttggatccgtcctgcatgaagggtgaaggctggttgaagcgcgtgaaacgaggtgttgaggcggagcaactgcggccttacatgctaccggtggggagggttaacctggtggcctttgccagatatggctaccacatcatcggctagagcattgcttggtgcctcgtcgccgcccccacaactagtgctgcatcgtcaccactacctcctcgacacccctagttggcgtcgcctcgtcttgccttcccgtcgctgccacaggccgcagccgacgccctcagcccacctcctcgccgccatggctgctgtcaagcttacggataaggcatgcctcctatcctacgactcatcgaatatacgccctcagcccacctcctcgccgccatggctgctgtcaagcttacggataaggcatgcctcctatcctacgactcatcgaatatacatatacggtataccttcgcgcattcggttcgttcacgtatacattaagaaagtttatctctaattatggaaaatatctccacgagtcaagtgatttccaaagttctacttggagaggataaggtttatgttatatcgtaccagatccgatgtctcgaggtttgacttagagattaagatgatccacgctataaaaggaacccctaggcgtgggtggaagagatcgaccaaaaccgccaacacacccatcatagtttacgaagccggagtactcggagccaagtggccgtgagatctcgttgatccccatcgattacaatctcgtcggaatcgtcagtttcgtctacttctttgtaatatgtggtattttcatataatcccatactaactggactagggctattacccatcgaggggcctgaaccagtataatctgtctcttttgcttgtttgatgtcatacaacgcaaatccctgttccaacgtaccccaatactcaaatcatccggtccatgagtattactcgtcgacagtgacgcgccaggtagggagggcttggtgcttaaggatctgccaatacaacttcaaaccatcctgacggcagtaccaacaccggcgtcaaccaaggagtttcagcctcgacaccgctggtctggactcatgtcggaaccattgtctttccaatctacaccgctacaccaccacatggcgccacctccgccattcacctcgtcatcaccaccgtgatgccttgatggaggagagactgagtgcaggggagagagaggggaggagggagagaggagaccacagagagagcagggggaagagagaaggtaggagtaggagagttagaatgataggttgggccactttcatttttgtcacgtacgtaagagtctagtcaacatgagtggactaggtcaaattgccatatcagtaaaactaaccttccatactattagaggacttaatttgaactgtttttgtaagttgggggtattgcggtttagggatgcaaattaaattcgagataaaaattacagccggaaagtggacttattcctcgtaacatgcatgcgtccggaatgcaggccggccttctctgatgggttaatctaaactaaactttcaactctccccaggtaattatgaacatgaaagttcttatatttgagtttgaaaattttacaattttagttgaaaattattcgatttgacagttcaataattcgtgtagagagttgtccgagaaatacaaaattttatggataattaccttaattaccatttcgaggagaaaatctgttcaaattgatttgccgaaaactgagaaaaaccagtggaaaccaaacgacatttatagggataccaactaaaacggctcggttttataaggaataagttcatctgaggtcccttaacttgtcaacgaatccgattttcgtccctcaactgaaaaaccatacacaatgagtccctcaactatcataaccggtacagatgaggtccctcggtggttttgatgacggttttggttaacgtgacatctacatggctaatttgactcggttttcatctgacgcgacgcttatgtggcaattcgatccagaaaaataataaaacccgtgggacccgcatgtcagtttcacacacgaaataataaaaaaaatcgtaggacctgcgtgagccccacatgtcatcctcactcctccctcctctctctattctctctctcccctcctctctatccgttctctctctccgaccgatggagcagggcgagcggcggctggcaaaagcgggcgacaggcgggacggagcggctggccggtggagcagggcggggctgcatcgggcgtcgcgacggacctcgccgcggggccggggctagccgccgccgccgccggcaatccgaatgacgatgggggagatggaggccgccatcgccgccctccccgcgaagaaggaggcgctgcaggagaatggctggccgcagggaatcctccagttcacccacggcgctgcttctgcttctgctgttgctgtttctgcatcatcttgccctgttaaaaagacacagtgcccttgttctttcgcaattgcaactagcatctccttctctacttctactcacttcacacctcagctcagctcatctcctgtcatctcagctcagctcagctcagagagagagagagagagctgcaggtgtgagctgatcaccaggaagcagaggcttttttcagattacagttatatatctgaaacaaccagattcagaatcaatcagcaaaggtagatggagtttcttgtttcttttgtactactacatgactatatccatatctctttttcttctacttcttgtcttttgtttggttttgtgtgttgttgctgtgtgtttcaacaagtcaactggatagatagattcatagatattatagtttttatctgaggttggaggtttcccctctcacccaccacacattttggcaccccaatcctgaatttactgttcagttctcttcttcttctttatcgattgatcgtccatgcatgcatactggtatatagtgctagtgctcaagtgatcatccttcctgatggtgaatctcttttgagaaaagaaaagaagaatatctctcttatcttggctttttcctgatgatctgagcactgcaatggccacgtcgtcatgcagacaggcgccgcggaagccaccgaggccggaaaggacgacgatgatggcgatggcgatggcggaggatgggtcggcgtcgtggtttcagtactcagaggagatgctcctgccgatgccgccgacgcccttctgcacaacgccggcagtcgccgccgtctgcgctctatggccccgcgtgccgcggacctgacctagcccgctgtcccgcgtgtcgatacccgggggggggccggactcaagggattcattctttttcgcactaatggaggacatgaattctgggcaaattatctatgttacagtctattaaaaaaaggacttctaataagaaattcttctgctaaagaataggctcgcctataaatagaagcttcggcgcactctatattttgcgggacaagaaagaaagagtcaaagccatggatatcgctgcaagactatcagcgattcctcaagaaatcgctgatatagaaaacactaagctcgaactagagcaaatgctgggtgtcctcggggagcctttatttctggctttcgtcgatccagcagtgatcatacaagatgatatagttcttgttcagaaccaaatccgcattcttgaaaacaggaagaaggcgctgctggaagaacagcaatcgctcatcgtgatggctgcccaccacggtgactaaaatagaaaaaggtagttactcgtctatctcaacgtaaatgaacgaagtcacttaaggcttcctactactactgctccttcttacttattttccttaaatcataatatctgactatcaatacttgtatataatgaaataaaacatggtgtccaacttagtggtaaggattattactaattatttccactagtgttggtgaaatatgtatatacaggtattttgagaagaaaacacatccgtcgagcgacaaactgcacctctgtgcattcaggatacatttacacgtattggaggccccataagtcaattaaaaaactgcaaatgggcccaaccatcatgccaatgggctgagggtctcaaaattagtgtccaggaggaaaaacaggtccaacggagccctcctgggttcggccgaaccacttatgaggctgttgatcgcgagattcgacgtggacggccctgattacttcctgatggtggttccggggtagcttggttatttcgcataggctgtaacagtcatacctgcctataaaaggaggagcctactctcatttccaacacacaactttgagctgaattacaagagactctattgtatcttttgttcattagaataaggtagagagtgaggggaagctctcgaggagtgcccggaagtttggcgctcatccgacttctacctcgatgagtgtagcttcttaggaggaattccggaggagtaccggagctgtcggtacactctgctccaggttcggagaacttcttctataaagtaagtattcgtgttcctttcttatgttatttaattactttgtctaagtaaaataagatttccatctctgcgggttcattgtttagtatttgtactaagtgctctagtactaggactctggatagagaaggaagttcctgcgcaagtattagagtagtaattaataacttagacgtggtgtctaggttagagattaccttcccacggatttgtcagagataggcggcaggtggtgacagccttaaattccgtcccagtaatcctccatattcggatacatcataaagctatagccggaaccacgctggcagaccagcaggggtcggtgcccgaagcaacagatagaaaattacctttgcttagcttatataattaacactcatagaaagtcctctctagcctacctaccatcagttgttgtccttggatagccttagccttaggtagattatacgcgttccctgagttcgatatccttttggggtcacccgaaggttaagtgctacagtggtattccgtgctcttgcggatttatctgtggacgtaagaaataccaacacccgccgtcggccgctgcccgcccagctcctccccgcgcgacgcccgcttctgccgaccgccgctcgcccctctccatcagccggagagagagaagggatagggagaagaggggagagagaggatcacatgtggagcctacgtgggtcccaccattttttattattttatgtgtggagctgacatgtgggtcccatgggttttattatttttccagattaaattgccacgtaggcgctacatcagtgccacgtcagatgaagaccaagtcaaattagccacgtaggcgccacgtcagctaaaaccgccctcaaaactgccaagggatcttatctgcaccggttttgatagttaagggaccgttgtgtttggttttccagctgagggacggaaatcggattcgtcgacaagttaagagatctcagatgagcttattcgttttttataaaccgatcagtagggtgaacctgtttaacacacaggccgtgaacctggcccaaatccggactctcggcctatccacgtgagtgggtcgcgggattcaggcccttcaaaagaacagatgcctccgttgtagaaaaaatgaaagaaaataagaaaggaagaaacaaagatggtatatatccatttgatcgatggctacgtgtagaaaaaactcgcgtgttaataagaaaaggcatgcaagtccaacctaacacttctcaatccaactatggaataaaactagacttggactagtataaattttccttgctacactagtcaagagtagaaggcgaggccatccacatcatctatggataaattcagctgctccctctgcccgtagtacaagaattttgtctttgcactaatttatcataaaatataaaatgtaaaggctagatttttgtggtcctgggactttatatactattactatagtttctttttcacctatcaaattaagtattattattttgcccactgtagtatttttttaccatgacttatcgttctgttacattgttaatttttttttcaaaaatggtataatcaacataggaaggagtagctaggccattacccacaaggcaaaatactccgaggatgaagtattagttccttgtacaatggtttgtttaaaaccaaagctgagtgatgtatacagattgattttttccgtttggctaaaatcaatttttgcatgtggacgtgccagatccgctccaccattgcccaggccagatccgctccgctaccgctggatccgcatgcatgaggggcggagcagtggccacatccggcctggagggagaggggggaaccagatccgctggtgccacgtctcccgcccgccgcattcccgctcggcggtggaggaggagcctcccgccagccagcacaagtctctcttgcctcgctcccgcccgactgtgcaagaggagaagccgaggagcatcctgctgctcctgccaccatcactcccacccagcggtggagtaggaagtgggagaggaggagagaaaaatgagtgggggagggagtaaggagataaggtgagagggtgtggaaaaatgaaaagaagagagaggagaagaggtgaaaaaaatttgaagtggctaagtgggaaaagagaggaggggagaaaaaaaattttggacgagaggaagtttttttttcttgcggatcacttaagacgcccgcatgcaaaaataggctcatttttgcatgtggccccttaataggtccaccaacgaaaatatatttttgcatacgagcctcttgagaagctgcatgcgaaaatagaggttgatttttgcagaagcaaccaattatgatctgcctacaacctataggggtcctcgtacattaaaattgtttttgtattaatggaaattagcacaaaacaaatacattaaaatcgttcttgtattaatggaaaatcgtttttcgtttttgtattaacgaaaaatccctagcaccagccacaaatatactggtaaggcttgtgagcgaacattcccccatcgataatctcgcgaatggatctatatatacgaggatgattacaggacgcgccatgaagtagtattgttctattcccaattttccatttcttttcacatgatcctcctatacatatcaagcttttttgttttttccgcttccttttttcatatttatttctttcgttagtcttttttatagttttattaatggaatttttaatatgaattattttttatagttttattaatggaatttttaatatgaattatttttttatagttttattaatggaatttttaatacaaattatttttgtggatacttagaatttagcaagaaaaaaactttaaattaccaacgaaaaatccttagcaccagcaacaaatacatcggtagggcttgtgagtgaactttcacccaccgataatctcgcaaacggatctatacgaggatgattagaggatgaaccatgaagtggtattgttctattcccagttttccatttcttttcacgtgatcctcctatacatataaaccttttttgttttttccacttcctttttttcatatttctttcttttgttagtcttttttatagttctattaatggaattttttaatatgaattatttttgtggagactttcttcatacattaactttatatatgcgaagcccaaaatatagactttacatatatagagtttctatatagattttatgtatatgaactttcaatatatagactttatatataaaatgtttctatatagacttcatgtccataataaaatttatatttgcaattagaaagtttagtgcataaactttaatagatattaaaaatgctgatcatgcagcacccaatattttttttgaaaaaaagaatccaattgaacgaatctagtaaagtaaaatttgtgtggcagcatggatttggtttataactgaagaaacaaaaaaagtaatcacataattaggcatgaagagatgttatgccatgctagacccaccccaaatacatagcatactcaacaccccactaccatgatatgttttatttcgttgcctgtcacgtggcgtgctgcgactcgacttttttactcatgataatgtaacttttgtggggctaacaacaaatcagtcgaccaataaaaacaatatgatatcgggcgctcgctctttgtacagcttctttcttcttgatttttcctcctctgctgcatgcatgctaatacaacaactttctttttcgtatttcttcatgcatgtgtaactcaacatgtttcttctttttctaatataaacctttctcaaactttaaactatttttaatggtaaattaatgattcaatctgtgacccaattacaccattgtgttctttgatattaaatcgtacaacaagctctcacatgactatatattgaataatatatataccatatttctaattgaaacatttttatattatacttgaaacatttaatatataattattgaaacatcataaaatatttactgaaacatataacaccattacgtgtaacattttaaaatgctctagtgaaatatcataatatatttatttaaacatctaaatacacatgatgtgaaacattagccaaataactattgcaacataaaaaacttaaaaaatatgcaattaacatagtcagtttctaggtgaaacattgacttcaactatcgaaacatgtatattttttcatcgaaatatatttgagtgatatcttattgtaaatatttaattgtgacaaaaataacggtataatcgaataatcgattggataagtaacatatgagataaaatcattttacgaaaacatagggcatccaatgtgaacataacaagggtcataaggttgagttggcagcttgtgactagccttaggttgtgttcggcagcctatgttcccaatacctctcccgcatattctacgcgcgcgcttttcaaacggctaaacagtgtattttttataaaaagtttctatacaagaattgcttaaaaaatcatattgctccatttttgagaaaaaatagctaatacttaattaatcacaagctaatggaccactccgttttctatgcgtaggagatttgttcccatattctccaaatgatctcagccttaaatattgtggaacgtaacaataggccattaaatgctaaagttgaccgtaagcttatggcttggtcacaagagaaaaaaaaaagaataaaagtactgcacaaaggagggagtcaattcattccttgagtaatactacctccgtcctaaaatagttgtcgttttgagttttttttttataatttgtggtcattcgtcttattaaaaaaatatgaaattattatttattttatttgtgacttgctttattatcataagtactttgagtgtaacttattattttttatatttgcattaatttttcatacatgaagaatggccaaacattataagaaaaaagtcaaagtgatcactaattagggatggaggtagtagaagacttcaaagaagcactgtattttgactaagtgggacccatcttatttcctcccataggttttaaccattgtggagtttgttatagctagttctttttcactgagcccgaccgttatattactacccattgttacatgtacattgagaatgcccttacacccaccaataaggttgtctatttgctttgctactccgtagcagtagtactctacagactcattatgcaagcacgcgagcattctggtctccgaattttggtgtcgacctcaggcgaccggacagaagtaatctccaacttttgttggaaattaataattatgtgggacccaactgagaactgtctaactgcgatcaaaatcatcgtggcagtaagtcaagatgcctggttaactaattagggcgtatgaacaagtcatcgtggcagtgcaactgcactgcaaccacgtacggtagcaccattccatggctgtcctcctaaacccttcgtcttcctcaagcagcaaagcaacgccgcggccgccgcagcagcagcagctactactactcttgctccacttgctgctcgttgccgtccccgccacctctctcaccttcagctatgacgcggactccttcgtctccgaagatttcaggcaggaggacgacgccatggtcaccgccggccggatcgagctgctcggtgaggagttcgcggcgcgggccaggggacgcgcgctgtacaagcggccggtgcagctctgggacggcgccaccggcgaggaggccagcttcgccgcgagcttcaacttcaccatccggtcggtggctggcaggggcaacgccctcgccggccacggcatgacgttcttcctcgcgccgttcatgcccgacatgccgcaggagtgctacgagggatgcctcggcctcttcgaccagagcttgacgaggaacacggcgagcgccaccatgggcaacgcctcaggcgccgccagcttcgtcgccgtcgagttcgacacgcacatggacgggtgggacccgagcggccggcacgtcggcgtcgacatcaacaacgtcgactcgcgccgcgggaactacgtggtcttgccggaggacagcctcgtcgacgccggcgtgatgtccgccacggtgtcctacgacagcggcgcgaggcggctcgacgtcgccctcgccatcggcggcggcgccgcaaccgcaacgtacaacctctccgcggccgtccacctgcgaagcgtgctgccggagcaggtcgccgtaggcttctcggcggccaccggcgaccagttcgccagcaaccacaccgtgctctccttcaccttcagctcgacgctgccgacgaggacgaccaacccgccgccgccatccacctcgtcagccaagacggctcatctcagcgccgccgtggccgcagccggcatagcactgttactcctcgtcctcgccatcaccatcctcattcgccgagcgaggaaacgccgccgacgcgacgacggcgtctcctacgacgactccctcgacgacgacgacgaggaggacatggagtcgggcacggggccacggcgaatcccgtacgcgcagctggcggcggcgacgggcgggttcgcggagatcggcaagctcggggagggtgggtcggggtctgtgtacggcgggcacgtgagggagctcgggcgggacgtggcgatcaaggtgttcacccggggggcgtccatggaagggaggaaggagtacaggtcggaggtgacggtgatcagccggctgcggcaccggaacctggtgcagctgatggggtggtgccatggccgccgccggctgctgctggtgtacgagctggtgcgcaacggcagcctcgacggccacctctacagcaacaaggagaccttgacctggccgctcaggtacgtacgtatgtgcccatgttaccatcgatcaggcgtgttcctaccttgacgaagtggcttttgtggggcccacatcttggccgcatttacgatagcgctgcctgtagattccatcaacagggcaatttggctggactgatgaaaatacattaaccatggatggtgacgtgtccccgagtcccggcgtccgggtgcatgaattatgagtagatgattgctccagtccggcggattgtaccggtaggtaatagtatcggaaggtacaaaatcaaatctagtcgtctaaattgggaaccggaaaagagaatagggaagggtattgaacatttgaagtcactcaaattatagtaatcagtaaatgacagaggagagctgctggatgggagtaaatctcttatgattaacaaggaagggagcccgcccatttacgtgggcatgtatcgtagattgtatttcaaaacactataaggatggaatataaatcagaaaacattttcaaaatataaactgaaaataaagcccgcagagatacactgacatcttatttgttgttcaagaaaaagaatggtaaaataaatcatacatcacatatatatatatatatatatatatatatatatatatatatatatatatactgtaagggaatgtaaattttcttacaataaaaaagaaatatatttaccgtaaaatagatggtatattttaatatactactaaatatgataagaataagaatacatctcatatttaaataaaaatcattttgtcgtggtcatatataaactcctctattgttattgttttaaaagctatgtgcatttttaataaatgaaactgtattagtaccactaaaataaattatatattattaatacactaaaaaataatctacactacttaactcgatgttcatcacttatttccacatcatcgactgtatctaccaaagctttcttatataatgccctgaaacattggttccacatcgacgtagccgtgaccctaaagaccagcctatggcaccattttaacacttagttcactatgagcacacccacaaaggattgcattagtaagaatgtcactttagatacattgcctatagtgatcttttactgacgccaccttaactcaaccatatgtatatgcctgtaatatttacgatggcatagtaaacactagacgctgcattgaaggacatggagggacaaaaaggaggaggtgatgaaaatagttataatttttgccccctacttatttttgtatagtattatttttaacaaaatcatagttgaaaggctattgacaacaataagtgccggtgtttatgatttttgttgattagtatttctttccgattttactattaatatattgatatattttttgatttatcgtttttctccgtagtatatgaggtagataattaagttttgtcttttcactggtggagaaaccatctttggtcggtcggcccaattccgtagtatatgaggtagattgatttttagtcccggttatttgaaccgggactaaagatagcgatctttagtcccggattcgtagtcccggttggaaaaccgggactacagggggttatgaaccgggactagaaagcatttctccaccagtgttttctggaaagtgagacgattataaatataggtagtttggttttccatctaataagtgagaaagaaaaaagaaaaaaaaaggaatgatgtgggcccagtgtacgtatcaaagtatggacgtacttgttgtttttgggaatacctatacgtgcacgtactatgcgagtttttgagataaatttaattatattttttataatagatctaatggctagaaataatgggcctatcggattttaaaattttttaaagcgccacatagcgacttaggagtgtttttaggagtgctatgtggcggcttagaagagtttgtaggaagtttaatgaacttttagtatataatagatagatgttgatgattcttgtcctacgagaaccataaactactccatcttagattataattcgttttgaatttgatcaaaatcattttactctaaatttaattaagtttataaacaatataataagacaccaaattattttcattaaatctataattgaatatatttttttaatatatttgtcttatgttaaaaatgttactatttttttataaatttggttaaacttagagtagtttaactttgatcaaaactccttataatttgaaaggtgggagtaattactactgcctctatggctctatcccaattaatcataccctaaaatttgtacgtcttagtttctaaatcgatcattatctaactgttatctatttgcttattcgtgtagaagtaaataacattgttctatatatgttcgtttaggtgtgcagtagtaaatgacatcgttgtatatatgttcgttcatctgtgtatgagtaaatgacatcgttgcatacctcacattaattcaactacacgttttcatatccacatacatgcctagtacaacatcatgaccgatgaggtttacttctaaaaggagtgatattttttgcgttgatctcggtaacatttgcaaatatgatagatcaaattggaaaggacggggaaaaatgagtagtactctgatcgaaagttcgattttatcttcgcataacagttagtaataaggtgatgtattatacaaattaccacatcacatttatattcgtactatcgtaatagttaggagttaatttggagtttttctctaaaaagaatgctataaattcacaataactcatatgatctaaaaaaatccgaaattaagcgcggtattgcacgtaaactcatatgtaaattctctgtgaaaatcaaatatactttccctgtatctgtgtatcatattatgtgactaatttttgtcaggtaccagattattaatggactagcctccgcggtgctgtacctccaccaggaatgggatcagtgcgtcgtccatggcgacatcaagcccagcaacatcatgctcgacgaatccttcaacgccaagctcggcgacttcggcctcgcgcgcctcatcgaccacggcatgagcctccagaccatgaccgccgttgccggcacgccgggctacctcgacccggagtgcgtcatcaccggcaaggcctccaccgagtccgacatgtacagcttcggcatcgtcctgctcgaggtggcaagcgggaggcgaccaatggtagtgacacctcgtgcagccgctgccaccgcgggtggtgggaaggacgacgacgacggcggcggacaggtgttccgcctggtggagtgggcgtgggagctctacggccggggtgatgatgatcagtcgtcgctcgacgccatcgccgacacacggctcggcggcgcgttcgaccggtgggagatggagcgtgtggtgggcgtcgggctgtggtgcgcgcaccccgacccgaaggcgcggccggcgatcaggcaggcggcggaggcgttgcagtcgaggaagttcaggatgccggtgctgccgccgaggatgccggtggcagtgtacctgcagccgttcgcggcttccaccatgaagtactacggcgacagcatgacctccgttgggtcggaggttgttggttactcgtcgaccagccttgcgacggcgacgctgtcgtccagctctagcttgccatcggccatggctaacaatgacagcttgagcccaagagaatgagggttttggttatattagaagttggtcagttggtactgccgtactggtagatggcacatggtagataaaggatatactcccatgttgcaataactcattccaatctgcttgtaatatttgaatgaactggtgtccttctgctccactagtggtgaaatacccaaggcaaaatttgctacaagacacctaaagtttgtggcatttgctgtgagacatccaaagaacgtgtattttctcgtggacaccgtaaaaatgtggtaattagctgctggatatctgcctcattattttattatcccttttattattttcggtggaaatggagagagaaagagcattgaaagtaccaaaacacccctgacactgtttttcttccagcttctgttcttctttcttctcctctcacactgccatgccacagcagaccaacggctccatctggcaagggcaagcacgatggcatccaggtacatgctagccccgtgtagcagatgtccccgttggcctcgttctggaacgtatgtattgacacctgcagcagcagcaatgccaagccgagccgtgtgcaaactggaaaacggcgttgattcgataccccttagcgagtgcgagcagcaccagcaggagcaggaagggccccaaggggagtaggtatgcagtatgcccctgatttcgctcgcactactgctccttgcgaggtcaaggacggagaggaagaacagaagaggggatctcaaaagggaaaaaaaatgaaaaaatgagccatccctgtcgatccacccgtggcggaaatggcggacggggcatgcgtcccgcgcaaggatttggccgacggcggcggtgcccacttcgccgctaccccatccgaagcggagccctggggaggactcctagcagcggcgcgccgccccgtgctccagcccagccagtcccgcaccgccccgtgctccagcccagccagctccgcgccgccctgtgctctagttgctgctgcagcggcggcgcccacttcgccgttgccccatccgaagccgcaggaggaagaagatgaacagagaaagagggattgacaagtgggctcatggacaaatctgtctttaaccaatgtctctctccgtttctatcgaaaataataaaataatgagacgagtgtctagcagctaattaccacatttttacagtgtccacgagagaatacacgttctttgggtgtcttacagcaaacgccacaaactttgagtgtcctgtagcaaattttgccaatacccaatgttaacaccaaaatttagtatggctttttagtgaattcaattaaggaaagaggtcgattcatgtatgaaagtttaccaagatcaaactgacttcaaagaaaaaccgtgaagacagcgactaggcggtttcatatttttaagtatatccttaaatagactggatttgttattttcctttggtcttattttagagagccacatgggagtttaatagcgtttgtaggatgttaatggacttttagttttttaaatatataataggtagatagattaacacagtaaaaaattaattggactaattgtaacaatgaattatatagctaatttttcaaagaaagtcaactcttctactatataggtacatcagtatatttgctttacaagtaggcccatccttggtcatgcagttaattttctcggcgctgcattttgttctttttttagtatttcgtttgttgctactcctaacttccatgtttgagggaatacactggaattttccagaacatttttttactgctttttacccaccaaatccaacggttttgccatctcctttttctctatccaatggtgattacgtggaacaatctggtgaagtttcaagatttaggacccatttgaatcaaaggatttatataaaaattttataggattcaaatttcatacaaaatttttctatttcgtcctttgattcaaacgattgaaacttttcaaatcctatgaaattcctatggaatgacacatagcatatagattttggaggaaacttagcaagaggtccaacctcttggaaaatttcctttgaatctatctctctcatatgatttctgtgtttttaccgcggtccaatcaaacgatcatttttgtatttttcctatgttttgcaatcctctgttttacacttcaattcctattagaatcctgtgttttttctattcctccaatcttttcaactctgcgattcaaaggggtccttaccgttcacttttatagataaatatatagatatatactccctctgtcccaaaaaatgccaacttctggctatgtattcggatatagcctatatcgtagatacacagctagaggttgattctttttgggacataggaagtatgtaacatcttttgagaagtaaaagtgtaaaaacatgtaaagtgggcatccctttgaggccttgttaggttggcccgggtttggccgggattgggctgcaatccccgtggattggatagacgcggattgaaacccggcccacagaaaagtttgcattcggttaatcccgtcgcggattgaatcgaggccgatccggcctttccccctcgtcctaggttgggaaagaaacagctacccatatggagtggaaaaaaaccctcgcgcacaggagaagagcagcgcgcagggaaagcggtggcggtggagcggacggttaacgaactcgcacaggaaaagcaatccagaacgaacgcacggattagagcacgaaggaattggcaactctattactgagatatttctccgattccgacatgaatggagccaccgccgcctatgccaccatggtcgccaaagacagagttcacctcgtgttctctctctcttatcttcctcacctactcagttcttccccctctcgcacgaagaactattacaggaattagacttaattacttggcctagttaggcccatagtacttctggtttatcttgacgggccttgttgcacggcgcaccacttctccttcagctgcttcaagttcatcttccctccttccggaatcagcatcatctccagcgtctttagcaactgacttagcgccctcggacagtggttgctccttgacaatcccctccccttgaaatttggcttgtccccaagccaaagcagtaggaaatcgagtgcgtaagtcctccatgttttcccaagtggcatcctcggctgcagaatcagaccagcggatcagcacttgaagaacagcatcggtagccctcttgaccaccctgctatcaagaatctgagaaggaacttgcagagcagagttagctttaggcaactgaagtgatgaaagctctttataacccttagccgcccttaactgagatacatgaaagacaggatgcacactggcagttgcaggaagctgaagtttatatgctactgtgccaattttccgtaacacctaaaagggaccaaaaaacttgaaggccaatttatgattagctcggagtgccactgaggattgccgataaggttgaagtttcaggtatacccaatctccaactgcaaaagatctgaaacttctcttcttgtcagccatatgcttcatttgctgatttgctctatgtaaatgctgttgcaccaatgcttgcatcagtttcctctcctttagccattcttgcaaatcaggaatttcacaagtgtccacattgattccaaaatgcctaggagagtgcccatataggacttcaaatggggaagtctttaaagaggaatggtaagaagtattgtaccaatattcagccaagtgcaaccatgtgacccatttagaaggattggcatgagcaaaacaccgcagataaatctcaaggcactggtttactcgttccgtctgtcgatcagactggggatggtaagaagtgctcagattaagttttgttccagaagcagagaaaagataagtccatagctggctagtaaaaattttgtcacgatctgatataatcaccaatggtagaccatgcaacttataaatattcaacatgaacaccttggctacttcaagagcagtgaaagggtgggccaaaggcaagaaatgtgcatatttagaaaatttatccaccacaaccattatgcagttataagatctttgacttaggcaaaccttcaataaagtccatgatgatgacttcccaagatccatcaggaacaggtaatggttgtagaagccctgggtacttagatctgtcaggttttgcttgcagacaagtttgacattgctgtacaaaatcctttacttgagatttcataccctgccaagcaaacagtttcttgatcttactgtaagtgactggaaaaccagagtgtccccccattggactagcatggaactcagcaatcaattgtgactagagagaaggatgattaccaatccaaatgcgccccttgtacttaataattccagactgcaactgaaatccaggtttgcagtcaagctgaacagacaaggctgaaagcagatcagaagaatagggatcatgttcataccccttagcaacctcttgcaaccaactgggaacacaactagagatgatggacaactcagaatcactttgaaactttcttgatagagcatctgcagcagcattgctggtccctttacgatagcaaattttatagtttaagcccaataacttggtgaaagccttgtgctgccatggggtatgtaaacgctgatcagataagtgcatcaagctatggtgatcagttagaattataaattccccaagttgcaagtatgacctccagtgatcaactgctaacaagatagccatacattccttctcataagttgatagcctgtcacaccctaaaaattcaaaatatataaattgttgtttaaatggaatttttagaaattattttaaaagcctagaaaagaagatctaattttaattaataaattccaatataaagtggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccctctctctctctcctcggcccagccggcccagtccgcagccgcagccgcccgcgcgagcgcgctgtcgctgacaggtgggtcccacctgtcgggatcgtcgtcttcctccggccgaaaccctagcgcgtcgccgccgctttccaattcggccgatcctttccttctccggccgaatcaatagaagggaaatgatcttcgagatctcctctaccttttctcctttggaaacatcggctaaatcgtttggaaattcgtggattcgagtttgtttcggattcgattttcccgaactttccttctcgtcgccggccgacgtgggccttcgccgttgcctcctagcccctttaaaaggctccccggtgtctcctctacccgccgccacctttgccttcgcctctcgtcgtcggaaacgccctagcgccgtgtgccctagcgccgccgtcgccgccgtcgctccagccgtgcgccgccgccgttccagccgtcgccgtcgctcgggaagaccgccgtcgtggtcgccaagtcgccgccgtcctcgtccactccttcgccgccgccgaagaccgccggagcaccgtcgccgccgtcaacccgaagtttgccgccgcttcctcctcgtcgccgtcaccgtccgttcctcttccgccatcgctttggtcgccggtgagttcgccgtgccgtccgctacccgttggtgtcctccgttcgtgccgaagcgccgccgttcgccggcgagcgtgcgccgtccgagccgccgagccgccgccgccggtggtgacgtcatcgccgacgtcatcgtcgccctctcccgtgagccggtcgtggaccgatcgatctcggccgtctgttttggatcaagtcgatctcggccgtccgttcgcgtgaaccgccgccgtgcgctcggtccaccgaaaccctagcccgctgacgcaataaatcctcttttccttttcaaaaaataattcattattgcgtcataattcaattaaaatcagtttaagtgttttaatccgatttaatctttaaaaattcataactaattcatcttagatccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgagctttatttattggttcaactagatattagatataattgcttagccctgattagaaacattagcacactattgggataacttatgactcactattatttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcaaggggtattgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctgtcgtgattagtcccacacttctcaccatagtaaatgatgctataattggtaataatttgattagctcctggtttggaatggtacattcctggtttggagatagaactgtgcagccgggatggttgttcagaatggttgggcctatacaacagggtatgttgtgtagcgttggattaatattgtttaatacttaactgttttattaaattctgaaatgtttgctaaatgctgcttttgcaaatgaaaccctactatgccatcctttgttatcctgtgcatttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatcttatttttccgctgcttagatctttattgtttgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatagccctcgatttcggggaccaagtgccttgctaatgtaggctattgggtgtttgttctgagacaggacagccccaatccctgaatctgaagcatcaatttcgacagtaaaaggcaaactaaaatcaggtaatgccagcactggggcagaaaccagagcttgtttcaattgttggaaggcagtttcagtctccaaagtccatttatatggcaccccttttcgtagtaactgagtgattggtttactgattaatccaaatcctttcacaaactttctgtaatagccagccaaacccaagaatcccctgagtttctttttggttgttggtgtttcccaattaacaatctcttgaatcttgcttggatcagtagataccccctctgcacttatgacatgacctaagtaggtaagttgctgttgtgcaaaagaacacttggataactttacttgccaatgatgttgctgcagcagggttaacacttgcttgaggtggtcaaggtgtgagggcaaatcagggctataaataagaatgtcatcaaaaaataccagagcaaacctcctcaggactgatttaaatgtctcattcatggcaccctgaaaggttgctggagctcctgtcagtccaaaggacatgaccttgtattcataatgaccagtatgagtgtgaaaggctgttttatattcatctccttccttcatccttatctgatgataaccagcctgttttatattcatctccttccttcatccttatttgatgataaccagccctaaggtcaagttttgaaaaccatttagccccaggtaattcatctagcaattcatcaatcacaggcatggggtaggaacacttgacagtgatggcattcagttgtctgtaatcaattactagcctccaagtgccatccttcttcctgactagaagggctggagatgcaaaggcactctgactcggttggataacaccactttgcaacatctctgaaatttgtgcctcaatttcatccttgagggctggattgaatctataagggcgaaggttaacaggcttggacccaggaagtaaaggaatgtgatgatcacatattctctttgggggtaatcccttgggtctaggattgactgaatgtcatcagggatttcagtcttttcagaatgagatatagacatcaactgtaccataaatagcagtgacccaaccttagccattcccaaacattgatcaggagtaatagaggagcatctgtcggtttgatgagtaacaccatacagtctgacaggctgcccatcaatcacaacctctagccatttgttaacccaatccacctgcataggactaaattgttctagccagtccatgccaagaatagcatcataagagcccaaattcaacagcttgaagtcgctcttgaaataatgaccttgagtccaccaacgacaccccagaatttgctgtgtgcacttcatagtaccaccatctgctattttcacagttacagatctacttaaaggaatgaggcccacaagcttgctgccaatgctctcatctatgaaggagtgtgtactgcctgagtcaatcaacataagaatctctgttccttgaacccatccccttaatctaatagatttggatgattctgtacccccacaaagcttgctgagatatagccatcaatcctccatcaattgcctctactgattcaatagggtctttagctgtcaggatgtcatcagaattacactcagagcgcattgcttccaataattcttggacaacatggagctggacagaagtagcacatttatggtctctcccccatctttcaccacagacaaaacaaagacccttagcccttctgtaagacttaagagaagcaaatttgtcctctctggacttagcagattccactccctttttgtcatcatgtgcactaacagctacagatctctgtcctggaggcactggcacataattgttgagttttggtactggcctgaacgcaatgtgattatcagaccttctgtgtgtagtagacttattactttccaggatttcttcttggagcaaggcaattgaacaagctgagtcaaggtcctggggtctctgtagcataactgcacccctgacatcatccctgagcccttcaatgaacttagtaacaaaatacacaggggtgagagcactgtcatatgccattagctggtgcatgatactgtcaaattgttcaacatattcagtgactgtgctgttctgttgcgcatggaaccattttctaattagtgcttcctgtatatctctagtgaatctagcacagatcaagtcacacagagtttgccaagtaatacccataatttgagaacggatcgactgaagccaaaatgctgcattaccactgaaattgagtgtggccaccttgacccaatgcataggattaataccatagatatcaaagtattgctcacaattgctcttccacatctgtgggttctcaccatcaaacttagggcaagtcataggaggaagactagtactcagatcggtgtgatgctagaagaagttggtgattgcacagtagaatccggagaaaatggactaggtgagatgggaggaggattccgcttaccatgcaaccatggagttccttgtgctgaagcatctgcagcggtttcttgtttgatcgcgccaccttccatcagctccaccttgtggcttagtgtctgcacggactcgctgagtttttccaccttctcctccatcttgggaagacaaatctccaccatcttcttcagatcagcgagatcatcccgagtcctcgcctccgcctccattctcttcttctcattctcctcaatagttctcaacaagacatcaagtttactctcctgcgacatcctggaatttgtgagcgaacccaactagatctagaatcccccgctccttcccgaactcagttaaccaagagaaggcaagttgccttattgtggaatctgttctaagaacaattccaatcctccccctggaattttacaaccgcgccaaggaattcttggagcgtagaggctctgataccaattgttaacgaacttgcacaggaaaagcaatccagaatgaacgcacggattagaacacgaaggaattggcaactctattactgagatatttctccgattccgacaggaatggagccaccgccgcctacgccaccatggtcgccaaagacagagttcacctcgtgttctctctctcttatcttcctcacctactcagttctttcccctctcgcacgaagaactattacaggaattagacttaattacacggcccagtcaggcccatagtacttcaggtttatcttgacgggccttgttgcacggcgcaccacttctccttcagctgcttcaagttcatcttccctccttccggaatcagcatcatctccagcgtcttctgcaactgacttagcgccctcggacagtggttgctccttgacacggacgtgactgggattcgacggcgctccgacgacgcggcgctctcccctccggcgaccgtctcctccgctggccaccttctcacttttgagtctctcttccttctcctctcttcttcctatcctacctagggtttggttcttggtccttgtttcttggtttatctccgtctccaactgcaagggctcctcctcatccaccatcaagaacaaggccttgaacatggtgctgcttgtcgattgcgtatgaagaacccaactgctggttgcggctatgcccagctcctcaaatcagatttgagccgattgtgaattggtgatggatttgggt

SEQ ID NO: 25647 - DNA, 1492 bp, Oryza sativa
ttaaatggaatcagaacaatctttttattatatcatataattggaatattacaagcatttcctgtaattttggctggcactacattggcatcaactttcttgatccaggaagttgtaacatgcgtgtatattgttttctagttttctctgaaatggactaatggtacttttgatcttgctcctacgctgccgtcacagggtactagcactactggttttaggtaaatagtggtaaccaaatgtactaatagtagtaatacaagtccagatcataaagagagctagcaatacgctcctatattccctgccaatagctgctatagtccctgtcaaaacgaacacagagtttctaagagagggattggaagaaacaagggatttagtccccacagggtttgagtgaaattggggggattcactcaatccctccctggtttgcttccccttaggatttaatccctagcaaccgaacaaggcctgagggattagaatccatcttccgctttcagcgtgcggttctccaaattgttttatttgcgtactgcagagcttctgagtcagccgtgtcggggagggattatttcaactctaaaagttcattcattacaatgtttatatcctcagtcaaattgctgcagtcgtatgcgtaatgataacatatgcaaatctgacgacgcgaaatctaaaatgcgtgcggtttgaaaggcttgctcgaggtttatccttttgaatatggggagagcaaagtcatcgtctctcactcggtccaaaaccatgtcggacttctgagttctgacttctgtactgcttttatatgcgggctgcggtgagtccccccggctgtaattgtactttgttgtcgttgtttgttcttctcttctcggctgctccggtgctcccgttcccaaatatcattcgcgtattttgcttataaccatagaccatcggttaagagttactaataacttctcatttgcggatggaggagatagaaggtaatttgctggagtcctcgattggatggctggcggataccatagtggagaacctggacaacgacaagtttggcgcgtggattagccaggtcgggctcgccgatgacaccgaaaagctccggtctgaggtcgagagggtggaggtggtggtcggtgctgtcaaggggagggcgatcgcgaacaaaccgctggcccgatcactcggtcgtctaagggaggtgctgtacgacgccgacgacgcggtcgacgagctcgaatactacaggctccagcatcagctccaaggaggtaaagcgtgtacataaaaaatacattgttcttcccttcttcgtaacgcaggacgtcgtacgtactttctctgtttcatattataagaattttttatattacccatatgcctagaatctttaacatccatctatatgaactagcaaggtggcctacgcaattgcgcggatagtatccatacaaaattatttacatatgagtttacttaa

SEQ ID NO: 25648 - DNA, 677 bp, Oryza sativa
aagtcaatcggctcagtcttgattcaggagttggaagggaaggaacgagttgtattctatctcagtcgtcgactcttggatgctgaagctcggtactcccctatggagaagttatgcttgtgtttgtatttttcgtgtacaaggttgaggcattatctactatccaatgagtgcactgttatatgcaaggcccacgttgtcaaggacatgctatcggctccaatattgaaaggaagggttgaaaagtggatattttccttaaccgagtttgatcttcggtatgagtcgttgaaggcaattaagggacaagctatggccgattttattgtggaacatcataatgattcaattggctcagttgatatagtgccgtggactttattctttgatagatcggtgtgtactcatggttgtggtatcggtctggttataatttcccctagggggcatgcttcgagtttgcttatactattaaaccgtatgcgactaataatcaagctgagtatgaagcagtgctcaaagggttgcaattactcaaggaagttgaagccgatgccattgaaatcatgggggattctttgctaataatcagtcaattggcaggagagtatggatgcaagaatgatacattgatagtttattatgagaagtgccacgaactaatgaaagagtttcgg

SEQ ID NO: 25649 - DNA, 763 bp, Oryza sativa
ataagccgagtcgagtaataaaacattgttaaaattgccgttttgccagttgaggtaaatcttggctctcttcggtatttcaagcaagacgacttgtcggttgacgattacaagaccttgatgggaagcaattttgaagacgtcatcgacaagcgtttaaagactttgaaggagatgaagacacttcaagacggtgttttcaaagagcaattaatgggaaatagcttgaagaaatacttcccgagcatttggtaagatgcttaggaagtcctatggccggtaattggattatcgccctgagataacatgttctatgcttttaggttcacgtatgttcaccaaaaaggcaggggggcatgtgtttacacccaaatttggcacctatggacgaaatagggaaaaattgccaaagtttggaaagtgtcgggtttccttcactagggccggtcagaccataggtatgtgggcggtctgaccggctagtagggccggtctgaccgcagttatgtaggcggtcagaccgtgagggtctgagtccgactctgttttcgtcgggtctcgggtttccttgctcaggaaggcatgtttcgtgtttccattggtttctatcccgaattggacgtgaaggagggcctgtagagggcaagaccaacccctatataagggacaaggccggttcattgtaaaacccccgaatacaatctacttgaatcgttttttaactatgttttctattttaccctagtttagtccatctttgtcg

SEQ ID NO: 25650 - DNA, 1005 bp, Oryza sativa
tcaataagcgcatcggccgggtttgcgacgcctgatggtcagccggtgcaataatttttaaatcaagttgtcccagaacacttggttcaccacgtacaaccggatggcacattaatgcctcaagttgtccctgagcacttggtacgtaatatccagctgaatcttcacaattaccaagggggtaacttgaattatcaatatcagcctccttccccgcaagcccaatatcagccagggggattggctcaacctcagtttgcgtctcaatacggtcagttcgagcccatgcagcaacagtcacaaggggcagctcaacaatgaccatgggcagatgtaattgctgatgtaatgagggaacagtttgggcttaaaccaaaagagactggaagcttgtatcggcagccttaccctgactggtttgagagagttcctctgcccaatcagttcaaagttccagacttatccaaatttttgggacaagatggtgtgtcaacttatgagcacattagccgattcttagctcagtgtggtgaagcatcggctatagacgctttgaaggttaggttgttccggttatctttgtctggatcgacttttacttagttttcctctttgccgtatgggtcgatcaatagttgggccgatttggagaagcaagtccacagctatttctacagtggggttcatgagatgaaattatctgacttgacagcgattaagcagcggcatgatgaacccgtgcacgagtatatttagagattcagggagatgaggaacaaatgcttcagcttgagtttaactgatgcccagttagtcgatttggtctttcagggtatgattgctccgattagggagaagttcttgtctgaagactttgatagcttatcacatccgatacagaaagtaaccttgcatgaacataggttcgcggaagttaggaaaagctctaagaaagttaatcatgtttgtccatacatctatgggttgaatgatgacgaggacgat

SEQ ID NO: 25651 - DNA, 6085 bp, Oryza sativa
ccttctaataatctcattggccccatgtatcccttctccatccatcatgtaatcagaacgatacgggtctgactgctccggaagctgatttggacgctttgtatgtccctgttccatacgatttagtggatcgttaggttctgcttggatgagtcccgtgcgactcgcaatattaggatgctcttcgtgcgcctgcattacaacatcaacacgaaccaatgcactattagagacagcagtgtagcatatcagttcaatggagagaatatttagcatcaacttcatgataatttctccaattgagaatatgcttcactcaatcaagccaggaatcatgaaacaaaacatagctgtagtcaaactgttttttaacatcaaatggggcatttgccctaacctttctagcaacactttcatcactcatagagtcacagtacatcgctttgctgaacaccattctacctcctctaaaaagaagtgatatggtagccattgaattgagtcaattcaattgaggacacgggagtggaagcgtacctcccggacttggaggatcggcggtggcgacgaggtgccgatcggcaccacggggacggcgccctccaccgcggcggacgacaggaggtagtgccggagccgcgcggtgtcgacggcgagctcggcggcgcagatggggcaggcgcagcgcgccagcccgacgggcacgctgagcagcgccccgcaggcgccgcaggggagccgcgcgccgcggacgtcggcggcgccgcggggcaggggcagcgccttcctccgtggcggcggcggcggcatgagctccgggggcagcgactgcggcatggcgcagtcggggcagatgaactccgtcagtcccggctccacctccagcgtctccccgcaccccgcgcaccgcacctccagcggctccggcgagcctccctccgccgccgccgacgccgcagcgcgccctggcgccattggcgcaggtgggaagaggtttcgaggttgttttttttttttctgcggcgaatgaggagaagtggggagggagagtggggggaaggagaagcgttgcgggatgctgatctctagcgacggtcagcctttagctagtctgcctagtaggagtaggtttaacgcttttttttactcaccagcgagtgaattttatgaatatagtaaaaagaatggatcaatcgatcccaaatacaaatttgttcatcggtactgctatacacacgaactagctgttcaaactcatgtacagctaaaaacatgttaccatagatcaatcaaaaagtatatgttcacatgtactgtttacaacagttgatcaaattcagtcgtacataagtctaatgatcaaattcagtcgcacgtgactctgataattagttcgtatgtacaacaatttcctttgttaatattctatgctatttcgagtgataccacaaattagcgatccaacgtttcgatatacaggcaaagggacgctttctccgctcatttccacaagaccaagataatgtttccgattgagtaaaatgcatgagcggtgcttaaacttgagcagaggtgttacgtaggatcgtaaactgaaaatttgcacaataaggttcatgatcttgttttaatgaaacatggtcggtccaaaaaacgtttaaccatatctgaccgcatacgtagcattccacgtaggcagcattttacatctggcccccttcacatctcgagaggggatgcaaagggatcaaaggatttgagagattttcggtgactactgtagcaacaagaggtaagaacagaattaccgccacgtcgagatgcagaaggggttggatgcaaaatgctacctacgtgaagcgccacatagttggtcaactctagtcaaacgcgctttggaccagctatggttcattaaaacaagatcctaaacctcaatgtgtaattttcaagtttacgcacataagtaacacattcgctcaagtttaaggatcggccatgtaatttactctttccgatttttcgctactcatttgcatatgtgatagaatatttcctaacagaatgaatctgaacagagaagatagatactcctttcatcttaaaatgtaagaatctagtactggattagacattttatagcattacgaatccggatagagatatttaccagattcatcgtggtatgaaatgtctaatccggtattaggtttctaattttggaacaaagagagtaataaacaaaacgtgaagagatgaagctattctggccatctgggtcaagagccaagagatgagtttcactatcgatcggagtcagcgtagcagcgggaaataccactgctggcagtgcatttcagcatctctccaaaagaccagggacagggaaacagcattagacgcaggtttatatattacatggccaaaattctacgcggcgaggcagatcaatcgcttgtagacaccacttcctcctcctcaacctcataatcttcgtcatcgtcgtcgtcatcgtcgtcgtggtgtctcgcagattgacgcctttcaacatgctgtttgtctgattcgtcctgcaaaacgttacaaaacaagatcgctgcttagtcgcttcaacgaacaagctacaaaagatggttggaaagcatgatcaaatgtatgtgcagcagcaagattaagtgggtcaactcacaaacccacttatagactaatcaaatggattgaccagcgggttacgcacttatttgatctataagtgatttggcgggtcaatccacttacacccttagctggtaagcatgacctctagtagattttcctttgcttttgggaaaaaaagggaattcatcatctacctgatgttttgactggtcctgttgaacatctcctccagctgccgaagacccaggggcatgctgcagagtcaccagatcaatctcttgggtctagtttggaaaaggaattaagtgaaaccatttacttactccctccgtttcacaatgtaagtcattctagcatttcccacattcatattgatgttaatgaatctagatagatataaatgctagaatgacttacattgtgaaacggaggaagtagtttttatgtgtacctcatgatcaacacctaacaatggcgcaccacgcacactttgctccagggatttaaacttctcctcccaggattgatttaaaccttgcagagcatgattgatcatctgttggacctcctcctgcgagaacttctgctgaccccttttaccagggatggactttgctatctccgcgattttggccttgtcgatggtgccagtgagtccatagtacctcccacggttccggccccccacctgctgtatccatgcagcatcgggatctgcaggtttatcaccagcctcctccattcgcttcttgaaaccctcctggaaaattcagtgaattgcaaacacgattcagcagccattggatacactcatctcaactagtttgcatggttgcatgatgcgtttctacaataactgcatagcactctttagtaactctaccatcaatccagtttcgcttttctcacatgacataattctctctgtgccacctattaacacttatgtggtctgtgttgtaatattctcaatgttcgtgacacatggctgtcccaccgattgctctatgacgctatgcaattcaatcagaaccagggtaatgtgttataattctgagtttttttagatgaaaattaaaatgactaaaccaatggaatttgtctttatgtcttaccataagctgccgttgcatggcaaagctccgagaacctgatgtgtgatgagcacgacctccaacaaaccgattcttcctatacttcagagacatctgcaagacttcttctttggcccaatattcacacaatctctcccaccaattcggatgcatccatgcaggggggaagggtttccacagtaaagggtcctcgtcctcatttaccttttctgtctgattgtcctttggctcttctgtagcatcttcctcctctgactctgcatgactattggagctacgagaacctgaagcttttttggctttttgtactgcagccaattctgctctaacccttcgcttctcttcgcacaggaggccagtaaactgttttactgctctgcgctgaaatatcttcaggcactcggcctcacggccaggggcccacttgtacctttgctacagcaagtgaatataagatcagaagcctgtcaaatatatatgacagtgcacatgtattaatttccttacaagaaattcattcaaaatagcagccctcgtctctgcaggataatgtttccagcggtaaaccaattcctcattagctggaacatcaccatgctcaccaaccggcaaataggttgatccagggtacttctgcttcaaaagagcagtgatggtagaggacaccttgggacaaagtgggttgacatcccagttactgtcagagaaagtttatttgtcaagtacatggtaaagaatgcatcaagaaacactaccgacaatttatcaacgcacatattgccttcaaataaaatgcacatactcgatattatttggtgtcaagacaggcctgtcatattccctgcgtggttcaatcagtcctctaggacggcgtcccctgcccctacctgatgatttacgactatattttcttaatacgggatgatagctatatgcgtcctgctgaacaagtgaatgcgtatcagcttatgcattcagactcccagtcacactaaatatatagaattcatgcataaattaaaccatcagatcctcaaacttgatcctacaatcttgctcttgggcaagttgcatctaatggaagctctgagcctcatacctgttgcgcatgcgtaacctgctctggtgactgtggctgcacctgctcaccacttttatcaagctggtgtgtacccctgacctctggagggcacagttgattgtagcggtgcggggattgctcggcttgaggcatctcacgatttgaagatgctggtaaaacagatgcatcagcattgcctgactcacttgagcatgcttgaggcatttggcactgaggtgatggactgggacacaaattggcaatgagtcggtcaatgtctggaggatcagaattatattggtttggagaagcagctggctgctggactggatcatcatttattggttgttctggttgtttcgtcaagcgcttgctacgcctaagatagagtccttcatttggagaactcggaaagcccttatttttcctcttattctcaccagcattcttgctgctcctttttctcttcgggcatccaatcgtcttaccagcttgtgcttttttcagttcactagcttgattgaggggctctgctttttcccgctccatagtacttgagacattttttgcccgctgttcacgacttgaaatgtcaacaagaggttgctgcccttgtgcgtggtccccacgaactgaattactcggagggcaagcttgtgcctgtggtgtgctttcctgaataggacgctctggttgtagtttttcaatatatatagattcaacacctgcctgcaatctagccttccttgaactagaccttgcagtggttttatcaagtgtctcattgcatgattcccccctatgaattgaatggttaacaggctcctttcgtgccaatgtgtgttggactgctgctggggagtcgtttctgaaagaactgaatgtctcctctcttggaactgaacgaatggagcattgtgctggtatctgctctgaacgaattggatggtgtctttctatttgtgactgctgcaccaaaataaataaataaatcaaaagattagatccatacatagtagagtaagaaaagaacattgaaggggagctcgtgatcaaatagattttgcagaaatacaatgagtacatcattgtaactgattttagtacattaagacttcgacttgcatagtctccgttcagctattggctatatcactgacactgattttgcttgttattaagattggaatgacccacatctagactgattgtctatggttgttcgatttac

SEQ ID NO: 25652 - DNA, 6409 bp, Oryza sativa
gaaactaaaagaaggctgagttcagcgtatataaccaaggtgcttgcctctattcctagttgaaggacaggaagaaaatagaattctcaagtccaatgccaagaatttttaagtggctcaacaatacatggaaagtggaacccccattgctggatccattgacaatctcagaacatatacagcttacgcacaataccattcaaagaccccctgcaacttgcatattcttgctcaagtcacttgcaagaacttatatgatacccactgtcccaaaataaagctatttccagagtttaaatttgtcccaaaatgtagctatttctacacctaccctcttatctcaaccaatcgcaaccatctcttatttaattcctccacctattttctcctctcaaccaatcacagcattcagttccacctacttccttaattcctgtgaaaaaatagatgcttatattttgggacatgtggagtattattgagccaatgcggcattccagtagagcaagaccagcgctctaagcttctggagaaaattgcaatattgggactgcaaacattggggcttcgctgttgacactccgagtggatgataaatgggcccatccgtgtctatgaaatatgggtccagtgtcattatagcaaagcttatgtttgcagtgtcataattgcgaatcccccaagcttctgactgcttaaatcacagacagatcaaaatgtacgcacctccggccgatggcgcagggaagacgccgtgagcgtgacgccagctgggggcggcgccacgacggagaccgtgggggcggcaggggaagcgaagtagaggcggaggcgcccgccgtcgacgacgagctcggcggcgcagaccgggcaggcgaagcgcacgagccccgccggcacactcagcagagcgcagcagccaccgcacggcatgcgcgcgggcgcgggaacctgcacggggaccggcacgggagcgtgcaacaccgcggcgggaggaggcccccgtccggggatgggcagagcccgccgcgggcgcggcggcggcggaggcatgagctcgggcgggagcgcctggtgggtcccgcagtccgggcaggcgaactcggtgaggcccggctccacctccagcgtctccccgcaccccgcgcaccgcacctccacgaactccggctggccccccgccgcctccgccatggcttcggggagcagcggctagggtttccttcggtgcgccctcggggaacagagtagtagttggagtgaggtgtgagtgcgagatactactactgccaacccctagtacccgtagcaaagccggaatcggccgtcgggaaaagaaacggctccgtgtcatgtcgcgccgtgtgggtcggaaatttactttttgcttagggtgtgtttagtcacttgaaaaaagttaaaagtttgggaaaagttggaagtttatgtgtgtagaaaagttttagatgtgatgtgataatggaaagttgaaaatttggaatagttgggagtgaactaaacacggccttagagggaaaataccttcgcgccaactttttcccgcccggcatcttccatttcattttatcgcttttgtttacacggaaaaaatgttgtagatgttggtgctcatataacgcatatatactcacccctataaacatatacagtcatacacttacaccctacgtcaaaaaaaattatagggatgtatctgaacaagcatatcgttataagcatcttcgaatagtgagcatatatcatttgagattgttaatcccattatatattagaggttgtttggttttgagaattttcaacccttgagaatgagaaaatagataaataaggttgtattaccccaacccttccaattttccaagagatttgagtcaatagaaaatttcatatgttttcttctctatccaactcgtatgaaagaaaaaaaaatctttgattttcctatgtttcatttccacaaaacgaatggcacttatgaaaattaattcttaggaattcaaatctttttttccttcaaactaagcaaagtcctaaataattggcatgtaacagcagcaggtaaaaaaatagtgaacataatcgtacttcagtcttgtgttgggaaagaaaaaggagaaaaatgaattgcataaacaaaaacgatataagggcactcccaacctatagtgtccataagcagtgtttatggtgccatgtcaataagacatcacaatagaaactacactctacaacccatggtttcttaaaatgggtcattaataaatacatcatctctcttatctaccaatcatatttattcttcatctattatgaagacactattctctcccaatgtaaaacttgatagtgtctagtgcataggttctcgtgttgaagccgtgtcttgcatgagaccccgtttcttcctctcttcactctctctcttaattaatatagtgccacataagctaaaagtcctacatgacaatgtagttaatgccatagacaccatactaggtggagggttgggactgccctaatggatgcaatatcctcaaattactttccatgtataataatttgaagatgtcttataatttgatcttaagatattgttaaattgccattgcatatatgtatagtctgtttggtaaagctccaactcttaaatttagttttaggagttgggtctagagtggaattgagcctaaacccagctccacatctctagtttattttatgagagcgctccacccaactacacttatattttagatggagttgaaattgtttggctgagctccaactctagaagaggtggagctgaaactatgccaaacaagccctataaacgtgaacataacttatccacgcaaaagaggaatactcaatacaaacaccaattcaataaaatatactctgtaaatgatactgcaaactatgtacaaattttaaaagagtttagtatttaaaagactatcacatattcatatataaacgttaacaacatggcttataaataaattgtaaaacctaaaattaaattttaaattttgattcataagcataataaggaaagaaaagatgaatatttgtaaacaagaataatgtatagtactcacgcattaggccagtgagacagcggcgacagccaacagttgtcgggactgtcactccacccgtcacgctcatccgatcgtacagtcccttttcccgagagcggaagagggaaaacggaaaagaaaaaaacgcgcgaagagaaaaaagggggaaaaaaaaccaaaaccctagcgatcgcttcccccgatccatggcgccgccgccggggatcctcgaggtgcggtgcgccgggtgcggcgagaccctggaggtggagcacggcctgacggagttcgcctgccccgactgcggcatggcccaggcgctcccgccggagctcatgccgccgcgcccccgccgcgcgctcccgctccccgggcgcgcgagcgtcgtcccctccgccgtgcccgcccccgccaccgccaccgccgccgcccctcccacgcgcgtctcgtgcgggggatgcgcggccgtcctcagcgtgccgcacggcccggggcggttttcgtgcccgctctgcggcgccgagatcgcgcctccccctcccctcgcggccgtcgtctcagtcgttgccccgccggcagcgatcccgattacctccaatcggccggcgatgacctccgaggtactatccagaatcatttcctcccaggatttccctcgcaatgcatcgttgattattggtttcattaagtgtttatttatactagctcaaatgtgagcaatgtggtgatggtatctgttggccttttgctacaaacttgtgacatgtgaggtgaaactactttctataggttgctagtagcataaccatgcttgtattgtacattgaggactatgacctgtgtactaagcagtgagattaaatttgattaggaattctgaataagcatgcgtgactttactatcagatcacttggttttagcaaggagtcgctattgtagcattcctgttttaatctcaacaacccgcattttctcatgtttggctaaaaacgctagggatcagcatggccaatatatgggtaccccttgaccagttatagttcaactaaatatattgcatgtattagaaagctgtattttagttgacctaaagtagctcaatgagtacccccatggatgatccatgctcatccctaaagaataacaagtttaaaagttaccagcataaatggtcatttctcatttcgttcgaactgaatgtgtgcatttaaagaaagagtttacctatgcgcaatcatgattggtgcaattaaccagcattgttttttcaagtatccacgaattggaaaaaagtgatgtatttgattcagtcaactttggagaaaagtttaaacacttcaacatttgaataacaacatccctttgcccctttgacctttctattacttccaaagcacctgtggtaccactagtttaatgatcaaccatctataaataaataagtaaagattgcagccactatattctctaactgtcttgagctagaaattagcatgtttgttggatctgcacagttgattgtggtgcatcgaaattataactatggaaattgatcaaatatatattagagctgttacaagtcatgtaagaaatacaattatattggaagtttggaacaaacatgtggtatcattgatcaaagttgacagaattggctgcacttcccatggtgacactttatttagaccaatagtagtatttcatcacagtgtttcatggtgtttttcttctttcaggtgctgaatggaaattcaaatcagccaactcttgctggacaggttcagaagtccattattccagagcaatactacaagcattcttttagagaggagtcattcagttcattcagagttgactctaggacacaaattcctgatgtagggaggttacaaaacgagtgtgttaatccttcagctgatcgagaggagtcacgcacagaaccacctaacgggactatgaccaagcctggcaagaagaaaactacatctgcttctggtccaaaatctcatccagctggaaagttgcaggaagagcatattagtaaggccatccatgcatcaagggctcagggaatgccttcaaactctgtaggaggaggatttcacaatggcatgattgcagtgcacaacaagcagaaaactgggcatatagctgcccctagtgctatcgagcatgagcagataaacactctccatcaagtttgtgacaagcagcagcctggcgaaaattccagtgatttggttcatgtggagcaggtacaggtggcatgcaaagcagtacaaaccataaaaaaggtaccaagtatacaaaaggaaatcaaaagaggcaaggtaagagtccgttgaattattcaactgagttgcctcatcttaggcgtagtcagcgcttaacaaagggttcgccagaccctattgatattgagcctatccataggatatatgcttccccaaaccaaaatcaatcagaaactccaccaattgagagggcgatagatgatacttaccatatttcaccaaaccagcaccggtatcctcaatcagtctctaataagttggacaatgctgatgcaactactcctgctttgaatcatagtatgcaacaaaaggagagaattccccagtgctacagccagatgtactctccagaaagtaggtgggtacttccaaatcgtagttctaattcatgtcatgagcatgagatgcctaatgaaagctttgatgggattgtccaactcgatagtagtgatgatgaagtgcattcaattccattagagaaccaaaatcaggatatggatggccaactagaacaacaagcttgtgctggcaagaacctttcagagcatggcaggcaaaagaatggcttcattggttcttcaggtgatgccaaacatcatgggggcttgtcctctggaatgggaacacgccaccagatgaatttggctgcttcatgcagccgccttgctgttttattgccagttgcggatgctactccattgcccaccatcagctcaccttcttcatttgaaagtctgtctgtcccactctccggcatgctcaattgtttctgttgagtcctttctaacatgttcttccgcacctgtgcagagctaccagttaactgtagcagtccaacaacaccgcaccagcaccaccaaccatcccccatctattctcaggttcctccctttatctattcttgctgaacctttttatttttctttgggtgatgctgaactttattttcagtttgaggtctgaacgccagtgtgcttgaaaagtggaaagagcagacaaccaagtttctt

SEQ ID NO: 25653 - DNA, 18363 bp, Oryza sativa
gtgtgtgaaaccttcgatggaccggaggtggttggtccttgctaggggaatagatacttgggttgacaccaagagagatccaatattgcaaaaaaaaaaaaaattctaacatagctgctctattgcgtccatagatgttagtggacatataaatatgcctgctagtatgttaagcatgctccatttggaggtagtaactggtaaggtctcagcttttgtattcaaatttggaacctaacttgcataatttcttgaagcatcaatcgacgatatatgccaatcgctgaattcgccaatgtagctatccggcctttcttagctggagcacaaaacctaaccccagttcactcctgacgctttgcaggacacattagattccgtggacggtgaaaaggatccagcgggggaaggcgaggacgaccccgagaaccaggattatgatgacgatgagcattggagctgagccaaaacgtgagcttgtggtggcaccagattttcgtctcctcggagcacttcccggttgccagcgtgtaaatcatgtacagatttccagcatctgaaagcggttgtctcgatcgcttgctggtcgcttccccatacggcttcggagttaagactttttctcaccgtcgtgcgtcgccgtgggaggcaggcgcgtggtacgaaagaaagataccccccgttgcgctgcgcatcctcgctttcctgccggccacgctgcgtcacgcggaagctgtcgcgcgcggcgcggggcaacgcgacgcgcgactcgcacgccaccggcgcgcgcgtgcccacgcgttggcaccccccgtgagcaacgtgacgctaccaccgcctgcctgtctgcttcgcccgccgcggcttcctcccctctgcacgcggtgcggtgccgttgcctgtttttttttagtactccaactctagcttttcggcgtgaattatagtagtagtagtattttgaataggggtacgtatatattcttctgcgtatattcttgtgcgtaggtaggaaacggagtgctgagcaccagctgtacgctgagctcgtcaaccaattgtcaatctttacgaatggagtattttgcctaatatacccactaaactagagttgacccggtgaggccaaactgctagtctttggcaatacggttatttcgtgagacgcggctttgccaagtgttagatcgtattttcccgacaaatcatttctttgaacggtaatttacgtgacggactgacggtggtgtttattacagcacgggctgatcagttggtccaactgaaacctcatacccccatcacaacagctttgccaaattccgtaatgcatacgtatgacccgtcggtgtgtgcgatgcaactgtagggccagaaaagaaagaaagaaaagggagtagtagacttgccggtgaaaagccgcgcgcagaccaggcgatggagtccgcgagcgaccgaagcgggagcgaaaaaaaaaaggaaaagggaacgaaaaaaataagttaaacaagtagcagtgggggccccgcaccgcgccggccgccgagcgacaaaataaaattcagagactagcgaagtagcgaggcggatatccaccgatgcgggtgcgtgtggagtagagaaacctcgcggaggagggcgggtcccacctcccacgccgcagccgccgcagtcgtgtgtccgtccccatgcgtgcgtctccgtctccgtctccgtctcctggatggagatttgattggacaagtggtgtgtggtgggcgccgtaacggacggtgggccgcagtcacgcgctcggcgagcggggcgctttgcgacgacggcgacgtacggctcgcgcgcaacgcgacccgcgcccgacgcggacggtgggtggtgtgaaaccccgcggtctgcgcctctgacgtgacggccaccggtgctcgacgcgttagttcgacgccgcgaagaataaaaataggcttgcgattggccaggaaaccagaagctgagaattgcctcacgctgggtacgcttcggatactatgcgtgtcctgctcttttctaaccgctaaatgttgggggtttttttacgaaaattttctatataaaaattattttaaaatatcatataatctttttaaaaaattagaaaatttgaaactcgattaattatgtgcgaatattttttttacatgtttatacttaattttcatctccgttaggttcaagcgggaaagttactccttttcatataaaacccttacacgggacatactgcgagtaaatttagaattcttttttcaactatctaatcaatcacttcctctattgtaaagtccagagggatagttaaaaattaaaagttgttgtattaacggagggagtacatttttaagtggtttaaaccttttttacaaaccacgtcctacaggataagtttagtctggatttttcatattttgatccttttaaaaaacttatttcacagatagacccctaaaaaaacttatcacagaaatggtcctttttgggatgctagagtggctggcgccgtccccctgccgacgtggcggggcgatactgaggtggctagggggagcgcgccagagtggttggcgccccccctccccgaaattttttatttttcttttatttgtttgatatttttttcacgcttaggaacacacaaagaaccaatcatagaaaaattgaactcaaatggacgtaatatgtgacctatagaatttttcctctcctctttctctttctccgaactagtacagaggagagagatgtgcaacttttttatttttattttttttttgatattttttcacacttaggaactcgctagaactaaccatataaaaaataaactcaaacggatgaaatatgtggcctgtggaattttccaaagctctacgaaaaaacttctctcttcgaaaacacaattttgcaagtggaatttggaggttttaatatcttccgagtccgtatgagaaagttacacctattttaataaatgacacccgaatgacttttcggtagagctttggaaaattctacaagttacatattttgtccgtttgagtttattttttctatggttagttcctgtattatcctaagtgtgaaaaaaatatcaaaaaaataaaaaaaaagtgcatatctctgtactgtttaacttatggctatgatttcatgtggttatatttactaaaggagttatggtctaattttgatgaaagtaggctaagtggtatgctattttcagacttctagctaagtggtatattccgttcgagtttaattttttcgtggttggttgtatcgtgatcccaagtgcaaaaaaacatcgaaaaaataaaacaaaaacaaaaaggttgcaactctatatagaggaataggaatggaggcgaggggtgggaggagctgcgccaacatggctggcgtcctcctccctagggcggcgccctcctcctgacacgtcggttcgcgtgtgccacggtggcaggaggacgatgccagccactctagcgacctaaaaagaaccgtttcttcgataagttttcccagggatctatttacgaaataagtttttcaaatgaccaaaatgtgaaaaagtccattaagtccagctgcactatgtgtcacgtgaagtgctcgctccatcacataaagactataattatcgcattgataaaacaaaattattcagtagcttagggcctgtttactttgatgctaaaaaaaccttaccaaattttggtaaagttgccaaaaaaatggctatatttagtttgctgcaaaatttggtaactatataagaaatcttgctaaaattttggcaaagttgtcaaaattttggcaataccaaaatttggtaaggtttttttggcaacaaagtgaacatgcctttagttttttttaatggctaaataactgaatgattttgtgaccacattaaaggataccaacaaatatattattaaaattagattttaaatagattttcaataaaaaaatccatatgtagattttcttttgaaaaaaaaaatcaacccctaacttttttctaattcttgatattttggataaagttctctctccaattttgttgcgacagaccaacactagaatagcaattacgaaatttaaatactcctactaaaatcacactcgtttgaatgaaaggttccagaaaatcgattcgtgttgtcatggcatgctaattatatttagatcatagtgttataagatatagatatacaattttgctataggttttacgaaaaatcgtcggtgtcgtgtgataccggctatatccgcctctgtgtacgccgcctgcgcctcagcgtctggcagagaacagcgagagggaaaaaaaaagggttggcggtttccccattccaccgtccaaatccggcgcccgaagacttgtccggtccagctcgcagctccgctcgggtgcagcgtgcacgcgcaacaatacaataatcctccgcgaatctgccgtctacccgcggccgcctcagcccgccgccgtgccaagcaaggaagacgcggtgcagctacgtcgtcctcctgcggccgcccaccacatccatcgtccgtcccctgttgcccaaaaaaaacactttttttttccgcccacacctccctcccgtcacatcacgcgccgcgtcgtcgcccccctgcactgcgcaccgcaccgcgggccacgccacgccacgcggctcgcgccgcgaccgggacaccgtcggccccaccaccgcgcgcgcgctctcgcgctctcgcgctcgcgtttacgacgttacgtacgggggaggtggggataacaaaggcggcggccggtggcgttggccccaccacgcgaaattgcgacggttttgctgctttttttttttggtttgcttgtctgcatgtctcgttttgcgcgcgccgccgtcgtcgcggtggacggaattatgggaagcaatcagctgggtgcgcgacgcgacggcacagccgttgttggctcgctataccatcccttcaccgcgaaaatcggcgcgcgacaccaccattcgcttcgccgcctacctgacgcgaaaatacacggacctcaccccttgttgattccaccgatgggaaatggcaaaaagaagtaagaaaaaaaattggaaccaaacatacagattgagatcggatacggtcgtaagtgcgactgcaccttacgactgcatatatttttagccatttatttttcagatctcaaacattctaacgcatgcatgattatcaataatgcgaggacaaaatattataatttagaattaaatatgatattttctaatacaatgtatttggatagacagtctgtcattcttatattttaatacggaggtatagtacagcaccctgcgtcgtgccgttgtgcgtccaaaaggatcacaaggacaataggacggggcagcgcagcactcgaactaccaagcaagcaaggagcaagggaaagcaaccacacacacacgctaccaaatcagcaccgtcaaaggcaaggagaaaagaaaagagagagagagagggaagattaacgacgggacaaaccgcgggggcggcgcctctctctccgctccgctatggggtcaaacctcccctcccgctggccccgccgcacctccgcctccctataataccacctcctctccccactttcctccccccaaactccaacgcaccaccggcgccaaaccaaccacccaccatccaccggtcgaacacttggcgctctcgcccgccttagctcgctctgctcgtggtgctcgacccgaacaagaacggacatggctcccaggaacgccgccgaggccgtcgccgtcgccgtggcggagggcggaggagccggcatggagcccaggttccgcggcgtgaggaagcgcccgtggggcaggtacgcggcggagatccgcgacccggccaggaaggcgcgggtgtggctcggcaccttcgacaccgccgaggccgcggcgcgcgcctacgacagcgccgcgctccacttccgcgggcccaaggccaagaccaacttccccgtcgccttcgcgcacgcccaccaccacgccccgccgccgccgctgcccaaggcggcggcgctggccgtcgtcagcccgaccagcagcacggtcgagtcgtcctcccgggacacgcccgccgccgccccggtggcggccgcggccaaggcccaggtgcccgcctcgccttcgctcgatctgagcctcgggatgtcggccatggtggccgcccagccgttcctgttcctcgaccccagggtcgcggtgaccgtggccgtcgcggcaccggtgcctcgccggccggccgtcgtcagcgtcaagaaggaggtagctcgcctggacgagcagagcgacaccggctcgtcgtcatccgtggtggacgcctcgccggccgtcggcgtggggctcgacctgaacctgccgccgccgatcgaggaggcgtaggttgcagcgcccgatgacgacgacaagacccccccacaaatccctcgtagaaaagtctagagcgacgtgtaatagtaagaggttaatcgtccgtttaattgccaggattgatcaactaggtgtacatagatcgtgtcctttttgcacggggagataggtatgaggaaaaggctactactcccggtgttacagttcctttaaagaaagaaggaaaaaaacaagaaaagaaaaagaaaacattttgttgttcgatgtaacatattgatcatcaatctctgattaatgagaaatttacgttattttgttcttaaaaaccatttactgtggatgctttacccgtttattactagtatgtggcttcatccctgcaagttagcagcacaggcaactttgtttccagcacctaaccagatctgtgtcttgactcttgagggaaaaaggacttgagatttaccatcccagcttgtgcatcattaaacagaggaaaacaattaaaccggttttgtcgtctcctgtgcatcttaattgcacatcaaaacaggcagatgtatgtgcaaatcagctcaaacaatgactgctagtagtcttctcccaccgatctgaagtgtgtgttcgatgtacaagagcacgcgtcgttgaacggttcggcggatgaaattccgtggcaaaacaaagtacaagtgccccgctcctcctccccggcgaccgacagccacaccaccccgcggcccgcggaaggaaaggcttggagtacgacccggacggaggagacgcgcggaaaaccgcggcaccaacgaccatctacgacgacgtcgcttgccgcgggccccgtggagaacgagtccacccgtgcacaggcgtgcgcagcgggagcagagctcgtaggacgccgcgccgcaccgcgtcgcgtcgcccaggggagggggaggagtcgtcgtggtcacgctcacacagtcacacttgctcccacggcgcgacaaccacgtagccaaagccactggctatggcctccctgggcgcgcccccaccaccaccccacgcgcgtttgacgccttcctgtctcttcacctcgcttcggcccggggcaagctcgctaccgcagcgcaagctacgtacactcgcacgcacgcacacgcgcgacccgtgagccagtgagccaacgacccgcggatgcgtgggtccaccaccgcgcgggggccccacgacccaaccaaccgtgtggctcggatcgtgtttgtcatgtggtggccggcgtcgcggtcgcggggcggctagtcggctacagtaggcgtcctcgccttttgttccgcacaaggattggttggtttggttggttgtttggatcgatctgcgactgcgagtcgagccgcgagcgagctgctttgcttttggctcatcagcgccgatggttttcgcggttcgcgtaggtggtagcgttggaagctctcgcaagtttactatctcaactttgcgaaatttcggctgtgctctgtagttgttggcgcagtatctcaactagctagctggctggtatatttgccagagaattaagggacatgttggctgttagcctgtgagcttactacaagggtctataagttttgaggagttggataatctagagttttattccaactgaattacgagtatttgagtggttttctcaaggcatgattaaacggtctggcatctttttcgctctcctctccatctcatctaagcacatgttgtttgcgctaatgcttaattacatatctgaaggtgtgtttagttcatattaaaattagaaatttggttgaaattgaaacaatgtgacggaaaagttgtaggtttgtgtgtggaggaaagttttgatgtgataaaaaagttagaagtttgaagaaaaaatatataactaaactcagcctgaacttgattactagcttactgattactgattactgtatctacctacacacagtatgggtatatacatgggttgatatatacccatccatgtctctaacccagaaaaagaacagtaaccgtagaagggaggaaaaagaggaaaacaagagcaaagtctcgagtctccacgctccaccatcaaggcatcaactcatcaactccactggtatatcccgtagtaagagcaggtacagtagcattcataaacatattttaaagagataaataaaaaaaaagaagagcaacggttataacggttataaatctatagcacgaactctaatatgtaatgtgtgtatgacagataggaccaagtatcaatagtatagtaagcaaatattatatgaattgactatagatgatttcgaaatagtagtgcgctataccgttaaactggctctaagagtaataaattaagacgaagatgacagatcagaacctgcctttctgttccgacctcgagccggccagccacacaggacgcgtcacgtgtatgcacctgtactccaccacatccgagagggaggcagcgtcggcggcttcgaatctcaggcggcggccggcagatcagaataaaagtagccgcgcgcgcaccggatcacgacccaaaagccaccgaaaccggtggacctgctcgccgcgcgccgtgctccagcttcagacggcgtcacggcgcctaactagcgaggcattggctagcccagcccccacgctttccaccgggaaaaaaaaaagaggaatcccgtgtggtcgtgtcccctcggccagccaccagcgtacgtacgtactccaccactcccccgcgcgcgccgccgcctacgaaacgatgcacgcaacccaccacaccacacgtccacaccgcaatgcgcagctagcgggcggcaggtcaacattgtacgcatcgccaggtatgcgtgtgtccaccggtagtactagtagtgcagctaccgtgctcgaggagtaactaacagaatcaccgaacgatctctttcgtgcgccggaacgacacgtgcgtgcgtccggactagctgtgctcgatcgatcgatcgtcgtcgtggccccagcgaacccacgcgaaacctgtcacggcgccgcgtccgtggagattatttcctcgtccgcgtcgctgctgctgctgctgctgctgcatgcggctcgtccggtgctttgagccgtggaggtgcacgaactgccgcgccgatcgatcgagctcccgcctcccgcggcacgttgcggcgcacgcgcgcggcggaactagccatgatgaaccgctccgcgcggtctacgaccccacgaatcctcccacccaccgggttaaacaccgtaccgcgcgccgcgggtggccgttgttcgcgccgtcccacccactctcgatcacgcgagtgcgtgcggaaaacgcgcgcaggcctccacgcgtcgcccctcacccacgaaccacccgcacgaggcacgacgtgccgacgtgttggcacgcactggtggtggtggaggcgtggagctagcgagctggacggaacgaggagggcgtgccgaacagcgcggagcaaggagacggtcgatcggtacggcccattggtgcgaatcaacagcacacacagcccaaacagctagtacccttgccagcggccaaattttaaaatttgaacttaattttaatttattgttaaggtttttcatggtattttatttttaagaattagattttaaatcaaaggtgcaattgcaaaattttatccataaaattatattaggttctttcgtttatatttttttataacaatttattggttgtagctcaatcggtcacataacaagtacttcttcgtaccaaaatataacaatctaggatctgattgaacatattaggtggtgtttggatctcctaaagatgaagataaagattaagtgtttcacgcaaaacgagatggtaataacgtgtgattaattgagttttaattattacaaacttggaaaatagattaatctgatattttagagcaactttcatatagaatctttttgagagaatcccttatatgccactgaaaattggtttgatcccttatataccactgaaaattggctctttccttatatgccattgatccaaatttgcgcaccctctcatgccactcccatcagttgaccgtatgttgaccgttaattttaaaggaaaaaagacatatttacccttctgagtatagggcatgcctaacaactcagacatgcaaatatgtcttttttacttgagagttaacggtcaacacacggttaactgacggtagtggcatgagaaggtacgcaaatttggaccaatggcatataagggaaaaaccaatttttagtggcatataagggatccgacgaattttcagtggcacataagggattatctcaatttttttttgtaacataccgtttagcagtttgaaaaacgtgtcacaagtatacaaaatttcatccaactcttgttggagaaacgaacgcagccttagtatgaatatggtgaatagtggatatatcccgcctatatttacagtagtaggatagtatattttgggatgggggattactatggtagagtattttctttcgctatcgagaattaccgttgcagacatgcagtgatgcagtttcaagaacaatatgagtacagctaatgacgaggctcctaccttggtaagcatttcgtcagcatcgctaatccagtctcgctcggtaatcggtgtcgtatatgctcgagctgagcggccaagctgcccccgtccatcaccccaattcccacatgtcgcattcgatcacttcctgctccccaccgataggaacggttctgaagtctgaacgtgaatggttaggcgccggcggcagtcaggatcaggggtagtattgtgtcaattaatcgacagaaaccaaacccagctgtgtcagatcagaagaaacatcaggatgtcgtgcacttactatagaacatgtgaatactcttaacccaaattgtgacaccaacaaccgtcagattaactggaatgaatcggatcgaaaggtattacgagtaaaccgatatttgcataaacgcactgatcttttttccccctatctgaagacgcccagcagctctattttctttccctgccgacaattatccttgcagtttcatgtactcctactactccctccgtattttaatgtatgatgacgttaactttttaacaaacggttgacatttcgtcttattcaaaaaaatttatgtaattataatttattttattgtgactttatttatcatcaaatgttctttaagcatgacataagtatttttatatttgcatacaaattttgaataagacaagtggtcaaacgttggttaaaaagtcaacggcataatacattaaaatcaaaattaaaatacagagggagtactttatacagcaaaacaatcgaccatcctttccaccatactcgtcctacaaacacagagatcactgctactccagtggctaatgctgggcaccgatcttactagcatttcgtgaggatttctgctcctgtcttggtaatcagtatcgtgtgctcgaactgcgcggctaggctgccgtccgtcgtgacggccgtccagccgtcgtcccacatgtcgcaatcaatgcttcccatggatagggccggttctggacgaaaagagtaagagccactggcagtcaggatcagaggcattgttttgggagtaaaaccgaacccggttgtgtcagattagaagaaccatcagggtgttgcgtacctattgtgaatgtctggccttcaaccatttgacctggcatattattacctgtctcagagaaaaaaagccgtcagatctaacaattcttggagttatttgtatgcaatgagaagagaagatgcattggtaacattggcatgcagaaatgcactagctcttgattggtaacaatcacttacgctggtgatatatcattggttctgaatgaaatattctcccaactccatgcccaacaaaacgatccacaacaccaaatccgtgcctctcagcatgctcgctgacatgttaaaagcaaactaatgagcaagaaccatttgagatgtatttgaaatcaatcaaagtttgacaaagttgcagtaagagttcctggttatataccgttacagttgacttagtcaattgcatatttattcattaactaaaacacaaccgatgggtaaccaataacaggctgagaatgtttggtagttgaatgcattataatacaagttcttacgaagacataataacctatggattctgaagatagaggcaatgatgattctgtttgtacttgacaaaaacacttcttcaatttttgggttcaaatacctgagagagataccatttggtgcaacttaactagtaaatacagtataaggttgaaaagttctgcaaagaaaaacagaagtctagaatagcacatatggtaaaagtccattctccattggattatggatgcaactatccttgccctgctggccatgacacaaatatggtatgagatttttataccttattcttctgccaattttcttcaagctggtaccatgtttgcaagctgatatagccctgagcatgcactcttcagtaacctgacattaccgtcattagggtccccgattcaaattagtagacagatggttttgaaggaaaagttgccatcaaaagtagatattagctctggttatatgatcaaatgcaaactgagacgtaagcaaaatctcacaaggtaaggaaaaatgaacacaaatgacttctcactttggtgaggcctactataatcatgacttctaataacatgaactacatgtttgcaaagacaaagatatataccttcacaagtcgtttactggcttcatccacttctccacataggaaagtctttgaggtgtccccatgatagccctgaaatggaaagatatattacttcagatgatgatacgaatgaaggcgtgaaaacacatcaatggtatgaagtaacaactaataaaaaagagagtagacatacattcaggtagacagtgacgtcgatattaattatgtctccatcctgcaaaacagaaaaaaagaaatgataatgacatcgtcagtggagcaaggggggtgataagcctgaacatgagggaaaaaaatgactatgtaggcttctcccagaacctgaagttcacgagaatcaggaattccatggcagatgcattcattcacagatgtgcacacgctttttggaaaccctccgtatccgagaggggatggataggctccagcatcaatgatcatcttgtgcactgctttatcaatttcgtctgttgttacagagggctgataaaaggatgcaataaatttcttactgaagctataatttatcatggaataattagcttcaagagaaacataaattgtcgaaatgctgaaatgcaagcttactttcactaaagttccagcgtattcaagaacacgagcagcaagctcacatgcagctttcatgtgaataatgctcactttgtcatgcatttgtatctcacttgctatctctgaagcatcctttttaccaacgtaaggaggttgagttatgtgacctggtactggtagaggtggactcactgtcccacggatcagtggtgctcttttcttcacttgttccaaactttgctttcctcgtgacctttgagtttttgcaagtgttagaactgtatgaagaagatcatgaaggtgcagtggcactaatatgttctaggttatcagccactgaaccacatttcttatagaaggtaaagactcgacttatataggtggattttataccttgggtttgccttctccaatccctctaatctctttgcttggacaaggaaaggcttttgaaggcagctttttccttaaaaattagaagacatcaaacataactttgtttgtcgtttcccaaaaaacaaactttgtttgagtaatagaaagaaataatgtattactgaacatacttccataatatcgttgcagatgcagatatgcaaatgctacctataagaagaatcattgattttgagttacgagatgttctttctgtcacttaactgcattattagtttgatcatattattgattatgcacactgaaccactcagtctcctatacccattccattagcactaccaattgctcatagcattgttcagagttcagactctagtaacggaaaacataactttctttatctactcctcggattattcctgattcgtagcatcgtttctgcctttcagcagtaagagagagagagagaaaaaaaaaccttctccatccttcacagcattgttccagcaacactagtgactgattaaagcccctgactaaaccaaaatctagcacttagaatatcctgatattaaacccaaagttgtcagtttgtcacctcgcacagcgagacgctcgccgcaacaacagcagcctaaaatcacacgcggctgagcgagataaagtttatagaagtttcatgaaccccccacccatccagccaaccttcggcgatgccaaaatccgacgatatcgccatcatattgggagtgatgaatcatgaatagatacctcggacaccggatacggacggcggggggcggtgcagctccatggaagggactctcaccgccatcggagcgccactttggtggccggagcagccgcgcggcgcgaggagtgagagggccagaggttgaagaggataacacgggaaggctgcagatttttttcccccttcccttttcgccttctcgtttcggagaactttaatcatttgggccgtatcatgtttcccacgcacgtgaggcccatagtgtgcgagatggaacgggcttgcgacgtacgggtggcccattgtacatgggctgcagcccatataggttggcccactatatagtttccatggagtttgccccagaatctaccgcgctggtcagtggtcagggtcgccgtcgccgacgtgaggccggccacggccagcttcacggccacgacgctgagcgtggcgcccaggggcggatccagcataggctggcgggatctcaagcctctactactaacatgaacgtgaaaactatgagagccccacgaaaattgcactgaattttttaccttatatagatgagagggggactgtaactctatataatttgctcagacacctattcctttctatatccgtgatcgtctccgacaacgattgcaggcggtcgccctcgaacatgcgttccatcgtctggcacgcctcctagctcgttctcctcctccgtcgttctcaggtcggcggcggccggcggcggcattgttagcttcgccggaacgtctcttagctctccttttaaatttcccgcgctttctgttggtagcttcggtttgcttgcgttgagttgggtgcgtagtgtgaggcgcggggcgggagggattttatacgaggcgtggggatgcgaattggtttggttgctgcgtcatgttgtgacagtttggtagttgattaacgaactgttgctaacgatgttcctataaaaagtggggaaatgaactgtggctaaagatagctattgctgtcgtaccctgattatgtattttgatttgtttgttctcccagcgagagaacttccggtggctacttaaccttgacatgctatcatagtttcattttgtactggatcatgtctttaaggggatagtgtatatgctgttagtataaataagtgtgctttaagattttaccatgtataatttaaagaccaagcattcaacgggttaaatagaataccatcgtacaagtgactttgtcctataaatacattaaaatgtgttgttcatcccgtagcactaatagggggctgttaaaggaaccctaagcaatgacatttcttaggccctctttgtttaggcttaggcttattggactagacttttaagttagcttattgacttatatgatttataagccggtggatttaatgtcctaagtttagtggttgagtcatacatctacctcacataagccaaaaaagcttctccaacctagcttttggcttaatagtgttagagtgacttatggctttaaaaaagccaaacggaaaagctacttatttgtttaggcttagacttttcgacttataagttagcttataagcctaaacaaagagggccttagtcagggccacttgtacgatgatatttcataaaagttgcacttatcaatggcattttatggaattaagcgcttgttaattatatttcttgaattttataaaatatagtatagatataagaaaaaaaactattatgatccctcgatgggatatcctgtcatgtattacatgttattcaaataatcacgaatctttttttaaaaaatataaaaaatatttaacaagacaaaataatgtatgagatatcacttcacaaattttaagacgaagttgatagcgcaaaataggattagaccaaattaggcctataaaattcattccctagtccctataacttcctactcctatcttattatatctcttggatatagttggccaaataggctgcccagcatggcactggtcgtgcctgggccatggttagtcgggctggcacagcccgaccgacacgcaaggccgtgctgtgtcagcccacgtgcttcgtccaggtcaaaatagcgtaccttggatcgggccgcgggcctcgggtctcgggcctcggcccatataaccatctatactcctggaggaaaaaaaaataacaggcacgtcagcaggatgagttgagttcgtccagaacgttcaagccgatcacaccgatcacagcgcgagctcgatccaacggcctctgtctcgacagcaaggcagcgcacacaccatcgctccacgcgtcacctccttccacctcccgccgcgacgtgtcttcggacgtgtcgccccgctcgccttcctcgcccaccgcccgcctcctcctttacaaaaacccccgcctcccacacgcacgacacgacgcttgcacttacagctgcagctagctttgcccagttttgcttagcttttctctgcttccttcgatcccatccatgtccaggttgatggccgccatgctgctcggtggcgcccgcgtcgccggtaacaccaccaccgccgtgatggcgcttcatcatccgaggccgtcgtacttcctccctccccggccgcggctggcggcggcgagctggagccgcctccgcctgcagaccgcgccgagatcatcccaggtgcgtaccgttcgtccgtcgtcgatcgccgtcgccggtgagtgatgggtgttgttgggttggctggctgacatcaatggccgtcgtttttgttcggggtaggcgtacgacaactcgccggcggacgaccgaagggacgtcggggacaggtacagggacgccgcggaggaggcgaaggaggccaccggcgacgccaaggagcgggtgaaagggatggccggggaggccaagggcagggcggcggacattgccggcagggccaaggacgagaccaaggacacggcgtcgcgcgcggccgacgcggcgtcgcgggcgacggaccgggcgaagcacgaggccgccgacaaggcggcggacgtgaaggaccgcgccaaggacgcggcggacatggcgcagggcacggcgagggcggtgagggacaagacggcggagacggcggagggcgccatggacagggccggcgaggccaaggacaggacagtggaagggacgaagcacgccggcgagaaggtggcggagatgaccaaggaaggggcgagcaaggtggtggagacggcgcaggccatcggcgagaaggcgaagcaggcggcgcagggcgcgtggggcgccaccaaggaggcggcgcagggcgtcaaggacacggtcgccggcggcgacgt

SEQ ID NO: 25654 - DNA, 841 bp, Oryza sativa
aatgatcaatatgtattctggtggatataattaccttgtgtctgcaagaaatatatgatttaacactgtgcccatgtggtttagtggcttagtgctgaacagcatcacaagcatttttgttggcaaaattttgccgttgatttctgcatatgctggagtgaatatattacttttgatgataataacagttgaaaaattatgcgctacgcctacgctacgttcgtacctctgatcgaatttgaccgggaaacctatttgcactaatggtcggttcggagttcggacatcttccccaagcaggccagccgagccagccgaggtctaaagagagaggcaaggcaacccggtaggtttccagattgtgcagcgtcttgggatttgggaatcttggtgatcatcggacatgtcgaagcgaccgctgtcttcggtgctgctgctcctgtcgcgcggcgcagcgacgtctgcatctcattttgtcctagggcacccgcaatgattatctagcttagagcaggtacaatggcggactattagctagctataaacatattttaatgagataaaagatgagatagaagagcagcagccagctgtagcacggactccaagatgcagtgagtgtatgacagtgggactatatagtaactaactattgtatgaattgactattagattggctacaaatgaattagagctagtagtggtgatgtgaccatcaagtatatgcatacaaccaagtatgagaaatataaaacattgacaaagaatacattggatgaatggaggatctacaagatattaaagtccaatgagttttggaatccaatttggcctccggaga

SEQ ID NO: 25655 - DNA, 6914 bp, Oryza sativa
aacttgggccttgcgccttgtaatagactaggcccatctcggaagtgtctccctccacctccacgaattagcacttaaccctagctttgttttcctctataaatagctttgtacatcctcaaaaacaattgggttttgtttagttgaattttgccaagtgccattcaccttgtctctagtcctcgctcgattagtcggtgactattgattcagagcccccaatagttggtgtgttgatttgctgggtcgattagatctaccacttcaatcgcaactattcctttgtgcttaattacctattcgcaatatttagattgcatcttatcttgttcttgcagtgttctctcgtttgcattgcagggatcatcaaccgcgcgtcacggttggtacgacatcgtttgtggtgtagcgattgtatggcgttctggacttgttctggttggtagccacgtcgtaaacgtcgcactcgatcaaagtgagagttatcccctcactagaagatcgggccacgagagagagcgtcatcaagtgggctacactattaaacttgcttttaggagccttttgcatgtagttgtattgttattatcgaaaatttttagatacacggtactctattttttttatagcaacttttagccatacatctaagcaattgcttgtctcatagacgtatataaaaactattatattttagggatgcagtgccaatttagagctacaacatactactcttcttcaagttctcttctcaatgtcccttctaacaaaagttctcttctcaataaaaagaagtgcactaaatcaagagtacttaataagtatagtaagaaccactgtgcactaaatcaagagtactccttaatactccatccgtcccataatataaggaattttaaaaggatgtgacatgttctagtactgtctagattcatagtactagaatatgtcacatccattcaaaatctcttatattacgggacggagagagtaactaataagaaccaccgtatagcaagagcagcaacatttgttcgttcaataacataacaaaggtacaaatatcaatatgtaatgtaaatttcttgggagacggagcatgcataaacaatataccatgtacttacctgttatgatagaaaaaaaatgctactcatcatactccttccgtccaaaaaaaaattagcctagtattaaaatgtgacatatcctagtacggcgaatctggacatactttatatccagatttgtgatactagaatgtgtcatatcttagtactagattggcttttttttagacagagagagtatgcaagtttcaaagctagcaccaatcaaaactagcaggagtagtcaagtgtagacgagataacagggaccaattaggaatgatatacaacactgaccatcatcatgacgtggtttgcaagaatatttagcctaaaaagctcactgaaaaagaaccagtaaaacaacgttattttccttccaaaattaaaagggtcatatttgccatctaataattacatttacttatcaaaactaaagcacgatccaacctacaaattatgataacaagaaacctaaaaaaattacaggaaatcttctcttataatctcatctactcgttcatatgacacagaacgcaaagatattacatgttcagctcatttgctcattcaaactaggatgttctagctcaccaattaagcgtatccggaatctgagtcaagctctcatttaccccctcaaacttcgatattccagctctccaattacatgatatcctcttaaaaattggataatgcccctggaaacatctcttcttaaatgatgtaatatattttaaaattctggaatagtacttctctggtttattcgttgaccgactaatgtattatcatatgatttgcacaatgccgaagtattgaagtcaagcctctctcttatttatcttttatgtcatctattgatatttgtatatctccagaatagattggttgtgttcagcagttggcaaccaatttttctcatcaaatctcatatagcttactacttacctactttactttacttgtccagagctcattgttgttagtttgttcactagcatcctttggtgttacttgtggttcatcgtccattttatttcttctttggttgtactggcatttctttcataatctctgctctattttttttctcactactgcttcaatatatttaaatcgcttctgatgtgtgatagttggatcaatagctttatggatcattccttatatgagacaaccaatcctctaatagctcatttttatgggatcattccttatatgagacaaccaatcctccacgttctttgcatttagatttaggtatatttgtcttaagggtttggatgaggctacaaagttttagtgcatattacattggatgtttgcacactaattagaagtattaaacatagactaatgacaaaacccattccataaccctggactaactaattcgcgagacgaatctactgagcataactaatccatgattatccctaactaatccatataattagaagtattaaacgtagactaatgacaaaacccattccataaccttggactaattcgcgagacgaatctattgagcctaactaatccatgattatcctatgtgatgctacagtaaacatgtgctaattatggattaattaggcttaaaaatttgtctcgcagattagctcttatttatccaattagttttgtaagtattctatatttaatactccaaattagtgtcccaacatcgaatgtgacagggactaagtttagttcctaattgttacatttcagatactatttttaaccctagcactaacctggataataccaggaagagggtagagaaaccgaaaatgacccatttattcattacaatcaggctgtccatatttaacaagaggaattgaacaacaaagtcgattaagaaaatgttcaatatcattttttaaatgatcttaaattagataaacccacccacttttttttcttatttaaaatgatagtcttaaattaaaattagagaaaacatattttcatatctttctttcaacagtggctcaactttattcatgattctccatacataattccatacaaaaattcgatacaaaaaaatctttattaaataaattatttttggtggtataacttaaaatcaaaaaacctattatcaaatgaattattttttttagaaataatttaaaattcaataagaatattatcaaataaattatctttttagtaataactttagatctaacaagcttattattaagtttttcagaaagaacaatatataacttttttttctctaccttctaaaaattatgttattttttatttatgcttctcatgtttatctctctttctttccttacttatgctcatatctcttttattggtgaaaataggtaccgcgctatgaggagatgaatatagctttattcaaatttatccataaaatacactttcaaaacattttctcaaatccacgttagataaggctattttagaacctagctttataatataaacttgatggaaacaccatcgtccctatatacttcaatcacacaaaacacaatactaagcttacctctcttttcattgcaaggaatcaaaaaacaaaagaggtttgaatagaaaaacaattttagatataaatgcaacacattccataaaatttacaaggatgggagacaatacccgtacataatttaattgtaagaattgaacattcacgaatcgagcaatgaaaatttaaactctctaaaaaaagccctagagactcatacaaggagcaccatatactttaggtttgatcctctatttataagctaagttcgatagaaacccaataaaaaacctaaaataatagcaggctataagttagctataagcatatgtggaggtgagaagggaagagaagagtgaagaaaatcgggctacatatttgtagccagttgcagcataaactctaacacgttgtgttatatgagaggtgggaccatatattaatggtttacagattataataactattatataaatgagctattagattagccatagataatttgaaactagtagttggctatactattaatcttactcttagctcaaccgagggaatactacagatggctgccacgtcgcctggcagtaaagccactccaaggcttcggtcccgtgcggcccaaccggatagagacgcacgtcccagatccgtcccacgcgccctccgcagggcccacgatccgtgtcgatgcatgctatccgcgcccatcaccacgtgtctcagccgatcgatgccgctgtgctgccgagtgccgaaccggacaccgcatgccacgtcgtcgtacggttcccgcccgctcctcccgcgcatggcaagaacggacagctggagatcgcaggccgcatggctcgatcgtccaagccatacaaggttgccaacaaaggtttggctgatctgtcaattgaacccgtcgcgttttggttgtagcatagtatgtatattcagggcaacccgtggcacgatacaaacatggcaacgaacaagcaagtacacctcgttagcaaaatgttggtcgaccgtccacaaacaaacattcatgactaatcgaagtcacagactcacagttgtatttgacacttacatatggatcgacctgaacctataaaatatagtggtaaagattaacaaaatgtggcgtgacactggaccttgcagtcacactaggaccattggatgtaaatcaaacgggcagataatcaaagatactattcaaacaaaagaaatactgcatatttactgtagctcctgtgttgtagcttcaaaccctccataagaaaaatagatgaccaagatcacatgcagttcttgtcttgcagtccctagtataactgcacgtgatctcaaattcgcagtagtgaattaaacaccccttaacttcaaacttgtgcgtgcacatttttgggggcatgaacctagaaaaaggctttattatgtaacaacaattgatttcgaagactgaacaatatcacccttagcacattgctggaaatgttcaattaacaggggaacttcgtactcagcacagaaaaaatggtatgacaatacaatcacctcatcaattcataacgacttcggtgtcgttaagtctacagccttttgtctcaaaagggaaaaatgagacagccaacccggagaggaagattacaagctcaaagagaaggatcgctgtcgtctgctggcagctgtgtactagagcaacagcgacgagaggacagaggatgcctccaatcctacctacagagctcgccacgccaattccggttgttctgacagaggttgggtaaatctgaaaattgaagcaaggagaagaaaacagttagcattaacatctgatcttccattttgttgtcacgatgatgaaatgaaaacaaattatgtgctatctagtgacactgaactactgaaccatgtgaggcagcagaactgaaccaacctctggagcatatatgtatacaattgtaaagctagcagatatgcaaagccgggctccaaatagggagactcttgttagtatatccgttcgggagaaaattagtgggaataagaaaacacagcttgtgaagagcattgatgccattgacagctttctaccaatcctatccacaatcatggctgacaaaaatgatcctggaatctctgtttcaagaaaacagagcagcattcgttgttaaaatgggaatcatatgcactggaagaaaattaataatgtacagaaaaaacaaacctgcaaagctagatataaaaacgtttttgtataagcttgcatcatttgagtgtatggattcaacctcctcttttgcacatatcctattaccgttacttaactccgatgtgagcagaacaattccataataggaaaatgcatttccaaagaaagtcatccacaggagcagagttgcacgtatcaattttggcgacagcagcttcgcgacggacaaacctccaaaactggaaactttgtcttcaatgatggtgtcatcttcttcagcatcagcaagaagtgttgtagactcagatgttgaaagttcatctagctcaatgtttttgtcagatacaagccttccagaggggagctgtacattgttcaatctagccattttctccagtacatccatggcttctgttactctgcctttcatgcataggaaccttggtgactctggtgtaataacataaaataaaagcaggacgaaagatgggacagcagataatgctagcaaccacctccagccaaatttgggcattactgtctgcaattagcatgatgaaaagatagttacaataatgacagggcctaaagatagttacatacattttcacaatgagaatgtaggcttcattgaatgagaatgcagaacagggcactttcttattgacctttgcataacccaccaagtaaaagtacagatattccagtttaaaaataccagggaaaaatatcatacccaagcaagagaagcctcgaagatggtcccaacagtccaaaaggcagaaaatactaccatccaagttcctctagttggagcaggaacaaattccaagaaccaagatgcaaggacaggtccccctcccaatccaataccaactagaaatcttagagaaattagtgacacatagttaggtgcaaaagcactgaggaatccagctccactagtcacgatggcggtaaagagaaatcctctcctgtaaattacaaatgcaacagaatgtatgagcctgtgtgctgcacaccaagaggaatatatcaaggtagtgtttgcaatatcatgaaataagcatca

SEQ ID NO: 25656 - DNA, 20568 bp, Oryza sativa
agttattgagactggaccggtaattgaaccggtgaggctcttggttcgatggttcactggttcaaccggttgaaccattggtctaacccggttcaatagttattaaatatattactcattcctttcaaacacaacaaggatgatagcctggtggttggtgagggctctttttccctcattttcccccgactgctcccttgcatgcacccactccctcgcaaggccggttcaaccatggttttttctccggttctatagcggtttttcatgaaaaccggacagcctaaccggtttataccggcttgattgcatatccggtcttttaactggaccgaaccggcagaggctccagttctggtttttcccggtccgaccgccggtccggtccggtcttaataactatggctaaaactatcaactggaacaagctgtgcatggaaacaagttcacagaccatcttttgtgacccattgctaagctaaagcaataagcatcaccaagagatcaaattattatgcataatgtgtgctagaaaacaaaatcagtgattggagtaaaagatggacctgcctccttccgtagttgtctgaaactacaccccaagtgtaagctcctattagcattccaacaaaaacaatgcttgtaatcatgctttcctgatgtgaagtaagcttccattctaactgtactgatggaccaacaaatgatagtagcatcatctccattgcttctgcaatcaagccgaccccggcatatgaaagaatcaatatttggtacctcccaaaacctgatgacagaagcgcgtcatcgacgctatacgtggctgattgatcctcctccatctgcaaggcaatgataaaatatggttattctttcagcagccagctgattaatcttcctgacagttcttgtatctaaactgcagaagcccaaggctgaaaacaggaactcgaatcctacatttttcctgtaattctgcctgttcagtatccgcacaccatttttcttttgctttgtaaatctagtaagagtatatgttcacggttaatcatccatggaggacagataaaactgaaaaagaggaaaaatctcccttatctcactctgcaaaacaggtcttaatcacatacgtactgttacatacacacacatataactaaagagtaatgaaggattcataagttccatagcagtggcggcggatctaacatgggccaaacctttttgggaaccatcaaactgttattggtattaaggttaaggcaaatttctagaacagaagctagggttagcgcaaattcgagaaaaaagtgcgtgggtagagagcgcgatggatggggatcggcgcaggcggcggtggcggaggatgtgctcaccaggatgcggcggaagcaacgacggcggcgctcgcgggatggatgggggatcggcggaggcggaggcggaggcggaggcggatgattcgccgatgctgtccagatcccgactaatcaaagcggtggatggagagaacgagcgatgaaatggaggagaagaagccaaagtcaaagccaaaagccaaaagtcaaagtgtgtctcgaattcatggatgcggaaaaattagctctaaatcctcccagattccagagataagcgcgtggtttgaggattttgccagccttgaattgaaagcgcagttttagacaatttctttcagctcctttttgaccggagctttgtgttcatgtgccatgtgcaaacccatgtggagaatcccttggaaaaggtaggtggtatatccatgtcaaaaatgttgcgggctctgtgtgcttgggcttatgtgagcccaaatagaggcctttaggggatatcggaataagtccactttgactcccttaaatgtgaccccaatctaatatatgtgaccttaaccgcaaaaccaaatattatggcccctcagctgttaaaaccggtgtaatttaactctctcagcggtttttttacgacacgccaccatcgtctcatcaaacctccgcgatgacgacgagaacaggggcgatggtctccaccagctggctcccgccgcggaggcaccacgctactcgacgtcatacagcgtcggcgaggtggttgtcgcgaaggaaaggagtgccgcccacggtggtgttggtggcgtcatgacgtagcgccgtggtggtcgaagacacgaaacggaggtaggaactaggaagcgccgctcgcggcggagtaggcaaggtggccaccgtccctggcgccgtgaggtgtggccgcggcgacgccatcgttgccaatcgcatacccctcgggttagacagcgtgggaaaaaaaaaagaagaataaagaaagggaggagacagaaaaaaatgtgatgctgacatgtgggtcccacatgctaagtcagctagttgaaccgggtcaagacgccatatcagcaaaaccgctgagggagtcaaattacaccggttttaacaatttatgggtcaagatatttggttttgcggttcagtgtcacggattaaattcgggttacttttaagaaagttaaagtgggcttatttcggggatatctcgcattatattccggactaagttttaaggcccaatagaacaagacgcttcttttgatctaattttttcgtttattcatgctcattcgaatcgttactagcaaataaagaatcgtttaagggtaaaaattttatatagttgtcctcagagactcaaagtaatagttgtaaaataaactataatgaaaaagccaaaaaaacaaattcaaaatcaaattctaaaatttaaattttggattataagcataagctaaccagtgtaaaacaaatagtgtaaaaaaaatcaaacttcgtgcttgtgaagtatcttcagaaaaaaaacagtgtaagaaaaggaaaacaaacagtgtaaaaatgaaacaagcactttggtacacaaaggtgcttatgagataatattacagtgatggtattggcatatacacgagctgattttgcgccaaatacatcagcagatggtactattagacagaacaatttcccctgcttcaatagatgtgcactatccatgtctgtacctagtgctgctaattaaccaacaggcgacatgtgtaattaacgaaatgatcggaacgacatacgtactagtatatgcatactcgatcgaccaaactcccaaacaataaacgtcatgtagattaagtacacgataagttgtagtttaacgaagtgcacctactcaatcgatctgtactgcttaattggttacgacttgcaagcaagcctaactctctctggaggcaattaacctactatctagaccacaaaaagtattgcacatataattcactacctaacaatgtccgaccgtaccgatctggtaatgcatttgcttgcatcagagcatcatcgacacacctgcatctgcatgcccttctttcctacctagcttgataagcatatacacatctggctaatgcatgtaaggaagtgatggcatgtgtgtcagtgagcaattatattaattagcatgttatgatctgctctgaccaacttcaggtttaaaaacattgcgttggcattgagcccttttcttggtgatcttccaactgaacccaatatatttgcctgttacatcttactactaggctttgattgacaagaaaggaaggggttcaagtgatgatgcattaccttgtatataccttcttgttgcaactagagagattataatctcagattaattaatattagcccactccttaactagttgagtgtggttgcttgttacttcggcactggctttctggtctctttgctctgaccacattccttcttcaccttctgttgaaaagagcctgacttcctgccttcccggtcaccaaattatcttgttttttcatgtgcgacgttttcatcagtgcatgcaagatgtaacctgtttaggtggtgattagctcaagcatcgtgtcactgtggttggtaggatgtccatgaacagtggactgaaagatcagccatgcatgcagcattgatcagaagttcataaccactttactgagacacatcaagccctaaaccttagaaggattaatcgaacaagacctaggaaatattcctgacctctgcataactaatatgcatcatcagtgaaacagaggaaactatgattctctgctacatctattcagcagcttcagtattcaccagcaggtttgaccgaggtcaactgagacaaaaaagctgcagtgcctgaacttgatggatggcgccggcgcatcaaaggtgtctgcgaatgtgtaatcttcctgtaatttgctccctagatgatccacaagatcacaagtaaaagcagtatagttatcgaggccgacttcatcaggatgcttaattagctcgtggaatgatcgtcgccgttgccgtttttcttccaaacctgatcgacggcagtttgtcgcctgtgcaactcgtgcagtttgtcaacaagattcttcagatagctagcttaggcaatggtgcgactaagctagcatttcttcagattcttcagtttgtcaagtaattacttcttgcttggttgactgatgaagtgatatgattgtaagtttgtaacactcccaattgagcaatgataatgacggagttaatccttttcaggaaggcttgacaaatgcttttgttgctttttcgaattgataataatgatgatgagtaaggatggtgttaagctacgtttaaaggcttggaaggtgttgggcgagaaacggctgactacagacatgcttggacatgcatgtgaggacatgtttgttggtgaatggtcatacacacttgcattacaggttcaaacggaattaattaggcttgaaaacgcagaagcttatacttctgcaaaattgcttggctacaccctacgtccacaaatataacaacatcaacacggtcttcaaattataacttaaacaaatattatttgtaaacaccaattattttacatagaaagggttacatataagatatactgttccacgataaatctagtaacactattccttaatttttgttattgacaatcaattttaaagaaaagggtatatttgtgaacagaaaaatgtagtttcttattgaaaatattgtggcgcgcttatatatgtactccgtacccagatatcccagttaaatggatatatatatatatatatatatatatatatatatatatatatatatatatatatatatatatttacgaacgcgtaaaaaaattgcacgtcaatatattagaagaaaagagttatagttacaccacgcaatcggccagactggccaatgccaggggaaaggagaaaaaagcaaaataaaataaaaaactgaggcttagaaaaagaaaactacgacggctgaaaaaaaaaactccgcaactgtaggaaggggctgagcggcgtgcacgcggctaattaacgtgctgcgatctcttaatatatgcagtacaattttgacggtcagtaaaactggcaaccaaagtcggtcttcaaagaaaaactaaccaaagggtctttcaaaaactagcaactaagctagtccatacgctgcatttttccagataccttccagggctctccactcatctggaccagaccacaaatctcaccatcatctgttactctccgtgactccgtgtagggtatagctaatgtttttttttcctaccaacttacaattctaaactaaatgaattgtctgtttgtgcatgaaattaataatgacgtgcaaacatcgactaaattttttccggcgttgaactgattcatattactattacattgttaatcacattgtgcaaattgaaaatgactagaacagtataaaaaaatagtgtgaatggcattgatttctgggaaactattttgatccctcgaggtaatatctcctcgttatttgcatgtcaatcaaacggttatgaaaaaaattttaaaaaaagagaatatgtattaacatggtgatattacactacacaaatatgtaagtttaaattcaacttctacatttcgtaacgaaaaaaaaacaaattaaaccacagctagttaatgtatattcacagtcaacttaatttaaacttgtatgtttacaggggcgatatatgatatgttaatatatcttcttattttttttcaaattttttcataactatttaagtggcataaaaacaacgaggagatatcccctcgagagatcaaagtctacttccttgatttccggcatctcctttataaatagaacatccatccatgattcacactcaaaccgatcaccaaacatttctcgacacactcgcgcgcgcaggtacacaaacatggtgcacgaggctatcaatggacatggccacgaggtgaccgtgaaggtgacgtcggcgtcgacggtggcgccggcgctgccggtgcaggagcaccggctgccgctgtccaacctcgacctcatcctgccgcccatggacgtcggcgtcttcttctgctacggcgccggcgagggctccggcggcggcggcgcgctgctgccggcggcgaccctcaaggccgcgctggcgaaggtgctggtggcgtactaccctctcgccggcgaggtcgtggccaatacccgcggcgagggggagctcctgtgcagcggccgcggcgtcgacttcgccgaggcgaccgccggcgacgccgtgctgcgtcagctccggcttgccgtggtcgacgagagcgccgagaagctcgtgcccaagaagaaggctggcgtcatgtgcgtgcaggttagcgtcacgtttttttttggattttgctattttcgttacgacagaattttgtactcctatttttttaaaactttttttagaattttgtactcctattttttttaaacttttttttagaatttttcatcaatattcgtattcttgtgtgtacaacttatagttaaaaaaatagtttctcaacaattgtttttctaaatgtatgatttttatatgtttattgttttattttgttattttatttaaaacaggttttttttaagataatggaataaaaacatcccggcctttgttcaaaagagctacagccaattattacagtctagcactctcgaggagtaaagtccaaaataaagcaatcacactaaataaaagaaggaaaggcaaacaaggcaaggagaacattattccagtctatcggtgaatctccatccatagttggcaaagagttgcataaccatcgtctcaagcgtacggcatgcaaccaacggcctcatcacacttttgtagctgagcccttagccagagttagtatgttgccctgaaaattatctgcatataggaaacatatagtgatttgtcaaaaaccctatcattcctgctcaaccacagaacccaacataaggcagaggctcgaatcagtatcagtctactctttttcttatcaacccccagaagccaatcataaaaaatattatatatgttactgggaaggcataatccaaaagaaaactgaattgctctccaaataaactttgcataatgacattctataaataaatattcaatggtttcattttttttatacagaaacaataattcaagttgtcattctaatttcatcttgctaaaatctaccatattcgaagccataaatccactgaaagataaatacgtagtctttcttttaagcgaagaggcgaagcaaaatgttttcgtcgctcgtacagttgcagcaactgcacacgtggctgcaaaagtgcaagattaaccaatacaaaatctgtcagcagatggatagctattccgttttttgattgatcgtatcggatccgcacgtgagctgcaggtgaccaagttcaagtgcggcggcgccgtcgtgggctgcaccttcgaccaccgcgtctgcgacgcctactccttcaacatgttcctcgtcgcctgggccgccgccgcacggggcagctccgccgcgccggcgccgtccttcgaccggtctttcctcgcgccgaccagcccggctccgccgtgccccgacgcgctctcggacaggctctttgtccccgtcagctgcgtgccggcgccgccgtcttccgccccggaggccgccgccgccgccgtcaaccgcatcttccgcgtggccgccgccgacgtcgcggcgctgcaggccgcggcggggccagggcgcaccaagctggaggcgttcaccgcccacctctggcagctccacgccagggcggcggcgtccccgccgcgccaccgccgttcgtgctgcatgggcgtcgtcgtggacgggcgcacgcgcaaaaaacacgacggcgccatgggggcttacttcggcaacgtgctgaccatccctacggcgccatgagctccggcgacctgtccgccatgcccctcgcggacgtcgcgggcgacgtgcaccggtgggtggcggaggcggcgacgcgcgaccacttccggggcctcgtcgactgggtcgagcagctgcggccggagccgtcggtggcgagggcctacctgggcggcgacggcggcgcggaggcggcggcgtgcgtggtgtcgtcggggatgaggatgccggtcggcgaggtggacttcgggcgggggcggccggcgttcgcgtcttaccacttcccgtggccgggcggcgccgggtacgtgatgccgatgccgagcgcgcgcggcgacggcgactgggtggtgtacgtgcacgcggcggcggaggtggtgaaggcgatggaggaggaggagaccaccgtgttcagggccctcgagtcggactacgtgttcggtccggtgcagcagtaaacacatgcaaaaacacaataatacacacggtaaaagttgtgcccgggatggcaccatcgtggcatcacaaacatctgcgtgcgtgcacatgtgtcgtagtaactgtaagctgtaagcatttatataccgttttgtactcctcgtaccgtggtacgtatggtatgttgtaaattgtaagtttgtaacggtcttgttgcattgcttgtacaaaatggaaggaaattgttatgcttactatccaactgttcgacttacgtacgactgaattcaaccaacgattaatataaaatgctccattttaaccgatttatggttgtatgtctctggttaacaagaccatgggccgacctgagccatgtctgctgctgggccatgtctattggcgaacatgtcgggccgacacgggaaactattctaattcctcgaggagatgtttcctcgtttgcttaaaaaccatctaaacagttataaaaaattctggaaaaaattgacaacattcatacaacacatatatacaactccacaaaatcttaagtccaaactcaactcacacgtcgagatataaaaaagacaaattcagcgtatgaatagtagcgtactgtttatatctaaatttgtcttttttttcttgatgcgtagatcgaatttgaacttgaattttagtggactagtatgtatcattatactctacattgtcaaattttttcagaattttttacaactatttgcatcgaatttgaaagaaaaagatatacgaggggatatcccctcgagggattagaatccactcccgggccgacacctaatctgggctcaaagttcacgcatggtccagtacgttgccctgccccaaacccgcgcgccggcgacttgacactgcgccgcgcgtctaattattcttggatggattcctctcgttttctcgttgcataaacatgcacggagatgggacaaatcaagaatcaacctaaggcagggagtactcacgcctgaaatttgcaagcaagcaaaattttaaaatcaaggtttgctggagctgagacctgagcatcgtgcacttggcttgtccacacacaccgacgtcgtactgaactattagttgataatagtgcatcgcgcattaatgttcacgcaacaaaggggtgcccaaagctgcgaagcgagcgcaactcaagatttcttgtgatgaaacccattcactcgggttcaagttaattatagattttaataggggtgttcgtatttatgactaattattatttcagtggtaaacgacgtactcgttgacagcgagatacccatagtgacttcattaatctcaatatatactggactagtctttcgaaagtgttcataagaataaagtgtacgtgtatatatttataggggtggatacagggccgtcttcagaaatttggggccctggaacgaaatgccaatcgaggccctaaatttaagaaaaattcatatatctaatctaatatatgagggatgattttagctttagtatgtattatttcgtgcaatatttacaaatatcatcatctgtatagtgttttttaaataaaatcttcaattgttcgtaattaatattattgaagacatcattttcagcacctaaatcatgatgaggtgattgacgaaacaaatctattctatttttaaacaaaagcaaagacatgtgtttgattcaataagtaatccattcaatcgttcgtttactcacaataatgtaagggactgtctatatatcatttgacagaatactccttaaaaatcttgtaaattttgaaccaccctattgctttaagatttgtacaggcaatcaaaccctaaaaaaactctcctttcccgattccccctcacgccgccccgctcctcagcgtgagcacattctgcgccgccgcccggcctcgtcggctggccggaaggtgtcaacggcgctggaaagggcccccggccggcctcctccccctcatcctctctctcccacctcacctccctactcgagctatcgaaagtgagatgctcccaacccggcgtcttcctcgtctccggcgactcctcgccaccggatctaccaccataagctcgctatgcccccgccaccaacaccggcccaccaccctactccgtcctcgcggctccgccggcgcctcgccacccgcccactccgacgcctaccgccaggccgctacttcccacgaccatccctcttagcccagcaaactcccccttcttccccctccccctcccacccctccctaccccgggaccctaattcatcagccctctgccagagtttgggttgtcgccggtgccggagaagaagaggagttcgccggagttagagaaagtagttggagcacgaatttataaattacctaatgaagtgattagtgaaactagcaggcggcagtcgctagacgttgctttaggctcggcctccacgctcgcctccagttgtccgcctcgccgttggttgctgcgatacgtgctaccgccgcccgcccgctcgatcgcaggctgccttcgccgtcttgacgcacgcacgtgcaatatgtgggaattatatgatgaaaccgctccttcgtttatgactcgtgacacctcgatgcacacaactaacgcatgcgatcttcaatcgcttgatgctcacgacgcatcagttttgcttctacccaactctccccgtcccataaaaaccaatctattactggaggtaacacattctagtattatgaagctctcattagcatatcgccaggtatgtggcccaccctaggtggtggcgtgggccccccaaaaattggaggccctgtgcggtcgacgggttcgctctcccccatcgatggcactgtgtggatacgggtgtgttgtgagcgtatattttgtaccgtgtgtttctttaaaaaaaaattgtcctaagctaaaaattaagggccatgtgcggtcgacgggttcgctctcccccatcgatggccctgcatggatacagatatgttgtgagcgtctattttgtaccatgtgtttcttaaaaaaaaaattgtcctaagctacgagctatagctagtgacaactgaccagcatggcctgttcgtcgaagccggccgtacgtgttttgcgtgctatggactatggtagcctgttgcgcttgcgcgcgcacctaacgttttgtgcgcgtgtgcatgcgtgcgacggtggtgtctgtgtgcacgcgcgcgcgtgctttgtgcgacgtttcgaagggacgtgacaatgagaggaggaagagtacagtggacatgcgtacgtacaaactgatgatcgatgcacacagatcagattttacatgcagccaacgggtgcttgtcagtttattacgatggtggagatattaatagggatgaaacgtactactccatcctataaaaaagcaaatcctatctacgaagaggaactgaagtagttgactgtccgtgctgactgacggagaggttaacaccaagtgaagcaaaagggtcgacctaactaccactctatatatagcctggaccggaactggccagaattcgtgagagatcaatcgatgtcatgcgtgttaacttggcttcaaccatgcatttttgccggatcggtgaatgtaacaccactcgatctcgctctcttggcaaaatggcaaccgaaatcgaccaacctggcttcccccttaatttgatcccaaaaatatagggaaaggtcattaccacgaatattatatatgatccatccatctcgttagttcgctggttgccgtcaatgcgagcgtacgtacgtctcatgcacgcgctgtagatagagaacgacgtacctctcctctcagcagtgtacgtacagcaccggagtcgctttcatcgataaccattttcacatgactcgatctgtacaaaataaaaaaaaagtcgggaattaccgtaactattttgctgatcacggtttatcctttcgggggggggggggggggggggtgagacggacgatgattacaaagctgggatatatattcgctgtacctcatctgactatcacatcgcagctgcaaaagaagaggcactatatatcgtgggtgtgacaagggaaggtgtagccgagaagtcaattcgaccgatcgagccatgtctcgagtggttggccggctcatggggtctcgattaagattttcaggatctgaattatctgtagttggaaaactaaacgacaatatagtctactccctccatcccaatatattttacagcctacccattctatgactacgaatctgggagtagctagctagctctgttcttttttcttcgtaggttgactcttcgccgtggtcgccattggtcagcatgtcagcataacatcccgtagtaccacttggcacaccgatacgtcatcctattgtagaggtatgtttttttttaaaatttgttcaatttcatataggctgcaggtaggtgactaatacgataaagtaaaagaataacagtcgcctgatgaataaaaaatgtttatcattaatcaaaagctataattttttaaagaaatttattctatttttctatatctatactatgtaaaatgttagtagtggtggtgtccattcccacaccacccctacaactgacatgtgagccccacaatctatattattacatagtcttttaaagagttatctctcatttcactattgattttcctcaaattttaaaatcatttggttgttcaataaggaaaataatattattacttggactaaataagctaattgattttttttttacgaaaaaccagcaggagaggctcctactgaaatgcattgccaatagaagatatttacaatcccaaaaagtttctgagagggagaagaagaaaaaaagaaaatagaacttaaaagaacaattaattgatttagcctagttaattgatttaccttattgattgatttagtaaggtagaaactcaatttgttttccgttgcaacgcacgggctttagcctagtatgatttaaatttcattgtgacatatcagaatttgatcttgtctaaatagctcgagatgcagagaagcagctggtgattagccaccaggtagaacattgggtttctcatattatggcttgtattattattattattattattattattattattattattattattattattattattattattattattattattattatgtaactatggaatgtcagaatttagatgataatctgaactagttaggagtgttggagattctataaaaaggaagatagaagctctcctaaatagggtattcaactggtacatcgttgaaaaaagtaagctatatattgtaactggacattggcttattttttctctctctctctctctctctcatgtttatgataatttgtaaatagttactactccagtctacaatatgaaagcaaggatcatctaaagcatctcgcaatacttgtacatccagatataagaactaattaagcacaactgcgacgcaggaaacatcataaaactaactttagtaacgctacccttgacccaatttcaaacaagtttcaacagaagcagagatatgaagcttcaagagttgaaatataggtcaggtgaccatgacttctatgattctcttccaagctctttcactgtgaacctgaacagagatttgttggcaggaaagctagagaaactgcaggaaatggaaaaccatcttatagaagtaatatttatctacctaatatctatgcagtgtttctaaaaaaaaaatctatgcagtgtttacagcgtcacttatcttaattctccccaactaaaagagattccatctatcctactcatgatataaggcattgtcttcaaaactaatttttgagttataatctttcatacactataatatctgtagcaaggaaactagctataatcatatgaaagtaaacttaaaatgtaaatccagcaaattaaattcaattcatattataagtcaaatgttttaaaattaaatctaaaacatgtgcgcttatattatgggataaagggagcagcatatattattcttaagtcctacgagtattccttttttcttcaaagagcatatacaatcatcagtgttttctcatctgaaacgaaagggggctacaaccaaaccacacgtattgagtattgacactatagttgtacaccaaccctgtattccaaaaatataggtaatctttagggggggtccagctttaaaaaaatggctaggtaagtgaattgcgcaaaagtaatttaactgattttttaacctgacaaggaactaataatgaaatgatcaactgactaaagcatcagattagtaagtgtactattaacagtttttttaagctggattgcattctaagttggtcactagtttacctaacaccctgcctttaaataccacacccatccagtgtctgaatctgcaggcctaattaattaagctgagctccactgtctccactctccggtacactacacacgtaggtatataccatccaacatggtgaaggaagagcaaggtggcgaggtggccatggccgccgccgccgccgtcacgacgacggtggcgccggcgctgccgacgcaggagcaccggctgccgctgtcaaacctggacctcctcctgccgccgctcgacgtcagcgtcttcctttgctaccgccacccggcgccgtccgcggcggcgctcaaggaggcgctggcgaaggcgctggtgccgttctacccgctcgccggcgaggtcgtggccaacggcgacggcgagccggagctgctgtgcagcggccgcggcgtcgacttcacggagtcggtcgccggcgaggagatgcgcgggctgcggattggcatggtggacgagcgcgtcgagaagctggtgcccgccaagaaagccgccagcgtcatggcagttcaggtatatatatatatgggagaaaatatatttaccggaagccccttttttttaaaaaaaagttcaaaaatatgaatttgatctaccaactaacttaactactacttcctctgtttcacaatgtaagttattttagtaatttccacatgcatattatatctagatttattaacatcaatataaatatgaaaaatgcaagaatgatttgtattatgaaacggatggagtactagtatgtgaggataattctgatctatcacatggaaaaaaaaaataaatgaagatgctgtttttctggaactggagagctaattaatgaactaataagctggtatatatatatgtttccagcatatataactgaatatcacatcaagttatcccctcccctggacgttaaaattatgtgggaaagaaaatgtgtgtatgatgtcaagcaagcactggctactaattacacatatacttacgtgctttacgtgacatggacgtacctaccgcatatcaacctactacatgttttctttgagacggagaacatgagagaaaaaacgtagacttgatatgattcatgcatgcaggataaattacctgaaaggtatatctatcgacgaattaactaattattatcatattgtttgacctgttgtggtacaaatggtcagttctttgacctgcactaatccacatggttaatatacgtgcaggtgaccaagttcaagtgcggcggcgccgtcgtgggctgcaccttcgaccaccgcgtctgcgacgcctactccttcaacatgttcctcgtcgcctgggccgccgccgcccgcgatggtcacggcggcggcaccgcgccgcctccgccgacgatcccgtccttccgccggtccatcgtcgcgccgcgcgacccgccgccgccgcgctcaccgtccaccgacgcgctgatcgaccgcctgttcgcccctctcggctccgcgcctccgccaccggacgacgccgcggcggccgccgtcaaccgcatctaccgcgtcgccgccgccgacgccgcctccctgcaggactcggcggggcccgggcgcacgaagctggaggcgttcacggcccacctgtggcagctcaacgccagggcggcggcggcggagcgtgagcggccgtgctgcatgggcgtcgtcgtcgacgggcgcggccggatgttcccggacggcgccatgagggcctacttcggcaacgtgctgaccataccgtacggcgtgatgggctccggcgagctgcgcgccgcggcgctcgccgacgtggccggcgacgtgcaccggtgggtggcggaggcggccaccggcgaccacttccgcgggctcgtcgactgggtggaggcgcggcgccccaagccggcggcggcgagggcgtacctgggcggcaccggcggcggcgacgcggcggcgtgcatcgtgtcgtccgggatggggttccccgtcggcgaggccgacttcgggacgggcgcgccggcgttcgcgtcgtaccacttcccgtggcccgccggcgccgggtacgtgatgccgatgcccagcgcgcgcggcgacggcgactgggtggtgtacgtgcacgtgtcgccggagttggcggtggcgatggatgaggagcccaccgtgttcaggtcgctggacaacagctacgtgttcggttgacaaggccatgcacgacaaaataattaatgtctaattataacgtgtctatctttttttttctttcgaataagagaatgtgtatcaactatcgactatcgtcgtatgggagtagtagtgtgttaagggtggagtaccgtgtgatatcgccagatacatcaatcttggcatgaaacagtgtgtgtgaaaaaaaataaaataacagtccatgcaatgtcactgtaataactagaaagtgtcatgtaattaacgaaatctattcgaaatctattaatctttgtacgttgcacgtaaagaagtgcagaaacgcgcaatgttgatggaacgttagttggcaactactctacgacgggatggatgtgtcaagatgacaaaaaccaaaatggaaatgctaggaatttcagtcactttcaagttccacaaggaggcgggcaggaattcgaagagataggaaggaaggagatagcgaggactcaaccgcgacgacgacgacggcgagctagccttggccgccagtggcgctggcacccaaatcccagatggcttttcttcgagttaggattttcggacttggagaagaggatgggagaaggatgaggcggcaggagcatcagattttagagtggtttggccacaagggtagtgatggtgttgagtctcgacgggaagcggatcatctaacgtgaactcctcctgagtagacctacgagcggtggagttcacatgtcagtcagcacgttcctttgactccaacgtcagaagatcacaatccgtctcgacggtgagagcaggcaaagacgggatagacgagtagggtagagacacctcgctactgctcaagcgttgggagggtggggaggtgtggtggaggtcaggtaggcgctagggttgggtcgttggaagtcgctgcagctggtgcgctgacgcgcgtgacctcgcgcacgtacgccgccggtgtcctcgtagcctccgcagctgcgcctctccgatccccgtcgttcgtcgcccgccgagcgcgctgccgctgtacgcctggctgctcgcgatccgcgaagggtggagtcgtgcacagaccaccgcggcgcagcgaccgcgcgcatcaccctgcggcgccggagcccaggacccgtggctggctctggccctagcaagcatgcgtgatgatgtaaaaccagttgccggtttggatattgtgagttgttggatgcgttgatagaattttgtcctgacgaatgattaagccgtcatcctctgatttgagttatccattgttccactgaaagtctgaaactgttctagtgttatgctgttgcattttttttttttttgccttgtttgctgcatctctcatttgagatgtggaccaatcaaatgcaagatacgttgaattcaaagaagggtgacaactgacaatacttttcaacaaaagggcttctctgtgcaatcgactgttattctcaggttaattttgcatctctgcttcttgtgctatatgggcttgtgggaaatgtcaagagggttgcatgatcaaatgtaactacagttcaacatagtatgaacaattccatgtagtctactgagcctttgtttagcctttgtttagttccaaactttttcttcaaacttctaacttttccatcacatcaaaacttttctacacacataaacttctaacttttccgtcacattgttccaattttaacgtgaactaaacacaccctgattttcttttaaaaaaatgtttgtgaacttgcttttaagttagtcgattattgatgatttgacattacaaggcactattgctatatttgtatcgcccttttactaaatttgtacttatgcatgggtattacggtgttaaataattagttatgtatgtgaacttgcagtggccgatcaaaataagttctagagcctggctaatattattaagtatttgctacgaagattttgcttctaattcatcgaaaaacattcaaatttcattgtgcagggttgtcgagcagtaaatccacccctgcgaacttgtgaagtagaactatccaatgaaaaatttttagctacaccactagagagagagtaggtggcacgtgcagcgagaggaaaaggttgtcttgcacgaaaatttacgcaatctgaactgctcaaggcaactaaatttataggtattttcaagtttttctcaaaaatactacaaaacagcatatcgttccaacgttcaacgaaataactgttgtcatgatgacgtcagcatgatacctacagggtgtcgacgattgatgtcgcgattctggtatttgcatagtatggggatcgtcggtactagggtatacgcgagactgaggtaaaagagacggagacagggatttttattcaggtttgggcccctgaattgtcaggtaataaccctacatcatgttggccgaagccggtattgctcttattcaccataatcacaccagtactatatttggggtagcctatccaactgttgtcgacatgacggtttgaaggtctgactcgtagtcgacaacagggtagtctttctctttgagttcgtgctcggcgagatcaaagacagcgcaatgtctctcctatcagtatccggagacaccgtaggggattagccgtgcctatctccgaagtcgatatccggcgtcttgtcttgacgtatgttggcttgtattggcttgtggctttgtggcgtctatgttgcccgtgtctgttgattgtgtcttctatggtgggtgtgtctcctctcctcctagggggctttgtatttatacccataggtgtccccttgtctaagtagaactagggaaaccaatatgcatacaatccgagtagtcctcgtcgtttccatgtagaactctggttgtccttccttatccggaactcctgctatatccgcagattgtttccgtataggacatggtatgtggtgggtcctgccgagatttaatcaactattattaggtatgtggtatccataaccttgacacagggtatcatgtctagtaccgaaggtaacatgataacgtgatacctacgagatactccctccgttttttaatagatgacgccgttgactttttcttacatgtttgaccattcgtcttattcaaa

SEQ ID NO: 25657 - DNA, 3733 bp, Oryza sativa
ggtcagacgcgtgagtaaaagtcaccggcgtcatctattaaaaaacagaggtagtatcatatttggtactgaagataccataatgatgtcagcatggtatcgtgctgatgtcatctaatcagttgaaacggtataccgttctgtagttaaaaaaaaaaactctccttaagtcaagagggagagcgcgcgggatcgcgtctgccgcctgcagcagaaagcgctcgctgcaatgtacagaacctttgccatgacacatgactgggactactaccatttcacaactcacagccaaaaccaagcaacaatgtatgtacacaacggcaacaacctgcacgccccgttcgattgataaaacagtttatgctggtgtatgtatgcacagacgaatcaccaccgcccaccaccaccctgcacacactcactactcgctactgaacccacaagtttgaacatctccagttttgtccttgctaacatatctcatctctagggtctgttcacaacagctacatactataggtaaaccatcttttttcagcaccaccacacaaattcaatcggaacgaagagaaacgcagagacaatgttgcgaagcgggtgttcagcagcggaatcggatgacgatgcaggagatgtcgtccttgctcttcctcgcaagcgcttcggtcgtcagtcgcttcgctgctgcctgggggtccttgatcgacttcacaagatcgacggcttcctggttcttcattacctgagttgagcaagatcataagatttagcaactgatttgtggatgtactttgttaagggcggaatactcaaatatagattgatgactaatcatggagatcacgaggatcatgcattttgccacatggtaagtgcacaagaaaccatgatatgtacaggtcctaactaaacaatagatatttttgctccgagaggaagcatggtaaaaacaagcagtatacaaggacagaagaagcgaaaggaaaatggagatgcttataaactcttagcattaaaaagacaagattaatgtaggcaagagttttaaggaattatagtaccaaccttccatagtccatcgctggcaagtatgacgaactctatgcttgaatttattggtacatgcctaacatcaggttctgaactcaagtgcgccttgaggctttggtccccaaaggccctcgcaacagcaagctgaccatttacccggggaacatcacctgtaaacaggtcatacaataaattattaagtaacatgaacttttttattttctgaccaagaacagtgatgagacagctgaacaacaaaaatcataccaggaaatgttgttacaaagccaccctgcttctcaatcctctgcctttcattagttgtatgaggttcatggtcaacagtgagctgattagcagcacctctttcacacacaacagctcttgaatcacctacatttgctacccacatatcctttccatcaacgacaatagcagtaactgctgttgaaccaccaggtccaagttgtttggcattctccaaaatatatttgtttgtagagcggtatgcattcttaattgcttcctgagggttagtccagaagataggctgcaacatcagaaaaggcaaatggtgagcaaaagatacatttgtaaggtaaatggaaggaatgaacgtcaataacacatattcgtagttttgcaggcacataaaaaaaaccaaaaaagtaatgcttacctctttcagtatgttgcagaaaaggttagctttcaagtaacttggaacactgtctcccaagtgaccatcaaaaatggcaaagagaccaagctcatggctcttgtcatacttgtactctgccacatggtagtcctccatgtcatgcccagatttcccttccaccaagtggaatccatgagtcactttgttgcttgactgcttactcctccccttgccggtatcggtagatgacgaattaaggcatgttgcactctttaagaccatacacaaatcaggcaaaccaaattaatgtcagtacacactgatgataacccaaacaagaccaatgaagaaaggaggtgtgaggattccatgaaaatggcaccaaaatcagcatgcacaagttctcaaaaacttaaagaaaaaaatagttcactgtacaaacaaggttgaaggttgtaatcgtatcaaatagcagcattcacagtattgttcgtgttaatgaataagaacagaaaaaactagtcttgtggaacaccattttccttggctttgaactttcatttgaaattgtgggcaaatcagagtttttttggtaaacaagttatgaccttgataaatcagcaatgtctagttgtctctatgtatgacaaataacatttttgccgctgatagacaaatgtaagaaatctcaaaccatgatttaaaaaaggagaataatccatccctgaaaataatagtaatagactattcataggaacaggaaagttccattttcatcaatgaagactgcggattgtgattgctgagaatagtaatataacattttcaccatttttgtagttctaaaacatagaatgtattttgtcagaaaatgttttgcacaaattgacagaaatagtcaatagcatatttttttttagataaaagcacatggtccagtactagccttcctattgccaaactattcggagaacatcactatctgtaaagtggtataatgtatgcaaggagcagctatattattccgaaacaatattctgcaaaacatttattagatgaacaacaggacattttctaaggtccaagtggggggccacggcatagaactgaaaaacaaacaagaataaaatcacaatttgcaggtaatattagacttcataggcgatagacgagtagtattcatccttttttgtttccaaaggtgatgtaatctcctaacttagtagacaacgcacatgatcaaatcctgaggatcatgccgataatcccccaacctctgctcgatatctgcaatagggatacttcaagagctactttacgggtggtccaggtctgaactcataacactcgtaagcatgtgaaaacaggtgtctagcaccgcaagttactgactcttgcacgtcattaaccacagtgtaatcaaatcctgagaaaccaattatcaactacacacaccaagaggcaactttcccaaggcaggcaagaacagatgacagttttctttcttgtttgggttcataaacagacagaaacacataacattaaaatataaaaacaagggcactaatatcataatctgattgcttgaagacaactaccgccatcattccgataaccacagataaggctaatgatttgcatgaactggtctggtttggtacagcaaggttacaagcttaagtagggagcaatgctatacgtactaaatttttcttactaaacttttactaacaatcatctcaatcgtttgatttaagtagatggaagttacaaaaaaatctagatgcactcatagcataacagtgttagtaaaaatttagtaaaaaaaagttactaggtatatccttttccttaagtaggtgcacagcaaggctccaagaaagtacaagttgcttacggctggcacggcagcatgggcgcacgcgtactaagtcaaaaaggaggaagcggagggttgcacaagtccgactttgcttggaagttgcaaccccatacttggagatcctgtgactccaagttaac

SEQ ID NO: 25658 - DNA, 3054 bp, Oryza sativa
tgagtggatgtttcgataaacacggatattaatcagatgctaaaaaaacgaagctcctttcaatcaggcaggcaccagcacatcaaagagggtaaacgaagttaaaaaaaatcaaaaattttgctacgcagccaagaattgaaccgcatgaagacaactcaaaatagtcaaattaaagaaaaaaaaaggtaggaaaaaaaagaagaggcgcacgcaggcaggcagggaaacatacccggatcatgttgagtatgtcgggccgcttcttgcccccgcaggccgaagacgaggaggaggtgccggcggcggaggaggagggggagcatgacgccgacgacgacgccgactgccgctccatccgcccgaccatgtcctgtccaatcaccacggacacagaccagctcgctcgctcgctccccactcccgacgacgacgacgacacagcagcagcagcgcacggggatgagagatcttctggggggaggaatttctatcccttggtttgcttctcctgatccgattcttccaccaccagccgagcccgaggcctctcgcggcgcggacacctgtggcggtagcgtgaggagaaatggaatggaatggaggagaagaagaagagaaaaaagaagttggagaagaagaagagaggagagggaggaggagtcgttgcggttggggtttgatgattgtgttgtggtggagtggaagagccgctggaagtgggtcccacaccagggagggggcaaaaaaatcggctgaaaatgaagcaagcaagccgcacacaggcacaggcgcacagctgtggaaaacctggaaaatggaaaacattgctgtgcccggcgtggatatggatggacacggacacatctttgcgtgataaaaacaccaaatttgaaaataggttaatagttttttaaataaaaaaaaggatggattcatgaacagatatgttttcgtaggaatgttattctatcagtatatttggatatgcataaaaccatgcacttatccgtcttcaagggttattgacaaaattgctccctaaaagttttctattgtctagtattgttgattacgtgtataaattaatggtatggctcgaagtgatacgtgtcaaatacttattgtatgtctacgaaatgtcgatttgtctatatcgcagaaataattgttgggttttttactattgacaaatcatccaataaaagtccttcattgtcctcgacgatgtaagtataacaataatatatcttatttagttccgtactaagttagttttgactttcgagtgtggtacatatttatttttatcaacacggaatactgaatttgctctagttgtaaaatcaataaatttgtccctttaaagttcatgtttttaaatacatatgttttttaaataaatatgagggcgagcttggatttggacatgtccttgtgggataaaataccaaatgtgaaaataaatcagtgttgattggatagctacaaatttttatgggcataactacataactctatctcaaactaaaccaatgttgtgtaaattgtggtatacctatttgctaaatactttcatatatcacatgatttgatcacacgaagacatttaatttgcaaattatttgatagatgcaacttactccctcagtctcataaaaaaccaatttattactggatatgacacatcattcgttgtactaaaatgtgtcacatctagtagtagatttgttagatttgtttgtttaggacagagtgagtagaattttgacaagatgatccgtacatattaattggtttccaaatttcgatggcttttttacctcacggcttggatgataaaccgatgcctgtgcgaaccaggaaagaagatagaaattttacaagctaaatatgtttatttacaacctaaatattttgctatctgcagttcggcacgcttcctgacttctattttcatttcctttgggtatcgtttttcgtttcggtgcccgggagcttccaggaagcttcgtccagctcccacccatggcaataatgctaggtgcacacggtgggatagtctgtcttttcgtttgtatctataccatgatttcaactaaatcgaaaagcttggcatgatttccatgtgtcccttccttagccgtgttaggttgcttctaaaaaccaattcaaaaggctggcatgggataaccacattagaccctgtcccaaaagaacaagtcatactttattatgtaacaaattcaagaacacaatattttcttttgtatctgtgctatgcctttttctaacaaacttaaagataccacaattttttttttttgcttatagtgtcatactccatgacaccatatatagcaggtattccactttaaaacacttctcttcagcaaactttttttttgaattattccaaaaggggcaatgcaacgtaaggtgcatgactctctcgtatcctcaaagaaaataataaaagagatatattatgactttttgtgggtgctaatgtttgagtgcaccgtgcacgatattacctaaatggtatccacaattacatagatataggtgttacaaaatgcatcttatataattattcttttgactccatgttatatttgttcgatgggtttagtggtcaaaacttatacatattatatatttatatatacagttgcggagaatgaactcctccaccagggaaccgtgaggcctccctttatgagttcggccgggggcagcgagtgagattcgagggcttggtaagcgaagctgtgtgatttgagggggttcaatcccccaaagacgatgagacaaaagatgtttatacaggttcgggccactaagaagcgtaataccctactcatgtgcttcattgattgggtgtagaacacaagtgctcggggttgcgagacccaagtgccgacttctctcactaggcctggatctccttttatacctcaaggggttaccacataggcccaacaacctaacttcgtcgagaagtattacaatctttgcattaaatggcatggtcttggttccttaacttgg

SEQ ID NO: 25659 - DNA, 12102 bp, Oryza sativa
cctttaggggagggccacgtggcattggagggccgcctcctccgactattctttgggaaggagtggccgccaccccacctcgggcctgactccccttggggagggccacgtggtattggggtcagcctcctccgactagtctttgggaaggagtggccgccaccccacctcgagcctgactcccctaaacatgatatcctcgggcccatatcaccgacaacagttgcgaagacaagcataggacaattaagagtccagccatagacctgttttcttaatcctttaagattccattgtaaatcgtatacatattaagattgttaagcaaattattagttcatccttggctttgatagtttgatggttttccgggtctttccctatctatatgtatacatcttaattgtaataaaaaagaaaaaaacaaagaaaatgtatgagtagcagtgggtagatctgttccggaagatgagtaaccccgttgtacaaacgtacagtataaatgactctctaatataaaggggatgttacctttgttttttccaatatatgacacatcagaatcttctaattcgtttatctatttatttctttagatatttatgcaaataaataaacatactaggcataaccaaagcatttttttttctgatagtatcacaagatactctattcgctattttttctaaaacaaataaaatatttcctccattccaaaatataaaaaaaattggttgtatgggacagatttatagtattaaaaatacgtcctattcaatcaaaactctatatattttaaaacggatggagtaaataataatcgaataaatatttgtggtctaagtttgagaaaaaaaaatcaaccgtatcacatcacacatctcaaagaaatggaggaagtaccgggagtaccgagtgctgtacaccggtacagtgcgcacgtatggagaacggcggagcgttggtacgcatggcatggcgttggcgttggcagggtcagcagcgcagcacagcacagcagggcgacggggggaggggaaggggaccatgcgctgcgttggcttcttctgttgccggttgacccgcgccagaaacagtcggatcacccgtcgtcgtctactaccgcgcgcgtggggacacaggctgccgctgctgctgtgtcgcgggcgcggacgcgcggtggtggacggtagcctgccggtcagaacgacgtacgcgaggacaagcagctagtagctagccggccgggccggcggggcgtgcagggcctgtggcctgtgccctggccggccggccaccgcgcggcggggcccggacaccgccaccaccacccgttccgatacgaggatcgcattcggctacaattacaaaggcgcgagggatttttttattcggtttttgaacttttctaatttttattttttactagaaaaaacgtctgtgcgttacaacgggtgaattctattttaatcttattattgttatgcggtttagctagggtaaattcactgtgaaatttcgcttggatattttttttaagaaaatcatgagctgcaattagtagtctgacttcacttcaagttagcatgtggggtttttttaaaaaggatttcttatacccctccttttgtattttcaaaagcaaacgaggttaaaatctaactcaaatatggatatgtatttccaaaagcgaacgaacttaaaaaccaactcaataccaaaatacccgaaaaaacgtggggcctcccccactgtgttatgataaaaaaataccagaaaaaacatatttaatttttataatagtagaaaattttgaaataaacctttcaaaaacttattttgatctaaacattttaaccacgccagtcgaaccggtgtgacaaaacaacgatatcacgttgatctggctagcacgagaactctatttgctcgcgtcgatctgcttgacgtaacaatattgtttgtgtggcaaaaaaaaaactgtcacacccgttgtgtgtggtgtattagtggcctgattaaaaggtttagattttaaaaatagattttgcaatagtttatttttaaaatttaaaaaataaaaaaggcttaaggaaaatcgtgaggcgacgaggggttgggtggggggcttgcccggcccgcggcgacgcaggggggcacgtgcgctcgcgtccacggtccacggcctgtctgtgtctgtgtcttgtgtctggggttggcttggagcggctgacctgtcaggtgggaccgggtcgccctgtgggggagcagatgactagacgagcggcacggcaacccgctcgtctctttcagccaggccgtagggccagcaaaagtcacggatcttcgcgttgccattgcaaaacgaatctagtactacgcctgtttcaaaataaatttattcttcattcatcttgtatataccaatagaaagttagtaaaaaaaagaagaatatcctaactttaccaataccaatacaactattctcactttatatactttcaatacaactattctatacttttataaattctgagacaatgattactctaaaataaatttattttgaaacaaataaaagaaactaaaaatgaaattattatgagacgaagtaagtaatacttttttcgttttataatatataagtatttttaaattctaaaattagaccacctctgtctcaaaataagttcatttttcacccattccacacatatcaatacaaaactaaaaagaactatttctcattttatctactcctaatacaattattacatgtataaacttggatgcaataattagtataaaataaacttactttgtgacaaataagaggagaaaaaaataaacctaatacgggatggaggaagtattataatataagcattcatgtactgattttcatggctcctaccatttcaatgattacaaagctaatcagacactcgaaaaggaaacataagcaattcaaaataaaaaaaatgacaagtaaaatgactaaaaaggaaccttttgacttaacttgagtgttcgttatacaatctaaaaatccttatattttataacggatagggtactttcccatgagaaagtattaagaaatagatttatttcgaaacaaatgtaaagtatagaaacaactacatcttagaatatgtgaagtaatatttgaaaatggtaccgaaaattactaattgacttaaatttattttctgttagtgttatattgaatttggtgctaaatagttaaattgacggatatgcatggaaaatcgatagacaaccgagaaccatttcatggtatcgttcccgacctgttttcatcccgtcctatttccgcatttgctgaaggccatgagttgcaaaatagcaatcctgcgagctacggcgagcagagaaaatggacaatggacatttagaaagcggtttcactggaatgccatctcgaaaacatgtttcgctgaaatgccaatatggagcgtgtgatcacagtgaaaatggtaaaaatagagaaaatagcaaagttttaacgaaacgtactttcgagatgtattctagcgaaaccctttttttaaacgtggtcaaatatccattttctcacggcgagcacagcgctcacggctacgggagataggaggacaacgcccggccggtgcgtatgagcgtatcggcggcaagtgctcccggccaacgacgcacccaggattgatagatccggggcagcgatgggccggggtcggtcgccactcgccaccgcggatgcgtgatgatcatcatcatcagatcaggtgagattgcattgcgacggggtggtggtagcgcccgcgcgcgagtgcgttccatgattgcgcgctactatagctcggaagtggagccagcggccagcatgtcaaccaaaggtcgtcgcgtgacgacacatcacctaatgagtagggaatctcagctaatggataacgagatgtcgctaggaattaaatttagaaatatactattcattcattttatttttagaaatattcggaattcaaaactttttacaaaaatataccgttgatctcgtacaaccattacgcgaaagtgacgtggacgtgacatcatgggcggtatcgcgctaggaaagtgcgagaccgcgcggtctcgcgaaacagaagagcgagaccgttcggtctcgcttaaccaatcagcgataccggatttcaaaatggttaattagtgattaattaccataattaacgattaattaattattaattaatcgctaattattattagttaaataattaattaggtcattagtcactaacctaatgcagtttaggacggtgtcgctctctgcttgagcgagaccgctcgtccttcccgcgctctcgcgccgtcgccgcgcgagaccgcggggtctcgcgttttctccgcgcaataccgccctcaacgtcacctctgcgtcattttcgcttaacggtagagcgagatcgatggtatatttctacaataaaatttacatcacgaatatttttgaaaataaattgaataaatagtatatttttaaatttaattcatgtcgctagccactcctatctttggtttaaataaatgtgaggtcttgggcgagttatgaaagaaaaaaaaagagaaaaaagggtcttgggcggcgtcaaagaggtcagggaggaactgatgagccaggtgagtgagtgacacgcctcgcctgagttgcagatgtggctgcacatcagcagtacaccctgggatgagatgccaccacgatgcatgacttgcatcctttggattgtagcaatgagaaaacgaaaaatgtagaaaaaacgcgagaatgattgtttaactgggccacagacaaaacgtaggaatcaaataataaaatagactgatttttttttcaatagattgaaattcttactaagttttcttcaaaatctttataagattattaatgtcataagaattttgaaggataagataggatttaatcattgtttcaaaggcttttctagtctttttctataagattaaaatcttttaaaattttatgtttgattaatcttttaaaattttatgtttttcctacaaattaaagataccttagtcgcagtcatgagtgatcggtaagcaagtatactttctaaccatttcgcaatacattcagtaagaactccacaagaacaattgagatgcttctaggggaaatgatataggtaatatgcttaactatttcttttctcctgaaacctatcgcattgcgaacaagtcatactagtatgttaactcatagtgcaaaatcttgtcatctgatcaacgagaccaacaactccgcaacgcctgattttgattctatggaaactcaaaaagggataagagtaatcgctatcatgcattcgttctccccgcacctaacaatcaagatggcaatgtaaaaccgtcaccacgcactaggaagagtctaacgatcccacgcaggtacatcactcaaccagtaaatggaccaggaaggccaattcaacatcaacacaaccaaaaggaaatgggaggattgcaattgactaatcttttcccgatgggacgatatgtaatacttgcacacatctatggacagaaaaaatggtatagagtatagacaacctttcattctgatgatatgcagggaataagcaaccgtggcctattcctccgaaacagtatggcgccatattggtgggtgcgccctcgcatttttcttttttctgatataagctggggtttagttgttttacatcccaatatacaacataacaaggaaatagaaaagaggggggtagggtacaccacatcttttacatacagaagttgagggtgtatttacctgcctaatttctaagttgacactgtcacattagtcatattagcttgctggctcaataaaaaaacaaaatcaaatgtgccgcacctctgagctgctgcatctaacatcagaaagcgatcgacaccaccaatatgaatgtgaacaaaacaaatcaagcctatccatgtcagtcatcaatatcttggacccactgtaagcctgcaaaaggataacataatgtttaccactctcataaataagaatatggtcttgatttgagatgatacatggcattggaggaatggaagtgaccagaatccacacagagtgttcaacatttaaagtgctggaaaaggagaaaaaaatactggcacattccacctctggtccttctgatttctccacaacgatttttttttctttttggcagagcccaatgaatgaaatcttactagaaaatgccatccacaaacaaatgagctgcccaagaagctccatgatataacagtagctcagtttaccgttgcacaattttatctccatagttcaactaccacaagccgtacctgattctccccattggacactaaccacaacaaataccatctgacaggaaattctgggaaatcataaccaacctgttaatactgactccacagctgaattcggaatgagtagtccaacgattcgctgattgtcagttgttgtctctaaacggacaacacgtactcgcttgtgactttgacgaacctgctcaataacagcagcaaggcacagaggcgttaaacatcaaacaatcatgcaccaattcagctaaagcataaaaatccagagagtaaatcattctgtaactttgttttattgtgagatactggacttctacttttagctttagacaaaatcatctagctcttgcttgatgggtagaaaggtcagagcctcagaggattcttttagggaaatatgtccagatcatcattattactatggtgtatgttctgtgttgatgaaggaatcattccctattaagtattggagattcaagttaacaccaaactttatccccttattttcgaatccaccaaatctctttctaactttagttaatgccctgagaagctctgtgctactgcccctgccatccagctacactcaagaccattttactgcctgtcctttaacttcttagctttgttcatcaaatagatttttttaaggtactttcaaggggatccctttaccttaccctaaagactaaagagtagagactccagagctttgagaagtttgtgtctacatggaaaaagcggatgacacaagagccaatacaagagacgcaatgccaagatcggaagatctaaaatcatatcaacccattgaatatatcggaacccaccattcaattaagatgaaaaagtagcaaccgtaagactttagaataagtggcataggagtgaacctgcttagctagggccttttctattgtaccccaaactggaagtatgagaccacccaagatgttaacctcttgcaaccttcttcccactgtacagtagcttcccactttgcatttcgatccatgcatacactgaaatgaagcaaaaagacactagataagttgtagacacagtaacagctcaaccgttcatcatcctaaagtaaattaggaggaactgtatgtggactatggaaaaatgagcttcatcctcaaagggaataaaacacaacagatccacaaacaaattgctattcacgatgaacagatgcacgtggccatgaaattacaaaatattcctgcttgaacaaaatattctatgcttcaacaatttttgcgtgtatataaaaaatcaacatcgtaaaaaggatgtgttatgtccctcagatcataatgggaaaacactgtcagcgccatataccttgctaagtactccaatgataattattatcttcaaatcttgcttaacttccaatgattacaatatgcccctttatataaagttcccccctaacaaatacagatcaaatttatctaagaataactttccctaccttataactactccattcatttcatattataagatgttttaggtttggactaagtcaaacatcttcaagtctgaccaagtttatagaaaaatgttgccgcatttccaacacaaaacaaacatactaaagaatatatattcaatggtgtatttaatgaaactaatttggtgctgtagatgttgctacatttttctataaacttgatcagacttgaagaagtttgacttaggacaaacccaaaacatattataatatggaatgaagggagtaagatacttgacaactaagggcccgtttggttgggattcttaggagcaattctagcaggaatcggttggagctgagccaaacgggcaatttcccctcagcttccaaagcgaatcaaccgggatcgattcccttttttacgaaggaagggagaatcggcggaaagcgagcttctgctgagaatcaaaccaaccaaatatgaaagtccccatatttttcccaaaaaattacccgcctgccactgggtatacccctctttccagccttccccatccacccgagcagatcgatcgacatcacgtgctagggttgcgggagccaggtgacggcgctccccatccagcgccgccatccccgccggcgctccgcatcgccgccgacctctcccgccgacgacatcgccgaccacagttcccgtgcccgagccttttcccaccatccagccaccttcgacaccactgccggtctccatcctgccactcccctattctccctcagccctgcagatccaggccgacaacgccaccagttgctagtgttgccattctccgtcgagctccctaaacaggacgaccagcactgactgggcaaggtaccatgtcctgaacttctccatttgattagctttgtatgttgtactgttgtgcaaaatagtagaactgaattgctcactgcgatgtggatttgtgtgtaaataatattgatgtggatttgcactctgatctgtgtatgtctaaatagttttgatgtgcatctgtgctctgatttgcatatgtgttatttcataagtactgcagatggcagcaacagtagtagaggaaaatcaaggtgcaaataatgctgaatggacagatgaaaacactaggatagtttgtgagttgttcgctgaacaagttaggataggaaatcgctcaaatacccatttgaacaaggtggggtatgataatgtgattgcaaaatttgaagaaaagactggcttacgctatcaaaagctgcagttcaagaacaaatggagcaagctgaggaatgagtataatctatggaagaaactgatagctagagagactggattaggttgggaccaagctagggctactattgttgcatctgatgattggtgggcaagagccaagaaggtatgctacatattaatgttgatgtttaagttgttaaccatgattttgcaaatatttgtgtcactcttctgattattcccttggtgttcctctaggatttgccaggttgtgcaaagtttaagttacgggggattcaaaatgaacatttgctccaacaaatatttgaagacctttgaaacacaggagatgaccactggaatcctactagtggaaatttaccgcagagttcaacccaaccttccagtactattaatgtagatacagaagctgtgaatgaaggtgatgatgatgatagtaacgatgatgatttctcacctcctcccaagagaggtaaggcagcagctggtaaggaagccaagaaacccaagaccagtggtggatattggttctatgaacaaatgagtcgttttgttgataaccaagagaaatcagccgcatctgttgagtctcttgtcaggagggaggacacttcagggtgtgccatcaaagatgtcatggctctagtgaaggaatgtggtgctgtatttggtaccaaagagcacttcattgctactgagattttcacaaagaaatctgagagagagatgttcatgaccttggataattcagaagaaagatttgcatggctcaccatgaaacatgaatccaagatggccaagtattccaagtagtggcctagcatggttgtgtttgttcaacaaatgtcttgctctgtatctttagacaattttatctccaagtagtgtttttatttttttttattgttgtaataattgttggatgtgttgactatcccctattttatttactggacatgtaatgcaaccaagttctcctttaattaatgtattgttgcatgcaattgtatttcaagtattgcctactgacttttattacctactgtattgctgctcgacatgtattgatgttgtcaattgtatgtgtacttctatacttgccttgatgcttgtcacttaacactttctttccatgtgccagatgtcttctagtgaaactgatggaaatgagactttttctgaaagtgatggtactgatctacatgaagatgatgaggtttccatacaatcagttattcgtcatcatcaagcattggaagccaatcttttttcagctgcctgcttacttggacaatattatatgacgtattatgataaaaataaaccaaggacgtcagtactaagtggatatgcatgggtacaagagactctgaggactccaggagagagtcaccacatgtttcgaatgaatacagacctcttctacaaattgcatgacttgctggtgagtacctataacctgaaagcaaccaaccacatgaactccatggaatcagttgctatctttcttttcatacttggaggtggtgagtccaatagaagggttcaaaataggttcaagcattccggtgaaacaattagtagaaaatttgaagaggtcttattgagtgtggttagtatgtgcaaggattacatgtcccaaagatcctaacttcccaagggctcatagtaggattaagaatgacaaaagattatggccacatttcaaaaagtgcattggagccattgatgggactcatatcacagcaaacccacctcgtgaagattatgttagatacattggtagaagcaagagtcctactcagaatgtgatggcagcagtcgactttgacatgcgatttacatattcttctattggacaaccagggtctatgcatgatactagcgtcctttatcatgtgttagatgttgataaagatatatttccacaccctccacaaggtatatactagctgaaatcatctacactttgctttatcttttatttgtaccatataacattgactcgatgcatatatcgtaggtaaatattatcttgttgatgctggctacccaaataggccagggtatatggcaccatacaaggggcaaaggtaccatattcctgaatggagaagaggtcctccaccaagtggtgagcaagagtattccaaccaatgtcactcaagtgcatgcaatgtcgttgaggcacctttggtgtgtggaagatgaaatggcggatccttttaaagatgcctacctatgcaatggacaagcaagaaatgatcgttgcagctaccatgtgtcttcacaactttataagacagaattcgacaactgacaagtattttcgtaggtgtgatcgagatccaaattatgtcccaactataccaacaagatatgcaagatatgttgtttcccaaaatgcatcagatacctctactccatagtctagtgataggtctatggacagatttcgtgatgacctagcaactgcattgtggcaatctagatgaatgttctcatataagtgctgttaggaatatattttggaagaactctccatagaaatatgtaactgtggtggttccactctccttagaaatatgtaaccatggtattttgcaataactgaatcaatttgagtggactattattataatggacattgtctttgatgccatgcaatgtacgtgacgtgtttttttaacttctcatatggaagcttggtatttttttacaagtattgtgctaaaatatttgtgcatattcagaagtacttctaacaaatattaggattgccatttcagctatatctcgttggtacagaggttatatagaccaaggacgtctttggcttcccccattaggatcttaatgtttctagccaaacacctaaattaactgattctgattctcttcagtatctgattcaggaagaatcagaattagaatcacagaatctgaaaccctaccaaa

SEQ ID NO: 25660 - DNA, 6083 bp, Oryza sativa
gagaaccgactcctttcccctcttgaacgccgtttcagggcaatcctgaagggccgctgcctggcattggcgtcactcgaacgaatcagagtgcgccagcgggctcggatctcccagctccgggagggagacgccaactccaaatacttccatatgaaagtgaatgcgaggcgccgtaagctattcatcccagtctttgagtatgaagggcagacagcaacctcgtaggaagataaaattgctctggccaaggactattttcagggaattttgggtgtggcggatcccgactcggctgagctccaattcaatcaaatcttccctccggcgccgaacctgcaagagctggaagtgcctttctctgaagaggaagtttggaaggtgataaaagagatgccaaacgagaaggcgccgggaccggatggattcaccgggcttttctaccaacggtgttggcaagtcatcaaaggggaagtgctggcggcactgacgaaatttcactctgggaatcatcagaatctcgacaatctcaacacagcggtgattactctgctcccaaagaaggatgcgcccacgttgatcaaagattacaggcccataagcctgatacacagcttttccaagcttgcaacgaagattttggcgtcccggttggcgccgagaatgggcgatctagttgctgaaaaccagactgccttcatccgtggccgatcgatacacgaaaacttcatttttgtcagaggtttagcgctgcaattccaccgaagaaagaagcctatgatcctcctgaaacttgacatcactaaagcgttcgacacagtctcttggtgtttcttgctgaacttgctccgaaacagaggctttgggtccaggtggcgatcgtggatagctgccctgctcttaacttctgaaaccagaatcttgctcaatggccatgaaagtgacagcttcaagccggcgcgaggactgcggcagggtaacccgttgtcgccgctactctttgtccttgtcatggatgcgctgcaaggcttgctcgccaaagctacttcctgggggcttcttgccaagctggacactcgacgttccatcccaaacacatccatttatgccgatgacaccattgtgttcctgcaaccaatcgagagggaggcaacagcggtaaacgccattcttcagcttttcggaaaagctacagggctcaagaccaacctcagcaagagtgctttgacgccgattaggtgtgatgatgatgtgttggtcggagttcaacagctgcttgggtgtagggttgagaatttcccgatcacttacctcggtcttccactctccctgagaagaccgacgaaggcggaagtgcaaccgattttggatcagctgtccaaaaaagtggccggctggaagcccaaactgctctctcccgacggccgtctgcgcctgatcaaatcggtgctgaccgcgctgccagttcatttcatgtttgtgcttgtgctgccaaaatgggcaatcaaagagtttaacaagaaatgctgagcgttcctgtggaaagggcaagaggaggttaatggcggccactgcctagtggcttgggatatcgtctgcagcccgaaggagtgcgggggattgggagttaaaaatctggaattatttggccaagcgatgcgaatgaaatggctcgctagacgattggagcaaagaggaaggccgtggactctgataaactcagtaccgacaaacgacatcaccggtctgttccaatcagtggcgtcgtttcaggtaggggacggtaaagatacggacttttggagggcgaactggttgccgaggggctgcatctctgtctcctcacctttgctcttcacacacctgggcagaacgaagctgactgtggcggaggcgctctcgcagaatcgctgggtgcgcgacattcgagggagtctctctgcgctggccttatcggaatattttcgtttgtgggatgagattcaggaggtacagctgcaagaggatgcccaagactctatcagttggaagctcactcctaacggagttttctgcacagcctctgtgtatgagatgttcttcgcggcacgggtgcgatctcaatgtgcggaattgatctggcaagctaggggcccgtctagacttaagttcttcatgtggctaatcaccaagggcaggtgcttgacagcagacaatttgcagaaaagaggatggccgcatgaagatggttgtgtcctttgcaatggcgatcaggagagctgtgatcatttgttgctgggttgccctttcacgaataggatctggggtctgctgagaacgtggctaggaactcctttccccctgcctggcgatgacgactgggagttcgcggactggtggattaaaaccagactctgttttcagacgggctacaggggcgcttttgactccctttgtatcctcatctgctggttcgtgtggtgagaacgaaacctcaggatctttgaacaaaaggcgagaacggcagcggagctcttcagtgatattaagaatgaagttgcagtgtggagggagaccaacattttgagagaagtcggctaaagagcccgctggtggcggattgttttgttttcctttcttttcggtttctctcgactgtttaatgtcgatttgtaaatgttttcaaacccttccttcaaatcttaatacaatttgggcggcctgccttgggccgtcccagctaaaatgaggcctgccttcattcagaatagaaaccaaacaaacacagcatgtaattcaaataacaagaagagagtgcacttcgatatccttattttgtttagttgtttttcagatatatggtttccttcccaagctatcacctactgtactaaacattctccgagaaatgaaacggcattagagaaattttccaccagggattttgtctcttttgagaaaatttctcagtgagggtcgctctccagctatgcacttgctatgtcatactttattccctactgtgttaagcatgctttgtaatctcactgcacggatcattttgtttcgagaaaagaaatcacccagaggcctaggttaagaccctggaaaataataactaaagaaaaggttatcggtagatcacttaatataattacatttagatatttggctcggatatttctgtatagcactgtactgcttggaaatcattagaaaatttaattatgtgtcgctgtcaagaatcgtatctttcatttgaccagaatcttgagccattatttgctttggttaatgcttttcctttgtacaggccttgtctcgaatggggactctttggatatgccatggttggatgtcgcaggtgtcagggtccacctgacctcaatttgtctgtatagcagggcaacatatatacctgtctattccaagttccaacaggatatatatcagttgatcatgtgatgctagaataatcttccttctttccaattcactgtaatgcaaaacttctgattttctgaagcagctgttgctatatatacatgcataacaagagctcaagtatacagtcgcaaactctgttgttattctgtggtttcagcaagtaaaactgtaacactgtaaactgcagaagttcgatgcgacaagtggttcaatacatcttcgtctactacccgtcttgaaaatgatccatccatccctgctgcatcctgattgcttcagatggtggctacctgcccgcctgcctgccattggtgtcgcactaacttcaccagtttagggttatagttacttaaaaaaaattggaagtttgaagaaagttgagagttttgcactaacttcaccagttcagggtgttagtttctgaaaaaagttagaagtttgaagaaagttgagagtttggaaaaaagttgaaagttagtgttaatttctgaaaaaagttggaagtttaaagaaagttaggagtttagaaaaaaagttgaaagtttatgtgtgtaggaaagtttttgatgtaatatgatgtgatggaaagttaggaatatggaagaaactaaacacggcctgttcagatgcaaatatcatggtgatccctcccatgggcttgcaacgaagtttacgcggtctctgatgaaactcgttggcgagattggctggtttgattggcgagattggctggtttgatggtgtccctacgtgtaagttcgcatgtttctcacggccatctctttcacactcacagtcacaggacccggaaaggcaacgcttttgtttctttagcacggagcaatccccgccgcggacgcaccgcacatggttgatttttttaaaattttttgaatcatttaacttttattttaaaaataaattatttctaaacttattttcaaaatttaaacagcacgtcacctgcaccaggatagttgacgtgaccagaatgtttattttttaaaattaaaattaagattaagaatgtttaaaaagttaaaaaaaatccacagggttgcttccgacaaggaataaatcacacacaagtcaagtcgtcacggtttttcttctgcttttaccttagcctcgaatcaaagagcttgcttgcttgcttggtcttgaccttgattacagcatgagaggacgatggagacgcggattactcacggctttcacactcggactccagattaacagttttattattattatttttttgctactccaaactttcctcccaagaataaggtcggcatcagcgtgagtagtgacaagatggttaacaacaggaggaagaaagggacggtcaaagggcaagtgagcaagttgatgacattgtcgtttgagttcgattaataataattaagaaaagaataaaaactttaatcagcttggtggctctaactgcatggttggatagaatatagatccaaaaatattggttacatgattatgttaattactacacaattatagggcctataaatagcttagaaaaacttgtttaaagcaatgctgacatagaaatacttaagagaaacatataattttgaaagcgtcgcatgaataatctataccacattcaactatttagaacgcgatacttaattatcctagaggtggaaaagaaaagacttttgagttgagtagccacattgggtaccctaagtggaagaaaagaaaggccagagacaaatgggactcaaaaatatattttttagttacaaaacgaacgcgaatggtggttgtacttgtggtacttttgtgcaatctaaaacctctctttaagggacattgggtgaagaggtgagatgacaaggacaagcacaagatgcagcagtagcataactaatggtctgtttactttgatggcattttcaatcttaccaaattttgatacagttataaaaaaaagtggctatatttagtatactgccaaattttagtaactatataagaaatcatgtttttggtatagttgccaaatatttgctaaattttgttaaggtttttttcatcaaagcgaacaacacgatatactagtatagaactggatttgatttgatccttgtttaagctaatgataaacacggtgccctcgttcccaaatcgcaattgtgttcgtgccaatagccgtagttgagagggacaagggagtttggggtgtgtgtttaggtaatacgtgaaacgtgaaggggcgtattgcaaattttatggagcatatatagcgggggtaaagttgctcacaattcgctcgatttttttcccaataaatttgcccgagttttcctcttttggttccccagtttcagtttaagctcttaaaccctcgccgggagatttcgccgcaagattctcattctccgcgcctatttgcttgccagttgttgatcttggagatggcggcagctcagcaggcgcaagattcagctggttcgttgctttttttccccttttatttgggttgcttgttgattttggagttcttttttttttttgcttcactttgcatatcttctgtgttgaatttgaggagttgggtgggagtttatctgtgaaggtcgcgatcttggcggtgtttgttcgtgtggggatcgtggtaaatttgcgaattt

SEQ ID NO: 25661 - DNA, 12196 bp, Oryza sativa
aacgggaacgacctctctcagatgatgctatcaagctgctgtacgttacaaaaattaccccattcttgatcccaatggcctttgagtctagcttagaatatggtagcttatttaaagggtgcactgcatgaaaaaaaaacccaacatcaaacacatatcaaccataaatacttttgatcacttaaggtgaaaatttaattttatgagttaattggcttcataccctgtacacattttgcaccaacgtcatccaaatctcttcgagcatcatacttcaaatcagagccaatagatacccacctggaaaatacaaccataatacaactagaatcaaacaatgaagcatggaaacataactataagatattgttatgaattcatcagatcactaaatgttgtttcttggcaacaatcttacactgccttatgctttccctgttgccaattttcccatattaatccagcaattgtccggcccttaccaacaccagctccatcaccaatgaaaaaacctgctctatcaccagtagggagatgataaaggtgccgctgtcatacaacaacataaagatttacaagaggtgtgacatataaaacttcatagaagaatatagaatggcactaacctgacaagcataaactaatgtttcgatttgcaagcaagacaaggcctttgtctcatccaattcatccatgatgttcaagctgtaagttggctcaggaggctgtacagctgacaaagaagaagtttctactattggatctggatgaggcagaccaagagagagtttgggaggcctctggaaacaagtgaaaatatgggaaaaattctcaagaaattaaatatgaatcacagtaataaatatgtgtacgaatatttatgcatagtaaagaatcagctgttaaagtacatagaatccttacatagtcagtgaacgtttctccaacagtaccaccttcatcttcttcacgctcaacatcaattgcaacctgcttgacaaaaaagcccagcaagtgaaaggctgtaaacctggtaaactattataatacaatatataaggctgtaaacctggtaaactattataatacaatatatgaagcatgcatcaacaatgtcagagaaactgaatgtttatgggtgtaaaacattgtacagtttgaaattaatcagcagaaacttttaaatcctgctgtacacatccaaagagcagagaacaatgtatggacgaccaagcagatgaattcaaaaattgaaaccgaccagccaaagccaatcaccagaaatgaaaaaatattgccctaaccattaaaaatgaaaattaaggaaatcagattgtacataattatgtcatgtgaagccctcgttatcatctcaagcaaaacaattgtccaatttcatgcataataaaagtataaatggaactataccaaaattgccttcctagcgaatatatagcccattacaaacagaatttctcgttatgataaactatcggtccaaaattgcctcgattaacaccgttcaaaggtcaaagcgcattcatcaagccttaacgaataagatcgtatacactaaccaacaaaatggcagagcaagttagtgcacaacagcatacctcgttgatctcctcaggcggatcagtgatgggaagcaccatcgggatcaacgcgccaggcaccatctgcggcgcctgcgtcatgcctggcgtcggcacgggggggaacggggcgggcggaggcgcaggcaccaaaggcgcccgcgacgcgggtcccgaggccggcgggacgttgtccggcggcgccgcggcggcgttgttgttggaggaggccaggaagttgtgcagcttggcgaggtcgacggcgagctccacgccgcactgcgggcagcggaagcgggcgaggccgtggggcacgttgagcacggcctggcagttggcgcaggggagctggatcttcgtggggtccaccccctgcgcctgcgggggcggaagggccgcgccgcctccgcctcctctccgggacgtaggcggcggcggtgccgccggggcgggaggcgcgggggtcgcggcggcggaggaggaggaggagggcggcggcttgggcatcagctgcggggggaggcgctgcgccatgccgcacttggggcagatgaactcggtcatgcctgggccgacggcgaggacgccgcggcatccggcgcagcgcacctggatgggcgcggcggccggggagggggaggagccgccggccatcggcggcgaggcgaggcgaggcgaccgagggtttgtgagagaggaagaggggggcaggtcgggttcctttccttgctcgctatggagaagcaggagcaagaggggggaggaaaccgaaacggcagagccggaggagcgagtgggttggtcggttggtcttctggtccgagaattaaaagatttcctgctgccaattgtaaatttttactgctagcgtcaaataagaggggattttggtgcttgaattttagttacatttttacctctgttctttttgttgccggagttgtttttaagggttcttttttaatttttaatagttcaaactttgaccatatggtaaccattttgttttttcaaagagaggctccatttttgttctttcacaaaaatggaaaaggaaatggagagttgtttcaatttagataatacgacaattttatcacatgtacttctttcgtcaaaaaatacttaaccaaggggttcctagattaagcttttttttatttaacggagggagtacgtaacgaagccaatatttagcttagataaaagccaagagacttggagaagaacgaagccaagatttagcttagataaaagccaagagacttggagaagacctaacgcactaccgtattacttagttcatacctaggtctagttaattagatgaccctacataaaagattgttagaggacctctgtccatgtaagggtgtaagtggctaaaccatagagtcatttataagtcaaaataaatggataagtgtcttattttgatttataagtgtgtttcgtgggttagccacttacaccctttgtctaccccatctccgcaaattatacaacatccaggtgactacatatacagtttgaaattacgatataagaaaagggactgttgttttgaagatgctgacacggtgacaccaacacacacgaacacatattgttgttttcaaatttcaaacatgccatctgcaagattggaagtgaaatggaacacagtggaagaccaaccacattactctcccaattactctcctaacaactcaaagaaggaccaaagaaagctgctatcatgcgtgaccaaccaactaaatggaaaacgcagatgcagcatatctgagatccttgcgacgcctgcacgatcagcatgctaggatgtgagtaatacttccactgtgtactcgagcatccaccaaccaggttcaacctgaaaatggaacgtggtaaagacagtagtaaatgacatcctctagaaaccttgctagtttgagtttcatatttacactgaataattgagagcttgatattacattacccgtgaggcaatcatcgagtttgttggctagaagagttagggttgtacagcacagagtaatcaatatagggggactgcaaatcatcacgagagctcgatgcattttggccctttgatgtaaaaagataaatagcaattctgatttagatacaaatggcacagtttcaaacaacctaatatagtaatacctcaaatcagaagttataaggatatcacctgtggaaaacttggaggcgccgttgatgcacccatcaatccatcaggcaaaccaccatttgacatcattttctgcatggcgctcactgtattcctcatgttagccaaatcctcctgcagctttttctgactttcctccattaccatcatcttcttcctcagtgtggcagcctcattttcagcaatctcttttgcatccacagcttccttgaaggatgccttaagggctgccttttccttcaggccactagggctggccccaggttcatggttatgcatcctacccctcctcttttcacccatggctgtgacatcatcactgcgcttacgagccttgtcacgagaacatgactagacggagaaagaaatgtcagttcttttacacttcaaaaggtcaagtacaaaataagagtacgaatttatacacatgtgaaatatagtaatggacttaataatgcaagcttttgtgtaactaatagacttcatatagtatagttgcatcaggttatttttccctctgtcacgcaaataacacaggaatagtttatggttacctcttcgtcaagtatccgtgcaaagctcttcgatcctgtagagctgatataggttgattttgctcgagaagctttgcatctagcacttgcagcctgtatttggggaaaaagagaagggtgtaccaatcgtccaacatgatgcaaaatcaaaatatgactatattgttacaacatatgaaagagaaatgtgcagccttacctgtgcctcttcggtattccaaaatgcaacaaggaatcgccactgttcttttaggacacgaggatcacaatcagcaagacgttcctcttcagttatatgagaatcatagtgttttcgttttaagttacacctccaattcctccactttgttcttatgcatttcagtagcaaggactcggaagatggagcaacataaaatttaagctacaccgacaaacatggagtgggaaagaagctataggcaggacaaaaaacagtattagtaatcataattcataaatcataccttaataatatgccacattacatccttgttctcctttggtatacttttccattttttatatgtaagaggtgccaatattccatcacgcgctagtgtgcccagaaagttaccaaacatggcagcattttttccaataggaaaacctgaattgttcaaggatactggaagccgcacaccttcaggcaaggtccacactttgacacaaagggtagggccacgcctgtgtcctttctttctcttgctacctacttgaaacaaaagtataataactcacctgaacagcacttctttaaataaaatggcaaatgtgaaacatctggattcactcaaaattgtatcttgcttgaaaagggtagtcattttagcttctgtagaaattctacttgtgatcctatcttggtaatttgatccacaccctccacttagacaatgatttccaaaattcttttaacatgaagttttgaccaagtactttttctaaccttttgtactgttattctgttttaaaacagcaatattcctctcaccatcgtttttgacttacaacagactggagtggagtaccagtgtcatgaatagaaaaggtgtggttaacagatcattatggcgcccaaggataactaaaaatgtgtttaagaccctttcagataataaactggtgattatcccttgaaagttaaactggttaccctgttcttcatggttcaactatattttttttaaaaaaaaatctattggggaatcataagtgggagtaatagcactgaagtttatcagcaggtccactggtgatattgcaacatataacagtaacaacaaaggacagtaatacatctaaaaaaaagggacagtaatacacattaccaatattctggccagatggcttctgacaatcacgtgcttgctccgcatcaggaaaatcatgcacaaattcctcatcggaacattcctcggagactagatgattaagtaatgaattagatcttttctttgaaagggcccttctgacctctagagggaatacctgacagtaatgttgagcaaaacgctcaggatcagacatatcaggatttgaaggagttgtggctaaatcagggtcatctggttcactagatatttcccgaggcttctcatgaacagaggatgtgctagggcaaagaccagcaatgattctgtcaatgtctggagggtcagacatgctttgatgtggagaaaaagcacaatgctcgtgatgctcactttctacagattcggcgtctgtcgtagatactaaaacttcacaatttggagaaggagactgatgcagaataggctcctgttctattggttcactagacatagcaaccgccgacacctggcaattcggagaagaaacctgcaggtcaacagggtcattttcaactggttcattttctacaacagcaactgaatctttggccaaacgtttactacgcctaagatgaagacttgaatttgaagaagccatcagccccttcctgttcttctcccgggcttgactagaaggctgcttgcaattttcgacattaatatgcttcttctgagcctcatgattggggggcatgtgtttctgatttatatggctaagctgattcggagagactagcagatcctggttctttagggtcaaattagagtcaactccagttccagtttttggtttgccttttcttccaatatgcttactctgaggatcaaaatccacctgcattgcatgattattaatatcagaggtatgtcctgtgtgctgtataacatggctcagtggctctatctgtctcttgttaacattatttttaggatcaactacgtgtacaatgtcctgctcgctatgccttgcagaagaatcttttctgggtcgaaagcacatggcttctctatgagtcgtttgacttacatcctcgtgaatttcctgatctggatgctctatctgtgcatgttctgcatcattagcataagattgatttgtttgtgtctgctttgtgacctgatcggcggtcgatgtttttctcttccctgcactaacagtgttatgtctaactgagcatccagatttccaactgtcaccccttgcagttgttttatctataacctgaatgcatccctcttctccatgatttgcttggtcaacaggttccggttgcgcctcctctgcatgaatcgcaccatctagacaccctacctgagtgtgctctgcacgaattgcatgagcagtatgcttttgccgcttctgtgtgatctgattatcgtgttcaatacgcctcttatctacactcccaacagcttcgggggcaacagagcacataattctccggttgctatgagttgtagcagtctcatatatcagttcagcatggcttgcttctctataaacttcatggctaagaggcccctcctgtacctcctctgaatgaatgactctatgcaggcgtgctagttgtgccggctttcgctgagtaccgtagcttgaacgctgatcatgtacctgatgcctggccgcttttatcggcaacaacctattcttcacacttacaataccaggttcaactgaacatcggttcctctgctggatattacttgaaacaatctcatgagcttcctctccaccaaacacaccatcaggatactcttcttcatcctgctgtagatgaataagacgatcgggatgctgtatccgtgaccgttcaagaggaaatagtctatcatcagcttctgctcgggcaaatcctgaacgaactgcagaattagggcgcctttgccatgcctgcatcacagcagaaggagatgcaattaaaaccctagccaaggtaaagcaatggattgaaaacgtcggtactagctcggctagcttcgattgaactgagatttcgtcgatgttgagagatcgaacgctacaagccaaatggtgcatttgatttgaccagaacccaacccacccacctcccggccaccgaggatgggttgcgcgggggcgggggcgaccggcaccggcaccggcacggcggccgtcgcggcggaggacaggatgtagttccggagccgcgcggggtagacggcgagctcggcgccgcagagcgggcaggcgcagcgcgacagcccgacggggacgctcaggagctcgccgcaggagccgcagggcagccgcgccccgcgcgcgtccgcggcaccccgggggaggggcagcgccctccgccgcggcggcggcggggccggcatgagatccggcgggagcgactgcggcgtggcgcagtccgggcagacgaactccgtcagcccccgctccacctccagcgtctccccgcaccccgcgcaccccacctccaggatctcgtcgggttcctcgtcagctgctgccaccgccatcgccaccggcggcggcggcggcgccattgccttcagccctcagcgcagtagcgtcggagtgtggaggcgaacgtttgggccgtcgagacgtcaggtcgtcactaaaaggcaaacaaacatcacttggggtgtgtttagttcacaccaaacttcccccaactcccaactttccatcacatcacatcacatcacattcaaaactttcctacagacataaactcccaactttttttttcaaactaccaactttccctaaacttctccgcctatatggttctctaccctacacctacacccaaatctaggtaaattttggtactaatactaattttttctggtagggtaaagtaggctagcccatgtttggtttgataccaatattaaaccaaagtttagtatggtgaagaagtttctagaatgtgatcaaattgagtatgggcattaccaattgtttggtttcaattcaaactagcatgtttactattcaaagttaccaaaattttggtagagcgcattttggcttcaatccaaaacagcccttgaagcacagaaaattcgtcgcgtttttgccaattcaactcgtagtacaattagaaaacacaaggtataaccctatagagagtatgtttgggggagtttctagctgctgcaacttctcccataaccaaaagctcccttaaatagtctatgttttggtacagattctgagaagttgtagatatagaatccagaaaatgaactataagctcgaaggcagaagctgagaaacccaacttttctatattctcagaaactggctaccaattaactgcttctcagaatctcaagcttcactaaacacgcccaaaatcatttcacaggaagggaaatgcgaagtgaagtagttctagtcagtgtaaacaaaacagaagagagtatcctgttacagtagccaataaaacagaagagtacaagcactgggctccgggtttagagagccaacattacacatgaacggccaactaaacgtctaaacctcttcgtttcatacaccattccacgatcaagatggaatcaaccatgcatattggcattgtctgtggtgcgattatcatcgaaatcgtggactaggggaggcagaaggatcgtacagtgcagagtagtcaagatatggctgcaaaatctcatgagcgcttcgtgaattttggacctggaatggatgaggaggaagcatggattccggatcagaaacagtgggataagctgttacaatgatagatactttctggaggtgcaaaatggattatagctggatactccatttacctgtggaaagttttgcgtttgaccatccgataggtcaccagttgacgtcgtcttctgcatagcactaactgtactcttcatattcgccaaatcctcttgcagtttcttctgactttcttccattgccaccatcttcttcctcagcgtcgctgcctcgtcttcagcctttcttttagcctcctcagcttccttgaaggatgcctgcaagactgccttccgacgatgacccctcttcccacgcaggccaatggagcaggattcaagtccgactttgtgtgctgcagagtcacttcctgagcattcggcttgcttatgagattgttcacggactcgtgcctgcatggaaaataaaactcagatctcaaccagaaaattattagtataaattacttccttgtgtctcacaatgatatcagctttttccttcttcataggcttcccgtttctgtgtgtatgagtcaataggaacaaatccgcagcagtgggctcctcattgttaggccgcttctgcttctgttgcatgcggtaatacaattagcacgtcattggtgatagtgaaagcaaagcaacaggattttaattacctcctccctcaattatccgtgcaaagctctttgttcccctttgcagtatgcgtagcggttacatttgcccgacaagctttatttcgactactcacagcctgatcaaagataaagttaccaatcatttaacaagcctgccaaattgcaaacaagatggcaagaaaatagaatggtcggtgttaccttcgctttttccgtaccccaatatgcaactaaatattgccactgttccttgagaacgcgaggattttgatcagcaaggcattcctccaccgtttcatgagtatcataatgtttttgttttaagagagctttccaactcttccactttcttcctatacacttcatgatccagaattcagcagctggagcaatgtcaaatttgagctacatcaacaaacaaggggtgtcagagaagaaactaaaggcacagaaagcagcagtaaccatataaaactgcataccttgacaatatgatacatcacatccttgtttttctctggaacacgtctccaatcttgatgtgtcagaggtgccaatattccgtcacgtgctaatgcacccagaaaggtagataaggtgcctgcctctttcccaacaggctcccccgaagcgttcaatagcactggaatgcggacacccttaggcaaattccacaccttgagacagagtgtaagaccacgaccacgaccacacccttgattcctcttggtacctgcttgaaaggaaaaaaaaacaatgagacaatcagatgagcataacaagaacagctgtcaaatggtggtgttctttatagacagagtatgaataaggaaatgaacaggatttgataatgaaacaggggagtgtgaacagtttgtttcaaacaaatccaatttattatatgtttagtggtctacatgggaaaatgaatattttagtgtgacaagttcctctcggtacccacgagtctccattcttctgtggattcagcatggataaaatgcaaaaaaaataataaaaaaaaaaccctccaactatggtaatcatgggcagatagcttactgagttcaaaatgatatgtattatagcttaataagactcataatcgctgctcctaatttccaaagaaagaaaacacttctaatccccaagaattctttatagatatgtttaccctcagcagtgtaacggataagagtgaaggagaatagcttaatgagtttaaaaggatttgcatcattgcttaataagattcataatcccaatgaaattattttatctttataaggaggtttattctcatcagtgtaaaatagacaataataagagcaaggacaatggctcactgagttcaaaaggatatgtaccagggcttaataagattcgtcatccttagaaaaatattttatctttatatggaggcttattcgccctaatgtgaggcacaataataagagtgaagcgtaatagcctactgagttaaaaaggatatgggttgttgcttaataagattcataatcccaaagaaaatatctctttctaagaaaacttattctccatggtgcaacacataataataagagtgaaggacaatagaagtgtgaattaccaacattccagcgttcgtcgcaatcttcagaatcacttaatgcatgcacatcaccagaacttgcctgtgacatcgcacgctcaaatgatgaattactagatcttagcttcgcaagggcctttctaacttcctgcggaacgtagttacatgcaaaatgctcaggatcagacatgtcgatatcggaaggtggtggtgtagttaactggacgttgtcaaactcattagagactttttcaggggtcatatgcctaggggatgaactagggcatatgctgttaatgattctgtcgatatctggagagttagacaaactctgatctggagaaggcatatacagatcatcaggctcattttctgatggttcactgtctgtgatggcagctggcatgtggccagttgaagatgcagcttgcctctcaacaggatccctgtgtattgattcagtatccatgactgcagcagatacttggtcattttgagaaacctgctgctcaaaagact

SEQ ID NO: 25662 - DNA, 415 bp, Oryza sativa
caaatctctgaccctttgcttctcgtagcaaaagaggttaactaattgtctaactgctttacggtcaaagatctttcgacactcctcttcctggccaggggaccacttgtagcgtttctgcattattttaaataataagcacacatacttttaaatctcaatgaaaatagtatgaaacatgcccccgtaagttactcacaaggaattcatccaatacagtatctcttatatctgaaggacattggtgccaatggaaaaccgcaagctcacagggttggccattggtacccactgaaacataggttccaggatagttctgcttgataagaagggatagggtggttgtcaccttcaaacaggcatggatgcacagtccagtttctagttgcataaatcaatttttcatacacatgaa

SEQ ID NO: 25663 - DNA, 479 bp, Oryza sativa
ggatacttgaaccatctgggtcaatgggaagaatatccgcatgttgccagtgcagatggaactgatgctgcatctcctgtaagtacatggttattatacacctcccctctttcttaatgctttcaccatcttgttctgctaccatgattttacaagaagggtcagttactaatgtaatctccttgatatgcaaatgttcaggtgatgtacagttcttattcccctgtgccaaccatgggagacagccaaccatattaccctttgcactgccctctgtcaagtccttactatcagccacctgcttctcctagcatgggatattcaaattctgcaactgggatgtcgcagtttgatcctatgcaagagtattaccttcctgatggacttctgtattcaccaactcctgggttccaccagcatttcggttccttcgatggaagtaagatttcctttttaatctctctatggcttctcattat

SEQ ID NO: 25664 - DNA, 2213 bp, Oryza sativa
aagttctcctgttgagatgacagttttacactcttggtaatttcagctccatcagtatcaatcaacagagacaaggataatatggaaatgagctaatctcacagaacattttacacttgtgtattcatcaatggcaggcactacaaactcagccagtaactaggagctgaatctaggaaacgggtaaggaagattaaccgaaagcttggcattagcagaactctgccacgggaacatttcaaattgtacatactatatactctgaacgcagcaaagtttgtgcatgttccagcagggggattatataacacaggcataaagcagcaggaacatgcgtcagttacaacaaaaggaaatctgcatgatgtttcgacaaaaggatagagcctaacacaccaaagcagtctgaaaacaccactctaagagagaaatattttgaatatagaactgccttacacctgagtatataactcagtcgtacactcaagttggatttctacttcagcggcgcagagtctaacatgtgataaatacactcgattatgcttccttccatcaaggtcttcgcaactctctgttgtctcattcaatcagttgtcatcggttgggagatgcagcaccgaaatcgggccttgcggactgtgctcaggatcaccacctcagcatgctccagcatcctaactacttcggtgaatggagggcgaacatcagggtttggatcccagcaccttgtcatgatctcactgagaacaggcaagcagtcctgtggtatggctggacggacacccttgttcaccacagcaaatgcagcttgtactgctgtcatgttagcgaaagggagcatgccagtaatgagctcccatagaacaatgccaaagctatagacatctactttctggtcatatggcctgtgctgaatcatttctctgcaggatcaaaataggcgagtcagacatcaggaaccaagttaataagatgaatgtattgaacgaattacaatttgaaacagtaaatagaaaacaactcattgctcagtatcctattgaaaaatattacgatgtactaccatgaagtaaaacacaacaaggtcagtattggcaagttgtagctttcatgctggcttcttcttttccagactgctaggaaacacagtgttagcaatattaaggcatgaggaataatgactaaactgactggatttcttatagagataaccatccacttgctttataaaccatcaatgtacatgcatgtgccactagacttgagaaagaatctagttagtactcactgatggaaactcaaaagtgtggccaaggatttagagttcaggacaactaacaggagattattcaaacaaattgtgaccttgtatgataaaccaatcaaaccatgtacccaacctcagatttaacttaagtactactacagtctactagcatcccgagatggtagccatgatgatcacattgaacattaaatattcttgactccagaaagaatctgattgacatttcacctacaaagttacacaaacctaaatgagtaacaactggtgacaggattagattctaatgacccaataacaggtaataagtattttaagggctgaaatgaagccttctagtgatgcagaagaaaaggaacgaggcaaagacatatgcacacatttgttatagtttgtaacagagattctgttaaggtaattcagatctatcagcaatcatatggtaaacagattgcgctggtaaggactaaggaatgcactgaagacaagcaattgatgtgcactaccctaccatattgcaagacctatatctgatttatggtaagtacctgcatatatgatatttcaacctggaatccttaatgctcaaggcccaacgtggttttaagcaaggcctaacaagaacttgctacatgaccaaacagaaccttaaggagggtcccacatggtaaaaaaaaatcccaactagactccccatccacctctcccttatattgagagtcagtcatcgggcaggcagcgaaggcctgctaaagtggtgcaatctgaagtcaggcatgtagatccaggaggcagtaaccaccaggcaacagggacagcatccccaagaggaaaagaccaagggagggcagcaagaacctgggaagttactcgagcgctagcatccaatggacccaggaccaaggggcactgtccccatcgagca

SEQ ID NO: 25665 - DNA, 18101 bp, Oryza sativa
gaaacactcttattgtccacaatgtgggtgccctagctggaatatatcctctagttttccatttatgcatacggtaagctgtcatctcttcttaatcaaagcttcccttaactgtccgaacaacaaagcattaatttcattccatctatggctatgcagtctaaagatcctcaattaatagaacaaggaaaaattgttatagtacgcctttaactaacatactatatcctacttggtaaatagcattaatgtagttgttttattcagtaaccaaacaaaattctcttaactaaaataaagtgttgcacgcggctagaactaacagataatatggtaaatagtattaatgtagttgttttattcaacttacggggccatccaacgataggttcctgtttcaggtgtcatcccctcggttttgacttcaatcctggcaactccaaagtctgctatcttaatcgatttatcgccagaaatcaagagattatctgacttgaggtccctatgaatgaacccaagagcatggacgtaggccatgccccttgcaacatccaaggcttgcttcacagcaagctttaatggaactgacctgttctgcctcttcatcagaaactgcctaactgagccaccctttgcatactctgtcacaatgcaccaaaccatcggcttcctgcatgccccaataaatttaactatgttgggatgcctcaaagttgcaagcatcataacttcttgcacaaactgttgttccattagcccggctctctccggatccgcctctggcctctccaaaagcttgatggcaacatcctccccattgtaggtgcccttgtatagcttcccaaatgcaccctgtgcaaagggcatccccatgtggagcttacccaaatcgatcgtccactcctcgtaatccttgagcgtctcagtcgggtacctcgggtccatcagtgcccgtgcaagcgcatcctcactcaacgcatgcgacacccgcccggggcggaaaatgctgtgcccaaccgagtaattggctgcgacatgccccctgaggcccgggtggttgagcatcctggtgtgggaatcactagacccgacgctgctgttatccaccgacattgccacggagccaccgccatgcgtgctggtctgcaggctattgaggctatcgatcgacatgttggagctctccccgagcttccggtagtacgccatgtcgcagaaattcccaccaatgtcgtcatggccgccggcgccgccgacgacgccgcccatcatgccggcgaacttggggccttccaccatcctcctcctcctcctcctcccaacaatcagcgccttctcaactcctcctatctcctcacctcacctcacctcccttccctactccccaagggcggatctatcgtcgcgcatagagggttcagctgaacccccaaatttctctgcaaacaaaccgccattagtaccaagcttaaggccgaaacaaaagcttccacatctacaagagaagctaaggtcaagtgcaaagagaaatggcgcgggtggagagaaatgaggaagaggacgtgagctcaccggcgggatgcagcaggacgccggccgccgctactgctcgccggggtggagatcggcggtgctcggcgcaggcggcgggcgggcgagctcgcgaggaggagacggggagacgaggcgaaggggagatcgactagggtagggaggagcaacgaggagacgagtcagaggcagctgccggtattggctttttctatagccaggtgactgagcttagcagtggtggttaaggaagctaatcaactttcctactaatgaaaatggtattaattaagctaatctaatcacttgctgatggagttatgcaaatgtgtgtttgccctatctgcagtcgaggatacatgatcatacggcctgtttagatagtttaaaattatgataagcagctgattggtagcgaaatactgtgttttccaccttttttttctatataattttttagattctaccattacattttatcagaatatagacaaaaactaaatcatttagagagtttttaattttaggagaagctgcagcagttaatttttttttcaaaccgcacctatccatctcggtctttcactatcccatctttctctctcttattttattttattttttttttggctcttgtgaatttgtctatgacctgaccgtatcacaaagcaaaaggcccatgtgacacaatggggagagtcggtgattactagcggaggggaaaccggtagtaacgcgcacatacaccgcgacacagactgcacaggcccgtgatgatgatttggtaggtgatcacctcgaaatgattggggatttttttttctttgcgaggacgacgacgactccccggcccgttgatgcgtgccaaccccgcggcagctgtgcgcccgcgcaccggtgcaccagggcgtgcgtgcgccccgttctttgcgcgttacgacgttgcgctcccgcatcccgctccacgcggatgcacgtacacgggacacggctcgtggttgtggacggggcgcgatcagagtgcgattcagcggaagcgtgtgatggagggaggcatcagcatcaggcatgggacgatgggagatcacatcgaccgcgttcgtggtgctttacactacacgtgcgtgcttggtttagcattgagctaagggccggtttagatcctctaaaatgattaaaattttaccgttttagaacattttttagcaaaataaatgtaaaaagtaggcaagttggcatttgtcatttgatagtaatctgaagaaaaaaaaatcaggccccgtgcataagagaggcggcagcaattaatggcaaaactttaccatgcatctaaatactaacttataaaattgcaatgctaaatctttttccatcaaaacttataccaaaaaatttaccgcagcaagttgatctaagcagacaataagccagtttttctgtgtatgatgtgtctggtaggaggtggcacaagcgcacaacacaaacgggcaaagggtgaaagggtttcacctacaaaatgcttttgattgcttcgttttttttcactgtttatcagcgtacagtaacaacaaaggttgaactgtatatttccagtttttttaaagaaaaaacctgtatatttccctttccttattctatgggccgacaaatccctcatatacggcccatcactataagcccagatttatgctacaaggcccatagcgtcacctcgccacgaaacggaataagatcactttgacttcctcaactgaccaccgaatctaaatcgtatccctcaactgcaataccaaaaatcttgacccccccccgaacttgcaaaaccggtgcaatttgactctcttagtggttttggatggcggtttcactgacgtggcgcacacgtggcagtgttgacctgttctttgttccacgtagcattgacgtggcgcttatgtggcattaaaataaaaaaaatatatgcggggcccatttatcattcacacaaaaaaaattgtgggacccactgacatgtgggtcccacatgtcatcttctctctcactacccttcttcctcctctctcccttatttctctctctctccccttgacatgagccggcggcaggcgggggctcggtggtggcatcggcgagcgggtgccggagtggtggctgcggtgggcggtggacctcgagcgacaagcccgggagcagctcctccttgaaatgggggtggacctcgggcgacgtgcgacggaatgcgtcgggggagatgggagcacgctcccaaccgccgctcctcgtccccactctgtgttgtgggtagtgaggagggcggcggccgcggcgtcgacaacgaggtgggtggtggccgcggtggaaagggagcaatagctcgcgcgccccaacgcacggcggcggactggccttgagcgctccagtgtcgacctggccatgatgcggagcggcgattggagctcctcctcctcctccaacacgggcccccttgtcacaccctgaaaattcaaaatatttaaattgttgtttaattggaatttttagaaataattttaaaagtcttgaaaagaaaatctaattttaattaataaattccaatataaaatggggccagataaaatttcattaaatactttgcttaattctataattcctagatttttctgggatttatttgagctaaggaagtatttttaataaatggaattgcatttaaggaataatttaaattgaaaaaggttttaaaaagtctcttttggctttgggccgaaagtcggcccaaaaccgctctctctctcctcggcccagttcggcccagtccgcagccgtcgcgtgcgcgcgttcggacgctgacaggtgggtcccacctgtcggacccatcgtctaccttcggccgccgccgcccgaaaccctagcgcgccgccgccgccgttcctttccaaatccggccgttcctttccttctccggccgaattgtttgaggggaaacaatctccgggatctcctctaccttttctcctttggaatctttggctaaatcgttttggaagttcgtggaatcgagttcgtttcggatcggtttccctctctccaagccgagctttccttcgccgttgccgccgccttgggccttcgccgccgcctctgagcccctttaaaaggacccccggtgtctcctctacccgttgccaccttcgccttcgcctctcgtcgtcggaaaagccctagcgccgtgtgccctagctttgccgtcgccgccgccgctccagccgtgcgccgccgtcgttttagccgtcgccgtcgctcgggaagaccaccgtcgtgctcgccaagtcgtcgccgtcctcgtccgccccttcgccgtcgccggagatcgtcggagcttcgtcgccatcgtcaagccgaagagcttcgccgcttcctcctcgtcgccgtcgccgtccgttgaccttccgccgtcgttttggtcgccggtgagttcgccgtgccgcccgcttcgtcttggtgccctccgtttgcgtcctcacgccgccgttcgccggcgagcgtgcgccgttcgagccgtctcctccgccgagccgccgccgctgtcggtgacgtcaccgctgacgtcatcggggtcgtccgccgtgagccgccgtggacccgatcgatctcggccgtccgttttggattggttcgatctcggccgtccgttcgtgtgaaccgccgcccgtgcgcccggtccaccaaaccctagcccgctgacgcaataaaccctcttttccttttcaaaaataattcattattgcgtcataattcaattttaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctactgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcagttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcagtggattgtgttatgcgaggggtattgtcacaactcctttccgagatactgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcaccatagtaaatgatgcttaaattggtaataatttgattagctcctggtttggaatggaatattcctggtgtggagatagaactgtgcagccggggtggttgttcagaatggttgggcctatacaacagggtatgttgtatagcgttggattaatattgtttaattacttaactgttttatcgaattctcaaatgtttgctaaatgctgcttttgcaaatgcaaccctactatgccatcctttgttatcctgtgcacttgcatatttgctacgtggctcgctgagtatgtcatatactcaccttgcaatcattcatcagaggaagagttctacaatgaggctgatggagtggaggattaggtgtagccttggtcaagctgcctgtggagtggagccgtctgcgccgtttatttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagcccctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatcaaaaaacttgtgctattaattggataaaggtcttaactccctcctttcacttgtctttagatgccgcgttacaagcctgagtacctgtttggtgttgagggttttgtccaggagttgcgttcgatgtcctttgtcattggatttgggactgcccctttttatgcccagattcctcatgatcgtcatgaagagaagtgccgagtcaaagtcaccttgaacagtaatagtgaagatatccccttagtgatgtttgaagctggaggaagaaactacatccatgcatgtcaggaggtggcaaggatcgccataggagagctccgtgatcgctacagtgatcaattggccgacactgagtatcgctaccatcctcgtcaaccccagggaagtgaccgtggcagctatcttgagactgaaggaattgagaatgatgctaccacgaagcatttggttgagatgttgtgggctatggatgaaagtcgtgcggagactgtgttagccgctcaagatcgtgaagaccggaatcgtggtaagatttgtaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaagatgataaagacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtctttagtttgtaataatgaaactcagttaagatcaataaaagttaaagtaattctctgtcctaagtagtttccccggtttctcttcttgtgccctgtccatgccagatggtgaacactcgcagcaacgggaatggtcccaacaaccccaataacaacaatggagagaatcccattctggcccaagttcttgctcaacagacacagcttatgaacatgatgatgcagcaatttcagaatcaggaaaaccaaggaaataaccatgcacctccccagaacaagttagcagaatttcttcgtgtgaggccacctgttttctctagtaccactaatcctgttgaagctagtgattggctgcatgccatagagaagaagttggatttacttcagtgcactgatcaggagaaggtctcatttgcatcacatcagttgcatggccctgcctctgaatggtgggatcacttccgccttaacaggactactgctgaacctatcatttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcatcttactttaggaccccagcccatgccacagggaggttcttcgtctgttgttcgtccgcagcgtcagttcttcaacaacaatgctggcaacaacatccgtaatcaaggtccacgtcctgttgcagctccagcacagcaacaacctgtcaagagggagcaaggcagcaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctatgagttttgtgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacaaaaaagtaactctcaccagctatgatggtcgagttgtaactgttcatgcattgtcatctgagtctttaaggtcaagactgaaccagataactttggaagagatttctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccagttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggatttaccaatgcccctgctttcttcatgaacttgatgaataaggtgtttatggaatacctagacaagttcgtggtggtctttattgatgatattcttatctactctcgaaccaaagaagagcatgaggaacatcttcgtcttgcattggagaagctacgagaacatcaactgtatgctaagtttagcaagtgtgaattttggttgtctgaagtgaaattccttggtcacgtcatctcagccggaggagttaccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgcgatgcatccaaacttgggttaggttgtgttctgatgcaagatgggaatgtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcatgatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcattgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatctgtgtccccgacaacaaagatctaaaagatgcagttttgaaagaagctcatgatactttatactccattcaccctggtagtactaagatgtaccaggatctcaaggaaagattttggtgggcaagtatgaagcgtgaaatcgcggaatatgtagcagtatgtgatgtttgtcagcgagtcaaggcagaacatcagaaacccgccggtttgttgcagcctttgaagattcctgaatggaaatgggaagaaataggtatggattttattactggtttacccagaacgtcatcaggccatgactctatttgggtgatagtcgacagacttaccaaagtggctcattttattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccacagacagacggacaaaccgaaagggtgaatcagattttggaagacatgttgagagcttgtgctttagatttcggtggaagttgggataagaatctaccttatgcagaattttcatacaacaacagttatcaagctagtctacagatggcttcttacgaagcactgtatggtcggaagtgtcgcactccgcttttgtgggatcaaacgggagaacgtcaggttttcgggactgatattctaagagaagcagaagaaaaggtaaaaattattcaagaaagattgcgagtggctcaatctcgtcataagagttatgccgacaatcgccgtagagatttgagttttgaagaaggagactatgtgtatcttcgtgtcacgcctcttcgaggagttcatcgttttcacaccaaaggaaaattggcaccgcgttttgtgggaccttataagattgtcagtagaagaggagaggttgcttatcagttagaattacctcaatctttggcaggagtccataatgtgttccatgtgtcacaattgaaaaaaatgtttaagtgtacctaccgaagaagctaatattgagcagatagaagtccaagaggatttgacttatgttgagaaaccaatccgtatcctggaaacaaatgagagaagaaccaggaatcgagttatccgtttctgcaaagttcaatggagtaatcactcggaagaagaatcaacttgggaacgagaagatgaattgaagtcagctcatccgcatctgttcgccagttcttccgaatctcgaggacgagattctgtttaagggggggtaggtttgtcacaccctgaaaattcaaaatatttaaattgttgtttaattggaatttttagaaataattttaaaagtcttgaaaagaaaatctaattttaattaataaattccaatataaaatggggccagataaaatttcattaaatactttgcttaattctataattcctagatttttgtgggatttatttgagctaaggaagtatttttaataaatggaattgcatttaaggaataatttaaattgaaaaaggttttaaaaagtctcttttggctttgggccgaaagtcggcccaaaaccgctctctctctcctcggcccagttcggcccagtccgcagccgtcgcgcgcgcgcgttcggacgctgacaggtgggtcccacctgtcggacccatcgtctaccttcggccgccgccgcccgaaaccctagcgcgccgccgccgccgttcctttccaaatccggccgttcctttccttctccggccgaattgtttgaggggaaacaatctccgggatctcctctaccttttctcctttggaatctttggctaaatcgttttggaagttcgtggaatcgagttcgtttcggatcggtttccctctctccaagccgagctttccttcgccgttgccgccgccttgggccttcgccgccgcctctgagcccctttaaaaggacccccggtgtctcctctacccgttgccaccttcgccttcgcctctcgtcgtcggaaaagccctagcgccgtgtgccctagctttgccgtcgccgccgccgctccagccgtgcgccgccgtcgttttagccgtcgccgtcgctcgggaagaccaccgtcgtgctcgccaagtcgtcgccgtcctcgtccgccccttcgccgtcgccggagatcgtcggagcttcgtcgccatcgtcaagccgaagagcttcgccgcttcctcctcgtcgccgtcgccgtccgttgaccttccgcagaccgcccccttcttcctcttggatttgccaccggccgcgcccgcagcggcctcgtggaggcttgggaagttggcggcaggagcagggggctcggtggccgccggggcggcagcgttttcgcgctcctccacctcctcctcggtgcgctcggtgtcccccgctgcgcacattccttcgtgccaccgcgcccgacttgctccctccccgccgtggccgccccgcgccatcatcgtcggaatcatcctgctcgtcgctgttgtgctctcaccgccatgccctcgctgagcgggcgctcaaggtgccctcgccgccatgccctcgccccgccaccatccccgaatccctactgctgctgcaacggcggcgatagaggaggcgcgaagactgtcggctgccgctccgtccattgcctgccgtcgccgtcgccgccgccgccgctccccacgcacgaagagaaagagggagagatagagaagggaggagggggaggaggaagaagggataggagagggtgacatgtgggacacacatgtcagtgggtcccacaattctttttttgtgtgaatgataaatgggtcccgcatatattttttttattttaatgccacatatgcgccacgtcaatgccacgtggaacaaagaccaagtcaacactgccacgtgtgcgctacgtcagcgaaacaaccatccaaaaccaccaaggaagtcaaattacaccggttttgtaagttcggagggtcaagatttctggtattgtggttgagggatacgatttagattcggtggtcagttgagggagtcgaagtgatcttattccccacgaaaccgactcaaattattctccagcccacgaagcagccgccgaataagatcacgctcgcctcctcctcctcctcccctctcatcccgtctccctcccgaattggggatctcgcgagtcgcgacgaaccaaaccgatcgaaaccctagctagggtttcgccgcaccaccaccaccacctccccggccgctccccaccgccgccgccgccatgtacaacggcatcggtctccagaccgcgcgggggtcgggcacgaatgggtacgtgcagaccaacaagttcttcatcaagccgcggtcgtcgtcggcgggcgggcccccgagggcggcgccggccccggggttcgacgacgccggcgggggcctcggcgggatgcggaagccgaacaaggagatcctggagcacgaccggaagcggcaggtggagctgcggctgctcctgctgagggacgcgctcgaggagcaggggtacacggagggggagatcgaggagcgcgtcgaggaggcgcgcaaggaggccgagatcgaggccgcggcggccgcggccgccgaggaggaaggacgcggcgcggggcggcagccactcccgggcaaagggtatgtgtagagatcgaagtgttcgtcttatttccgtttactgtgctggctatagtgtttgtcatgtgtactaggagaggaaggctggtgactcatgcttaaaagttaataattttcgatacagtgtttggttgtgtgttattcctgaaacaaattgttactcgtagttcatcatgctagcttgttcttgttactgtgctggctatactgtttgtcatgtgtaggagagcagggctggtgactcatggtttaaaagtttatatttgttcgatacagcgttaagattgtttcatttctataactgaactgttacttgtgtttcatcacgctagtttcatttctataactgaactgttattgtttcatttctactatactagtatttttttttactatagttccaagtttccaactagcatacgtgatacgactgcatatgcatgggtttctttatttttgctgttatatgttcatttgtttgttctgtttctgtacggttatttaatttctcacaggaaggttatggtcattcaatttcttacaagaagtgaattctctcagtttttcagacacacaaagccaccacgttgctgcaaggaaggagaagcagcttgagacgctgagggctgctcttggtttggatgttgatgataaagcgaagaagaacgctgatgtagaaagtgatgtggaatctggggagcttgttcctgggaaggagtatgaaggtttggaaatagatgggccagaagatggcaagactttaaaggatgacagaaggcatgcaaagaagggtaagaaggataaagggagtgatgcaaagagtcatggcaaaagttctaggaagattaaacttggtcatgattcagattcagatcatgatgataacaagaagaagaagaagaattctcgctatggttcagaagatgattctgaggctaaatatgatgaaaagaagcacagtaaacacttgaagaattctcgccatgatacagatgatgattctgagagtgaccataagaatgcaaagtgtaaaaagagttctcgccatgattcagagtctgattctgagagtgatcataagaatgcaaggcgtggaaagagctctcgccatgattcagagtctgattcagatggtgattatggcaagaagacaacaaaacatggcaagaacgatcgtgatgagagaaagaaaaggcctgccacgatctctcgccgacatgactcagaagatgaaaagcctagaaagggtaagcgcatggatgattcagatactgactcggagggtgatggttcgttcagtgagtcggacagcgactatgatcggaagaagaagaaatctacaaatagttctcgcaatgaatctaaagatgataagccccgaagaaaggctcctaaggacaagtattctgatggcccagaaagtggctcagacagtgatcatggtggaaaatcaaagtattcaaagatttctcgccgtgattctgaacttcagtcccgaaaggatgctgataaacaggaccagtaccgtgataaattgaagagtgagtttgctagcgatggctatggagagaagaaatctgttaagatcccatacaatgacttgaaagatgacaagccaagcagcaaggttgttcggaaggaccggtacagtgatgaatcagagactgattcagaaacttatgttaagaaaaagaagaatcttccgaagtcctatcaccatagtgataaaccagcacaaagaggtaaagaaaaggaagagaactctggaaagaatgttgataagcgcaagaggcatgatactgattctgattcagatagccatgctcgtgaaaggaaaagacaccttgatgcacgggcgagtttggctgcccaaaagaaaagaagtgtgactagctcaagtgagagttcagagagttcagattacagcagtagcagtgatagtgaatcagatgtgagttctgacagccgcgaggataggaaatcagcaagacagttgaagcatgatgagttagagagaaagaaaaggagtcaagacgagaagagaaaggagctagagaagcaaaagcaggaggaagagagaaaagagctggacaggcagaagcagagggaggaagagagaaaggctaaagagcttgagaagcagaagcagagggaggaagagagaaaggcattggagaagcagaagcagggggagagggacggagatagatatgagcgtgaccatgaggggaggaaaggcgaaaatgatgttgaaagagactacaaaagaaaagttggagaagataggtatgatccaagcaggaggcaggatgaggataggtatgatccaaacaggagacatgatgaagatatgtatgatccaaataggaggcatgaagaacatggtcgacgaagaaatagagattttgatagccgtgatccgaaaaggtctagacatgatgattcttatcatcattctcgaagggactatgaacagcgttattctagagatgaatatagagacaggaggcatcgttgaatgcaagtcatgtgtaagtctgattttgtcctctgttttgtttgtgtatatttggattgttttaaacaaacacattttgttcattccaaagtctgttgtttagtaatattagaagttatgttttttcggatatggagttaactttgtgcattgtcaatgggctatcacagat

SEQ ID NO: 25666 - DNA, 690 bp, Oryza sativa
gcctgctgtttgttgccccagaggaggacaacatggagacgatcgtcgcgcagatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgctt

SEQ ID NO: 25667 - DNA, 746 bp, Oryza sativa
cggctttgatcagtagacgtaccatctcttcaggttggtctctgaccggcagcagtcgttcagccaggtgatgaaccgggtgacactgacgagctggatcaccagaaacgccctgtcaaaattgcgcatcatatgatccatcagttttacgtcgataacgagacccgattcagctgaacgtgctgaaaaacgtgtgttggttgcgtgtatgcatctctagttgatgcaagaggccggaagttatagtattttatattaaaaaagaaaatgtgcatgcggggcttaccctgctccgaaatgcgcgatcttccctgaaaatatgaaaattcagacgaacaccatgagcaaagaggaatcaagaacgggtgggtgagaggagctgaggagggtgacaatggcaacactgaccgtagagctggatgagaggcgaggggaggaagaaggggacgacggtgaagcccatccacagcacgatcttcgccggccaccactcggagtgccatgaattccggcgatcgtgcgtcttcctcgtcctcaccgtcgacaagaacatcacgaagaagaacagctggtgatcgccgtcgtcaaggacatcaaattcacaaaatgcaggaaaactcaattcatcccttaagatgataactcctcatttttgtatgtcacttaaaaagtcattgaaaatttgaaaaaaaattagtacgataaatcaatatgtgatgtcacttcacaaacatgtaaattcaaaa

SEQ ID NO: 25668 - DNA, 1289 bp, Oryza sativa
tcacgccatggccctgtcttcgctcttctccagctccctgcctccggtgcaggccggagtgtagtgggaccccctaccccacccttccttgtgataggagtttttgtttctttcttagtagcttatcttccttatatttgtttttttttcttttttttccttgacccctgtcaacggccttttgactgtgtgcgttgtgtaatcaaactctgctctcttcttctaatatattgacgtgcaattcttttgcgcgttcgaaaaaagatagcccaaatgtacgcaagatcggttaggcttcaaaagaccacacaacttttaatcaaaggttagatattttttattaacacaataaagctaatagaaagtgctcgattagtatagtgcaatggcaatgggtgtatgatttcaagtccgagttctcgtattcaatactcaactcccccataaacacatatgagtgagcaaaggatggcgctcccatccatggtgttttttcgtgtttcacctagggcagctagccgtagccgcgaagcaaaggatggcgctcctatccatggttttccaaagatctctgcggccgttatcaagacgaacgtggactggtgagagcggtgaatcggtgatcatcgccaggttggctctcggttcctcattggttcctcctcctttgctcctgatccgtagacaaaagggtgaggaagagttttatctaggatttggttttccactgttgtaaactgatcatatctttattctgctgatactatggtggtgtttgaatgtactgaagatgaagattaagtgtttcacgtaaaatgaggtgttaataacgtatggttaattgagttttaattattacaaacttgaaaaatggattaatctgatattttagaacaactttcatataataagttttcacacgaagcacaccatttagccatttaaaaagcgtgtcaccatgtatacttggttgattaaaactatccgctagtacttcgtccttccgtaccgtgaaagatatgaacaaataagaacgtttgtagcccaatactcattagaccttgttcggttgggccgggaatggccgggatcggggcccaatccccgtggatcatcctggcgaggaaacaatcccggcccatgcgaaattgtgccttcggttaaggaataagtccactttgactcccttaaaagtaacccgaatctaatatgtgaccctcaaccgcaaaaccggatagaatgactccctaaactattgaaaccagtgcatttggttttggagggtggtt

SEQ ID NO: 25669 - DNA, 2347 bp, Oryza sativa
gcaaagcaacgtatgatgtcattttgaatctttgaagatgtatactgactgttaccaggagcatctttacctgcaaccttgtgtaaagctggattttgctctgcggtataagcatgaaattccttgaaatttcctttattgagagactcctcactctcatcatggccccgaaaaggcatacctagcttcagtaagattctagtaacatcaattgagccatttaaccgagtataataagcaattttctcagcattactttggttgttcaaagaaacatcaatgtgctgctcttttttcagtaaagcatcacaatccctcattgcttggttatgaacactatcaatatcaccaacatgttccttcaatctgtgttttttgttccaactagaccacccacttgtaacaaatgcatcataccctgctgatttcttattagggtctctgaacaaaaagcaataaaagcaataaactttatctttggactcactatactcaagccaactgccaaactcatcataccattcaggattaaattttctatctctaccaccaatatttgtaacagggagatcatccggacgaggttgacaaggcccattgtccaagtattttcttcttaccatctccttttgattgggatgataatcctcaattcttttccttttgccaggatcaaattgaatctccacttcccaattgatatcttcaggaacatctcttctattaaatgtagcagcattatgtctgtgtgatggctgcgatggggcaacatcttctccatgtgatggagattttctcttgtaatacttttccataaattcccatgtcaatcagttagctaaccacttagctcactgccaaccagttattctagtgcaagcaccaatcagtaagcagcgatacagaatgtggacaactaaaaaatgattgaataaattaaaatgttttgatgctcctactctgacagcactaaagaatattgaatgaactaatgtcctaatccaataatctgaattctggactaatggtagaaaacaaaccttgcaagttgcaactggtggaagactggaagtcgagcgtacgcgaatgcatgctgttgccgctcgccgtggcctacacgcagcgtgtcgtcggccgcgcgggcgcggtgcttgatcttgatcttgatctgagtagagcagcgattgagcgaaaagaaggatcgagcaagagcagcgattcagggtgtgtttggttgcaagccacactttgccacagtttgccacgcctaaggttaggcaaatttgacaggtgtttggttgtagccacagttgtggcaagattctcctccaacaaattgggtcccacgtgtcaatggctcaaaaaagtgtggcaagattcccttaggcttagtaagttgtggctaacaatttgatcacctcaccttagacaagatgtgggaacttttgttggcaagtaatggtaaagtgtggctgggaaccaaacagcccctcagtgtctcgagtctcgaagagtaccgacgactgacgaggaaaaggagcggagagccggagacgcagttaattcagtctcgagatacacggcgtcgtttcaccttcccacgaatagttgggctctagttgggctaacgtgagctttgatggattgtttctttagttgggctttagtaagttatctggacaggccggggtccaatccaatttttttttgggtgtcccatgctgtatatacctatatactataacttgacacaaaaaattacccggtgtccggtgacacctgttaggcctacataggcccgcctcatggagctcggcctcctcctggcgcctggcccgggggctttgacctctatggctgggcgtacagtgagggactccatcggcaccacagtggggatactctttggcgggtgcgctccttggcgccatcaccgccgctgccggcactgaacgtgagcaggcagatcaccgggacgctaaccgacttgacgctgcgcgccatcatgggggagtgcggcttccggtggcgtgaggagttcctggagacactgggtgaggcgcagaagaaggcgactaggttcggcgtcgctgacctgttcccgttgtcgaggctcctccccgtcgtcaggagcccgagtggtgacggccggcgggagctgacacgggagctagctggagcggcgggcggcggaagtgggctggagctgacggaggcttggaataatcgagcgcgctagtcagaggcagctgcagccgcagccgcctcgttggaggtctgtggcgtggggcggtttccaccgtcgccgccactcaagcccctcctgtcgccgcctacttctgctccg

SEQ ID NO: 25670 - DNA, 25116 bp, Oryza sativa
ccggttttgcggttgagggttacggattagattcatgttacttttaagggagtcacagtggacttattccttcggttaatccctagcatggattttagcccagcccaccacgggatttccctgttctgtaggcccaggaaaaaatcacctactcgagaggagcggaaaaattcctcgagaggagcggcggcgctacgaagacacggacgcgacggcgggggcggagcgcggcgcgacccagaggcgacggctacggcgacggcgacggcatagctctcttctccggccgccaccttctctccagtgagcacgcttcccttccccctctcccctcctctttcaaagttagggtagggtttccttctcttctccctttccggctttcccgtcgtcgcacgcaccgtgccgtaggggccggccgtctggtcgtgctccggcgccaatgccgaccgcgtgttcagcttcggctctggcttggggcttgggcttgggtggcttcggcttcggcagcgctttgtccttgttcggctccggcggtggcattgccgggacacgggagggttcttggacgccagagaggagaggagaggaggagaaggaggaggagagggttcttggttcttggcccgtagccttcaaagtgtcggcaccctccacgtcggaatctgagtcatgtagttgcagttgcaggtttgcgaaatctgaaggaattcagagtcatctagttgcaggtgcagtacagaagagtttcttctttcttttactttccaaagttgcaggattcgaacttgattcttctcaagattgcaaaatctgaagaaattcagagtcatgtagatatagttgcagacttgcagtgcagagattttccttttttccttgtctttgattcaccaagaactagttctacctgattaccaagattggtactgtatgatagatatgtatgttttatggttatagattttttgagaactcatgttcaagtcttttgtgccaatgataagtttagctgcaactcatggccaaaatgaacataactgaaattcccaaaaaaaaaacaacaaggcaaattttagggagccagcaattcagttttctgtatttgagtaaactaggtcttcttggtatcttctattgcactttgatacaggaacggccaaaattgttgaagcatattctagttattgaaacagattctatttcatgtcatgtccaacatgtttaagaatgccaaaagttgacgatgatcctagttcgtgtcttgtgcataactttgagttgtcaccaagttctttttcttctctagataccctaaaatcacttatatgtatcctacactgatgcaaatcctagtttttacatgccatccgcaaagattgttcctcagccatagttaccactgtttacttttcatttgaatttaattactgaagtgtgttcttcataaatgttgaccattcttatctatagtaaattactaattagtacagtatacatgttgctttccctttttgaccttttgcctgtagctgctagataacatagcagtctccatttctctgtactgcaatacaaagtcaaaaaaagcatgtagccgtgcattgacaattattattttattgtatatctatataagttgtatatatgatctctgcatcttctgaaaatgcagacaagtcaagataaacatgatttctgcattggccatatatatttgttatacatgatttctgcatcttctgaaaattcaatcatctcaagttttgtttccttttatctgtttgtgagataggaaagctaatgtttactcattatgctttgtaggttccatgaaatcgactggtagggaaattccagataatttatttgatggtagtaattttctgaagttcctgaagatttattgcttcagacagcatgacgaaagtcagggcatcattatagtgtctcctgctgctcagctcattccactcataaacctgtttagtttgtgatgtatctgagttacaaaaaatgtgtttaaactgagtgctcccacacagtgaaatgtgtgatatttgatactgtcgacatcattttttttctttgtacccatcattgtttttcctgtgcttctaatctgcaatactgtcctgacaagctttgaagcatcgctgctcatattagctgctcgttacagccattgcaaatgaaaactttgacgtaattctggtctgattacagtcggctgatagaacaaaagcaggtctgctcgaaggagcagccatgagatttatcatattttgatagctaaaatctctggctaaaacgaacatggggtttaaaagagggaataggagagagcaagggattccaacccccatagggattgagtcgagtgacatatgggagggattcactcaatccctccctggatatattccacttggggattaaatcctaaggaaccgaacaaggccttaagtgctatgagagcgcttgtgcagcccatgtagagttcgttttgtgcccaccagcccaacatgaagaattcggacaatccaaataggaaggaaaaagtatactttgacccccctcaactatgacccgagtatgattcatgacctccaaccacaaaaccgggtatatcgactcatccaactatcaaaaccgtgcaaactatatccctccctaggtggttttagaagcggttttggctgacatggcgcccacgtggcggtgttgacccggtcttcgtccctcgtatcgtcgacgtgtcgcttatatggcatcagagtaaaaaaaattgtgggaccgacgtgtcattcgcacattaaaaaaaaaccacccacatgtgggccccacattttcaatccccccctccctcattttttcctctctcaccttccatcagccggccgaagcacgaagcacaagctcctccccggcgcgcggcgcgtggacggccggacgagctacttagcttatctgaaaccatatccagaacagtgaaagcatatgcaagcatgcatttgcatcgatggatcgatatgtacgtatgcccaaattaaagcacggctagctccttccggtcctccccctgaaggcgaacggccggcgagctccacccccgcgcgcggacgccggcgagctcctcccccggcgcgcggacggccggcgagctccacccccgcgcgcggacgccggcgcgcggacggcaggcgagctccacccccgcgcgcggacggcaggcgagctcctcccccggcgcgcagacggccggcgagctccacccccgcgcgcggacggccggcgggctcctcccccgagtgtggacggccggcgagctcctcccccgtgcgtcgtcgccgtcgccgccgccccgcttctactattggaaggtgagaggagtggaaaagatgagagagagagaggggggagaggtgaggatgacatgtgggcccacatgtccgtgggtcccactatttcatttttgtgtgaatgacatgtcggtcccacaagtttttttattacatgtagataagcgacacgtcgacgacacgcgagacgaagactgggtcaacactgccacgtgggtgccacgtcagctaaaaccgctttcaaaaccacccaaggatatagtttgcatcggttttgatagttggaggagtcaatatacacagttttgtggttggaggccatgaatcatactcggatcatagttgagggagtcaaagacctccgaaataagttcactttgggtccctctttgggttcctctatttgttgcccagtccgattttcatcccttgctcgcaaaatcgggtacaacaggtcccccaacttatgaaaaccaggtaaacgaggtccctcggtggttttggctgaggtggcactagggatgaaaacggagcggatacggacggataatgctcataccatattcgttttcatattttttgccggatacggaaacaaatacggatagctcgaatacggaaacaaatacggactatctcgaatacgaataagaatcgaatatgatcggacacgaatacgaaaacaaatttttctcggaatacgaaaaccaattcaacttctaatagaaacaaatatcaacatatataattagatcattttatataaaatatagtataatttataaatatttttaaaattttaaataatattaataatgtggactagtgttaagagatgaactattattaaaatctaaaaaggtatattgaaggtcatagagttataaagaaatggggtatgtctggtggcttctgcggatatccgaatagcactgttcaccggatatccgaattattatccgtatccgacctgataccatattcgtattcgtatccgagagaaaatatccgtattcgtatccgtatccgaactatccgagaattatccgatccgagaggtatccgtattcgtttttatccggagcggacggaaactatccgctccggttttatccctaggtggcacctacgtggctcattttgactaggtctttgtccaacgtgtcattgacgtggcgcttatgtagcaattagaaccgcaaaaaataatataacccatgggacccacgtgtcagttgcacacacataataataaatggtgggcccatgtggacctctacttctaggggaaggacccctgggcggcgagtccaccgacgccggctaccgcggctcgttccacggcacgtgggagttcgccagcgccggcaagctcggcctcgaccgcccgtgcgtcaactcgttggcgtgccggaggagtggaggcagctcagggccagccgcgtcctggtcaccacggcggatcactactggttcgtggagagggcacgctcgtacgcggaggggatcaagaagtgcgagtgggacggcgagctggagttccacgagaccgagggcgagggccatgtcttcttcttgcccaagcccaactgctactagggttgaaatcttcttcttgcccaagcccaactgctactagggttgaaagtgattcggataatttccgaccgaccggaccatttttcggatacagattgtttcggttggatatattcgaaaattttcggatacggaaacaaatacagatatttttttgcagatacaaaaatgaatatgatataggtgatatccgtcggaatcagataatagtcggaaactatccggtttttttcaccggatatctgacttacaagaaaccctagaagtctccaattctccatccattcagatccagtccactcccagtctcccactgtccagtcccagacagagtcccacaggcgcactcctcacctcctcatcggccggcgccgccgccggcgtgccctgtcggcgccgccgcggggccaagccgtcgtcgcctcctcgctgcggggccaagccgccgccgccgtcgggaccaatcgcctcctcgcccagtcgccacatcgccgccgtcggagcaaccaacgccggctctgccgcgccccatcgcctcctcgcgccgtcacgcgccacatcaccgccgccgggccaagccaacgccgccgccgcggcgccccatcgcctcctcgcctgccgagccctctggcttgccacatcgccgccgcaggggcaaggcgacgccgccgccgggccaagccaacgtcgccgccgtttgtgttaatgattgtgtattcatgtgtgattatatcataaataggcttgtgccttgcggtagtttgttctgcaggctgcagctgtggctttaccatgctctatgaattttacatgtgttttcagttgaaaaaaaactgtggttcagacttcagagtttagactaaaaagattggttgacagtatctggcatgcctagtagtgctttgccttttcacttcacatgatgatggatggtatttcataatatcagtgtgtgcaagtttgtagttgtttattattaattgctaaattttgaaaatattgatatgtcctattagaaaaaataatgagttatatttcttcgttgatttgtgatgcttagtttgaggggtctttatattctgattaatattcgtcaccgtattcgtttcgtttcgtatttgctccatatttgtattcgataatattcgattccgttttcatatccgggtatccgtatccgatttcgattccgaaaaaaaaaatgaaaacgaatatgatataattagtttccgaccgtatttgatccgttttcatccctaactgcgacaatgccgtcaaggagctcgccgtcgtgaccgatttcgtccggcgctgttgaagccaaccgctttggttatccctcatgtcgccgctgagcgattgtactactactcgtaactagtaataaagggaggaatatactgtctatgattttgattcttattgatgatttgcaacattgaagtggaaaagaaaaggaaaattttagttgattatgaatttcctaagtgggtcaaggttcagcatagctatgaaatcccttttgttcatttctagttcttcgttgtctgacttaccaaaaaaatgtgaaaggtcgacggccgctcctctaccacccggcaaggtcgacggccgcgacgatgtccgctcacccccgcttcgccgcccctctggcctgctcgagcggtcgccggcgagcgcgatagatgtgcgcggggcggtgggtgtgcgaggtccgcgtgctggggcgccgcggctgcaggctctggctcggcagttcgacggcgccgacaccgtcacgcgcgcgcacgacgccgccatgcccgctctccgcggccgtgcagcgtgcctcaacttctccaactccgcgtggctgctcgcctacgccgcgctgtacgcggcgctcctgtcggggggcggcgccgaccatgcccgccgccgctgccggagctcgcctgctgcgccgcccacccgcgccgtccgctgtccaggaaggagagaggggaaaggaaaggagagaggagtgaggctgacatggggcccgtgtgggccccaccattttaaattttttttttgtgtgcagcgaacatatggggccacgctttttattatttttcgtagatatatttgtcacgtaagctccacatcagtgccacatgtgatggagacctagtcaaacaagccacgtaggcaccatgtcagccaaaaccactatcaaaaccgcctatggacctcgtttgtctggttttcgtaagttgggggacgggtcatacccggttttgtggtcaatggtcgacaaatagagggacccaaagtgaacttattacaagaccttcgtctccacccacatctgagccgccccgattcagtccaaacccaaacctgctttggtccgtctcaccaccaaggcccaaataaaaatccaacagaaagcccattaaatattgcacaagtccattatggcccaattaaaacccaatagaaagcccacctccatctccacccacatctgagccgccccgattccaatccaaacccaacctgcttgctctcaccgccatggccgccaccggcgattccgccgccgccgccggcgaggtccggcgcctcctcgcccacctcgactcccaccagcagctcctcgcctcctgccacgacgcctggtcgcgcgcgctcgcccacttcgcctcgctcgacgaggacctcgccgcccgctccgcgtcgctcgacgacgccctagccgccgcgggcgcctccacctccgagtccctcgcggcgctcgaggcccgcgaggccgccgtcccggcgcgcctcgccgaggccgaggcggcgctgtccgcggccgtcgcggaggccgggtccgcggagcccccgcccgccgacgtccgcggcgcgctccggtggatgtgcggccgcatggacgcccccgcgctgtggcgcttcatggcggcgcggcggcgggagctcgccgccgtccggaaggaggtcggccccgccgtcgccgcgtcggtcgacccgccccgcctcgtgctcgacgccctcgccgacttcttggccgcggaggatggtgcaggtgaggaccagttctgggtgctcggcatactgctgcgctcgttgtttgattccgatggccggaagccgccggagataggagatacgctggttgagagggcggccggagttgccaagaattggtcagagaaatttgggatcaagatggaattgtatgcaccggataacaatgaggtggagatgacagaagcgcctttggtggagaacgcaacagcgacagagaagaaagaagagcatgtagatgaggaagaagaggaggaagaggaggacccagaggaaatggtgcccgcgtcggaggaagaggcagatgcagaggaggtagagaaggaagaagaggacccagaggaagtagagaaggaaggaggagaggcggaagccaaggtggccaatgcggcgaagacaggggaagtagagaagaggaaagtcgaggaagataagaaggcgtcgggaagagaggtgaaggagggagagaagggtggacaggcagaggtgcagatattcctgcagatggttgctgcatttggactaaaagataggtatgatgtagatttcttgaggcggctattagttgataatggacggaggagggaacttgccagaatcgcttgcgtccttggtttcgaggatagcctcagaggtaatggtgtgttgcttttatctgttgctttcgctttcattgaactgatttaagaacatatcctaggtttgttgaatcgagatcatagggcaggttatgaactatatcaataagaattaaaagtactactgcatatgaggattataataatcttgagtcaatacctagattgagaaatatttgggctgttacttcaaatcggcaacttaagcatcaatttctttctatttagatatttgttcttgtgatacttcagtggctacctctttagttaggagtcgaaaggtcttagcattggtgctctgtaatgaattgccatttcaagtattgtttctattggtcttcttatggcaggatataacgcaaataataaatattccctttcaggcagtatacgaaccgctgctcaatctattagttatgaaatatctttttgtgtgctagcaactgattcattaaaacaggctactttttcatctaaaattcatcttcattcactactatccttctccagcagaggaaactccccaaaagtatagggctccatagtctctgctaaaagagtatggacttgaaatttaggttactgaagagatcaactcatcatggctttgtttgatgtagagctacaatttgaatgatgaagtttcacaagcgatatctgctatcgctgttgataccgtgatcttatcttgaactaaaagccatcacaactgatttctgctatttttatcgatgggctgcatttgaatgcattttttattgatgctttgtttactgaccaatatctactttccagtgataaagtgatttctgcaattactttgaattatatcaatcttttgttgagttgattttgaacttcgcacaatttaattactaattttagtcatttcaattcatctatcacggttagcattattttaacctggagaaaataaaacatgacaaaactaatatggttttgtgtttcagatgttattgaggaattcataaagtcaggaaatgagatagaagctattcatatcgcccatgaggctggtttgcttgagcgatttccacctgtaccgcttcttaagtcttatataaagagaataactaacaagactcaggttgcactgagaggtggaagacattcaaattctgttgtggtaagactctccattccatttccatcccaatatatcttcttattactgttttgtgcatgattctgtttaggcagaggtatttttcgttactatgttagcacatgattctatttagtcagaggccttatgtattactgtttagcatatctttttgcatgactcatttaggcaggtcctttttttctctacttgaagcctccacctgcacgaggagttccttttttatggtctatatgtgatttaatattactactatcgttgtcaaaccacctatgattctgtcagtttgtgacttaatattagcaggtttagcatgctagcagtacctgcataccactttctgcgaaaccctgcccggtctaccttcagttcttaacagtttattcgaaatgtattttacctgagttcttaacaaataacagcccagtataaggctgttgagaattttggagagctgttggcctatatatctctagtccagcctgatctctagtgttggatttacttggcatttcttttcatggacttctaccgtattttgtctcttgcaccaaatcttttgttatttgttctgtcctacattagtatactctcatactaaagaagggctcatgttttctttctcaggaagaggcaaacaactcggagtgcaacgcctacaagtccatcatcaggtgtgtcgagacatgccagctaacatcagcatttaacctcgatggcataaggaagaaggtcgcaaggatggagaaagagaaggctgacaggaggaagccgagtggcatgaacagattccagaacaacaagcgagctcggggagcatccgggcctcagtccttccctccctccaagtactcaaggggctcgaactcgaactacgggtcatcttttcggaacccggcctcccactctttcccctacaccgatcgtgccggttttgtcggaccggcaccaggtgctcggccgcacttcgcaccgggaagctccatgggcacgcgccgtgctggggtgctgtacggtggacctggagcgacatttggagccggccatggctatggtgctggtgctgggcatcaatcttaccatcactaaagatggtttagactttggactggatgttgatgttactgaatgctcactgttttcctgggtaatacaatggtttatatatgaagtcatggactggtgaatttttaggacatatatcctgtgtgattattgtttggtctgaaatttgctttttactgatgggtggtattgaaggctgcgtagtacgtagtgcggtgatatgacgaggttgggcttgtctaatgatccgcacgatatattctggtatactctcctacctgctgtgttgcacgggggtccctatgagaaaaaaaaaagtaatcaccacggttattatctactatttgattcctcaacctactactcttactccagtgcggaatgtggtaaatcatattataggcattttcatatgaaatacctactccagtgcggaatgtggtaaatcttattataggtatttttgttctgattcatatatttcatatcttgtattaggttaacttatttaagatggttggggtttttttttatcttattacgattaaatatttaaaagtacaattggcatcacttcaattatgtcgctgatttcaaccctttcaattgtgtcaactcaatcgtatatataagtcatatcgtatgtccgttccatcgaaagattgcatcatttaatttttgtcactcatgcaactactcgatatttctaataaacattaaagcataaaaaatatcctataaattatacttcttattgtttgttattgaaagatctttttgtcgctcataaattaggtcccatataatttcttggaggggcaaaattctcaatatcgtggcaaaactgttatatacctcgtcaagctggaagggttgcagcattcgcttacttagcttctgcacttaaggttgtctttggaatcatatgtttgcaatatgcacagtgcgcatggaaaacggagcagtccattagtgcgtaattaattaagtattagctactttttttcaaaaatagatcaatatgattttttaaaacacagccttagctactagttaaatgtacagatgcttcggtttacgcatcaaataaactaaaactaacccaagaaatcaaaccaacggcctaaaaattaaccaagcacaggtctaggttattcattcttggctgtcaatcgcctcagtttgcagaaggttttaaaccaatatatacctaggttcacacaaacaaacataaaaaatgctggtaattaaatttggtatttcatagcatccaatacataaagacatgttactcattgtccagaattcataacatactggtgctcgcggagcaacacggaccggttggctccaacagttatttaagatttaaggagcagcttcgtcctatatatccacttatagatatacgagcaacaatttcaaaatggtactcaagctgactagctatagctacctgtaataacattcaaaaaataaaatacttgagctttccaacttgaatagagaagcgtgtgtaaatttattatcctaccaatgtaaatatatacttaaaatatcatatatgtaataatggaatatgagtattgacgtaaaaataaaacattttggcctaaaacctgcgataatttgaaacaaatcacaatatatggggttttatgtcacgtgtaccctaaaatttagggttttatgaaatttgtgtgtgtgtagagagagagagtttctgcacaaaactttcacatgaaaggtataaaatttgtactcaaatttcagaagatattcaaaataactccaaaacaaattaataattaataaaaaagatagtgcacttagtcccgtacgctcaaggcctagctgaaaataatgcttaagtcaaatagcacgtggattcacaagtacatgggcagtgttcgtacggtgtgggtagttaactaaatcactgacttataaaaagggaaaggactagtgcctaaatgggtaagcgaaaccgttatgctaaaaaaggagcacccagtgttagcatacgagcaatttcatccactctacatgtcatctcgcttgtccatgccattaaaagattgcttcaatcttttttgtcgcttataaattagggcaaccgcaactccttgatatatccagtaaccaataaagcaacaaaactatcctataaatgtacctctcaatatcccacaaatcaataaaacgacaaaacaatcccataaatttacacctacatcttgtttgtttgcgccatcggaagattgcaccttttatcactcataatctaggtatcatgtcatttcatggaggggcaaattttttaatagcgcggcaaaacagttctctcttgtcaatcttgaagtggttgttgacttagtttcggtcgtaaaatatgggtattctcaccctttttcacccaaatcgaattctcctcctgtggctactccttagatctagagcaacaagcaactcaacagccgctctccactatacaccaaataaactaaaaataacccaagaaatcaaaccaacaacctgaaaattaaccaaacacaacctgaaaattaaccaagcataggctctaaccggctaagttgtttaatcctgagctccaatcgagtcagttgcagcaagttttcaatgaaccagtagctaggttcatacaaacatacattgaaaacactagtaaattcggtatagcatgcaatacataacaacatgttcttaattattcactgttcactgttcataattgttcaggaactggttggccggccaactcgatcggacagatattaattaaggagtttcgtcttctgactcctgtccgctgatagagatacgagcctgcatatttcaagtgatcataaacgatttcagaatggtagtagtcaagctggttagctatatataggtactaactgtaatgtaacagtttcatatgaaaaataaaatatttaagccttgcaacttgaatagagaagcaaaggtaaaagatcatgctatcttatgatggccaatatattaatggaaattaagtggggtgttacaaaaatcctagcaaggctatactgaaataaagcgagtatataagattaaattgattccagtgtgtttatcaatatttatcctgattaaatgtttcatgtactcgctattattggttttccaacttcaggggagttggcagaaattaaatggcatctgcatgcttgcaatttactgaatattcatgtatatatgtatcgcttctacttttctatatattggagttgggttaagtaacaaaccgtcaattcctgaagatgttgcacctgtcttgccgtcctctgaaactggcactcgcaacaaaacccagaaaaatcagtcatgaatttcttcatctccctgaacactgagctgtatatacaagaaacactacttcagctacagatcgataaattgaggtgatactagggtttttcatgcatgtatgattccagatcagcccagaaattaacaacagccaattcaatcaggttaattaaatttacaagaaagctggtatttctcatggaatctcacctttattagaagtgttggaaactaagggacatgattttacatggacatactactatatgaattcctatattgattaattcacctaaacaaagtagccaacatactgtacatacaagaaaaatataggtaaaaatattacattgagtgttaccttttgcaccacatgaccatgttaaccctccgtccagatgttactgagaagacaccatgcctgtgactaccatgatgcagcaggacttgtccgggcacgttgggatgtacaaaatactcctgaatcgtataagtattgaagggcaaaaataagatgtcaaatgttaatttgcataatcatgcattaacagtaacaaaattaaaggaaatgagcacaaaaacacatctgcaaactagaataatgcaattttgaaacctattagatgtagatatgatctcttttaacatgacttttcctacagaagatttacggaaatatttcctacttatagataaataaaaacctactttcagatttacagaaatttttcagacatccaaattccatgtgttaattaatctgataaaaatctgctatacaagtgctaaaagaattaaatagtagacattcaatcctctagccagggataaatatcacacatagctagaatttctatacaattctagctatgtacattttttgctaatttgttcatcggtttatatggcccccactatacaccagtagacaaagaacaaagtgtttaacaattgtctttgtgttgtagaaatcggttgattcgtacgcatgtgttaatttggaatgtgggatgcagtatgttcttattatgtttgtctactattttagtgataagataaagtaaagtataatgctctccatttaaaaaacaataataatagtaagaaagtccgaaatccatttattgcttaaaccaatgaacgaaggggaaaaccatgttccctattggttgatcttggctaacccgagaatcacgtttgggaagtggcccaccccacgattatgtgcacttccctaacaagatcttgcatgaataaccaaagccgtatgatcacttcccttacgtacgccccatgatcggagtcaagtttcattctttgtgaatatgccctcaagccccgcaaggcctttttaaatgggggaaaccggccctgtgcgtgaagcgacaatctctcacacggcaagcccactttcggaaaacctaatgaaaccctatcctcactagcactggaggagacccaaacagccatttcaagcaatgtaggtgatgccctggagggacattgacacctacaagattaattatcactgccactagcgacgatggtcatcaagctagcaaccatatttgcgagagactgcttctacttcaatggcaaaaccaaaagaggcaattgactacacagaggttctaatggctttgaagattacccccccccctccccaagctagtgctgacatggcattttgagaaggtgtgctcgcctcttgcgctatcaacattgccccatgcacggaggcaggattccgagcacgcatcagctattggtcgtcgtatcaactggaaacgatagctcgattgggtcacctctcatgcacttggtgcccgctacctcctactccctccttgacctctccttccccaaacccaaaccctagcatgcgtgcccactgtcatcatccctccctcacgctctctcgtgattctgtctcatccatccctcttctgcgagacagccaccgcctttctcgtataccaaattccgcacaagaaattatgaattacatgatcatgttataggttaagcattagatcataaagattagctccgaacaacctcttctttgcattcattattcactgatctgtaatgatttgcaaattaggagatattaaagatcgtttgtggcgggttcaatattgggcgacccattccagattaatttttagtgatttgacatctagttagaaccatctcaaatggatttctttttcatggagctgttagagatctctgtatttgtgatagtgttgacatttctactcgctctaaatgtcttccagccaaccattactggatcatcatggccgtcaatacagtcaagctttagtcaacacctttgtcgatattcatagccatgcatgcatcctctcattcaaatgttattgtttgactgatggattagaaaaagaaacaaagctaagttcaaggaaggtgaggatgtagatgacttgtggggttcaacccctgaagcaatagaaaagttaaggctaaaggagaaatgctcaaaggaataaaaaggtttggatgatatgatcagcattaacactaaaagaaaatagtttttttatttactaaaaacttgcattgctccatggcaattaatgggcatctaaataaaatgggtgcataattaatttaatttacaaattatacatcaatcagtacctcatcatgtgttcctgaattaacatgatttccacaacgtataccacggaagtacatgtcagcgccagtgaagtgtttgccaaggcagatatttagtgttacctcactatcatccacatggaaacctgcaatctccatcaattgttgtttagaatatataagaaaaagctgatcatgttaatatgttacctcaggacagcaattttaatttctacatgcatagcttgatagcttcccctatatatgtcccagaaaaaaaaaagatttccaaaagcccgatgcaaatttagtgctaacaacaaaagaccaaaatgtcctcgatcgtgtgtgcggcacagtttccgatagctacaggagacacagatatagaattaattattgatgtatttttatcacgtagtactgcactagtttttttttttccatagtacttggatgtggcagaagtagttggttttttcaaaaaataaaaacagagagagtacatagctactgtgaaaatgatggtaaaacattacttcctagctatatatgcgcttgcatcaaaagtgtgtgtaatatgtcatgtacacaaatggtttgagtgtcgacatgtaatatatatctctataagtacatatttagggtactccctaattaaaaatttaaaatattattaaggttatttcacactttaaatctattgatatagtttttatatcatcaatctagctagatatatagtgtagagcgtagatatgatgatcaaagtatggcaacacatattctaaaacttaaatgtaaaatgaactaagggagttatgtagcacaattatatatagttctagtcattaattcatagatgcgtggttacatgtttatagcatacctctagcaccatcagcctcaccatactcaagaacgaatgtatggtgggagtccagtgtattgccgccaacttcagggaaaagaactgcatgatcaaggagttaagtcattaatcgtttcattttaaagaaaggaaaattttgatacatgaatatcataatcttaatctactttcctatcctacaagaaaatcaagttgtgagacaagtaattgacctgtagacattggtgagatgaaatccttcatcagattgtctaacatctcttgcaagccaaaatcagagagggcagcacctctcccatgcctatctaaggatgttggtctcattatcctttgattcgctgattgtgcccacctcaaaaaattgttcacctgcgagaataaacaccacacgagcattaccgatattgcttaaccttatatatatacgtttacaaagctaattaattagtgtccacaattagcagcaaaataatactacatgatatatccaaaatgatattccatgctgcaatataatcacatacctctgacattaacatctggcagaatgagggcttcagcataggaaatgcaaacactcccggtgctggctccatcattatgcttgtgatgctttcttcggtgttgccatttatggcttgaagaaatgccggtaggatgaaagttgatggatcatttgtgtacagctccggatgtaatggcttgaaaatatccaataagaaaaaaaaaatctgtaagtgtacatattatagggtaaatgatatacctatgagtttgtgtgttcacctatatataaaatgtgcaaatagtgtggctcacactttttaattcaaatgtgtctatggcacatttcaagcaataatactttcttagctagctagctaggcaaatagcatgtaattaaggagtagcatttttacatgtacaaaaaaaaaagagttcctatctacatattcataatatattatctaatacgtgtatacattttgattatagtgcaagagtgcattttttaaaaaaaaatgaatgcttaagaaaatacgtacctggtatgcggacaagatcctttccctgtactccctctgattctgcgtctgcaaacgagtttccagattatacataagttacgacgtgattaattcatcttaattaattaacaacacacactacgtatgtacttacactaacactatatatccaactcatcatatgcatgcaatagcaagacacactactcatggttaattaaacttaaaacagttgtaaataagcaaaactgactactacgtacatgaagccaaattaaactgcatttatgactatagctgctagagaatcaaaattaatgaagcttgatttgatgaaatgaattaataatgagacgcctaaatagtaaaagcgcgtatactagctacacttaccctgatccgctgcgacggcgaggggacgtagttgcggaggacgctgcgcatgaagtagcgcttcacctcggcgggggcgccggcgagatccggcggcaggtggcgctccagcgcctggtacaccgccggcgtgatcccgagctcgtcggggccgtcgccgtagttgtcggggacgtggtcctcgttggggacggcctgcagccgcaccagcggcctacggtacctcgcctccccctgcggctgcggcggcgcgggcaccgccgccggcgccggtggagcgggcggcgggtggttcggcgccaccacctccggctgcagcagcagttgcagcccggccggctccggggcttgctgcggcggcggtggcatggcggtgacgcggtggatctggccgcggcggatcctcacggtggcggcgcggcggggaagaggcatcttggcttgcgcgggcgcggtggttgctagggtttcgtgcggcggggaggggagaggagaggggatcgagaggaggaggggatgattcgggagaggggaatcgattcgatcgatcgagagagcgagagcgaggaggagagcgagagcgcgagcgcggcgcggtgtggttttggaggcgagcggagtgacgcggaagcgggggttggtggtgggtggggtcacgttggtcatgaggaggcgcgcgcgcgctagggggcgcggcgcggcgcggcgggcggcgcacacttggcatgcgaggcgagagacgcgagcgcgcgcgggcggcgagcggcgagacgcggacgcggacgcggtggtggagtgtaactgacgtagtagtagtagtagtggagtatacgttgggctggctgctgctggtggtgatggtgagggaggccatgcacacacgtagtaacgcatgcggtgatggctgctggtttggtgggggaaagaggggagaaaaaggagggaccttgcccttgcccttgcaccttaatttgggcatgcttggtttaatttatgctttgagagtttcatttttggagttaattatttgtgtgggtggaaaatgtgtgcaaagcatgcttgtgggtttcacacaaaccataaggtatcaaaattcgcatttttagttgtgttctctgtataagtgtatttttaagttatactaaatgcatcgcaattagaagtgtacgtagttttacaagatctgtctctatacacgtgtaatatacacgtgtaagatgacagcgactatacatgaccctaaaaataagaataaactgaattgatgtgtaggtaggtgagcttctttgacatagctctaagtgttatggttgtgaacaattcttgttcgtttgatagtaggatatatctaaagaaaagagtattatttgatcgtagcttttatggagggacactggttgcatgcgtagtagagacccatcccaatgttttgtaaaaaaaatatttaggcttgatctattatatatgcgattagtattttctaaagataaagtcttatttaacattttacacatatataatcctcaaattgttaggggtcgctctgagttttatgtagacacacgttaaaacttgaaagtgtactactccctctatcccataatacaaggcgcacatgcattttcaagattcaacatttaaaacatttgaccaacgcttagtataatatgaaatgaattttatttgttaaaaattatatcattagattgagatttaaaattactttcatacggttataattttgttgctacaaaccttatagcatacgagaaattataagctaaatattagttttggagaccgtgccaactttgaccgcgccttatattataggatagagggagtactcaaaaaaaatcatttataaccgttataggaaaaattagtatgaagagaaaaatgtctctattaataaaaaaaagttattgtttaggaaggtaattgagaggtattgaatggataatgctcgttaatttaatactactttggtttgtactttgtgcagtagaccaatactccagtagataaaaggatcttttttttttacagattttgaatgctaaaaatcaactctttacatgtatactcaagccttgctcagatcgatcgtgccaaggtgccatggccttgcttcaaaataatttatgaaacgtaactgctattttcatttctaaccataagcaatgcatttatattattccctctattacaatttacatatgtcgttctaacaaatctcacactgtattactcccttcatttcatttaagtgtagttttaggcttttagctagcaaagacatactcacttcgtctcaaaaataagggattttaatctgatgtgacatatgttctgtctagattcgtattactaggatgtgtaacacatccggtcaaaatcccttatatttttttaacgaatggattattaagtaaggggttaaaagatatagaaagaaaatgagattatgagaagaaagaggagtattattagttcaacgactaaaaatgagaagaaaacatagtattaaaaaaaagtctagtggactgtggaccactgcacattcttttagggacacatttttgggctaaattgaactaattttatttatttaaggacggagatagtaaaagacatggcaaattacattgctgccctcattgattacctcctagtcatcttttccaaagcaagcatttaaatttcttgtgatgagtactagtactaagagcaagttcaatagtatagccaactactagctccaattcatctatagccaatctaatagctcattcatacaatagttatatactacactattagtacctggtcccacctgtcatacacacactgtgtcttggagtccgtgctacagctggctacaaatctgtagcccgctgcccttctctctcctcatttatctccttaaaatatgtttgcagctggcttatagtctgctattgtacctgctctaatatagttgcattgataaaaacatctgagtagggggaggaagaccagacctcgtggaaactcacggaccatgccccatacacaactaccatgccccgtacacacaaattgcctcggcatacaatgcatagttttttgggttggtccgaaccaactttggcatgcttatctggaagctgtgggcaccaagaaaatacaaatgctttgcttggctagtaatccaaaccaaagtatgggccccagatagactaccggttcgaggataatccaacaactccatataccccctatgtcgagttgttgacaagtgtaggagatatatagtcttccactttacagtgcaattaatgtcgatacacaaggagagtttagaggatgctcactactacatggatgtgcaaaaattcagacccaacagagtggcgggctggcggcacaccacttcagtgcacgaacggttggaaacgatggcaaacacatacgatgtgccaaaacatagtcttcactcgttcatccccctcgtttcctaggagatatgaaaggaaaagaatgagaaaattttctatcacaaggaattttatctatagctttggggcgaaaaaatgaggagctaaaacgtgggtgctcgcatgagccaagcgcctatatgctgtgttctggaggagggggtgggaaccctcctcccggcacgtaaaactgctcgtattgttatataattaattaagtattaattattttttaaaaaaatagattaatatgattcttttaaaaaaacagttttcatatagaaagttttttaataaattacaccgtttcagtttgaaaaacgtgcacgcgaaaaacgagatatgtgggttagtaaaatagggggaagaaaacagccatatcgattagaccttgtacagtttttcttaacacatgtacagaactttactctatatatattcaacgtatctcatatgatatgtgactcgtgcaacgcacactctctcaataacatttacacccacgcggcgcccaacacatacaaaacatgcctaagaaaaaatagttaattattccaagaaaatatgcacatatacatcctcgatagggttctatctacatatcggttaattaagctacactctctaactatttaaagcgtctattaatttttagccccgctgtaattcgccatgaggttgtctagcattcgttacaatttaacactgaagtatttggcgaatacttccgtgcaactaggaatgaaaactaacggataatcatgcaatactgttttcatattattttgtaatatacggaaacaaatatgaattatctcgaatacaaataaagatcgaatataatcaaacacgaatatggaaacatttttttctgaaaacacgaaaatcacctcaatttataatagaaataaatatcatcatatataattagcttgttttatataaaatataatataatttataaaataataaaattttaaataatattaatagtgtggactagtgttgaaagatagactactattaaatataaaaagatgtagatcgaaggtcgtagggttattaagaaattgagtatatctcattgcttgaacggatacccgaatagtattgttcacaggattccaaatctatattgtcggaaaccccagtatcatacccgtatttgtattcgttttcttcggaacgaacgaaaactatcctttccgttttcatccatacttgctttgcacgacaggactagtgggccggctggagcctcgtacaacaaatgcgagcagccacagcacacaaggctccctttgcaccaatgggcccttgtatcacagttgcaacttgaccttgatcagtaactgatgatgtttagtgcccttccagcctcttgatttctctaggtctacggtctaccctgtcctaatggagaaaatgtcgtccagatgagcgcaagcagaagcaacgagccaccggttaaaacttaaaacacccaagaccaaggccagcagcaaaagaatgcacactagcaggccattaaacccaggccagcacattaacacatgcaaaagtaagtccagaagagcgtgcaaatcccatggaacaagaatcagttgatacatcggacttaaaaatttgagttccattgtaagtcccgctataacacccaccccgtaggacaccaaatctgaaacgtgcccttatatctcgaattgaaagaaaaccccttggcagaaaaattaaaaagggaaagccgattttaacaacacattggtacagtaggatataaacctaaacgtacgttcacgcagatgatcctcacgaagtatggtgaatcacaaatccatccctagcgaacctctactgaacttcggtgtcggaatctgataacgaatgcagaccgagcagcagcaacttgcaggaaactgaaaaacgtttccgcagctgcagcctaggcagcttcagttccctccggtttgtccgtctccatttgctcgccggtagattcgctggcgccgccctcgctggcctcgccagccgcttcagctccctgaggttgctgctctggtgtttgggctccgccagccggggtctcggtcggtggcgtttgtgggggcgtctgtggcttaggagctggtttcggcttcatcattatcggtttgcagaacctgtaaaaagaatgggcgttagaagtatgcttaaacataggatacaggaacagcaagtggcgtcaagagagatttatctacggacctgtcaaccgtttcggcctttttctttaaatcagaagagagtaggacagggttagcatgcttcggcagagcatcttgctgctgtattttctctctcagccagacttctgcttcggaacactggttaatcacctgcatgtgacaagcaaatgaatttaataccgtctatcggtgggatcaactaagacgagtgaaaagtctatctaaaattat

SEQ ID NO: 25671 - DNA, 715 bp, Oryza sativa
ctctttatctcccccctttctcttcaccttctctctcgtagcgtaatctgcaggcaagggcggcgacggcaagcgggagccggagcggcggcggcggcgatggctgacgcggcagtccccatcgccatcgacctcgacctcggcgtatccgcatgcgtgatggcggcggtctccgaggatgcaatccacgaacccagcccggcaatccggccaacccccacaatgctccacgggtcagcctcggcagagtcgagcagcagtacaacaaacacaccaatgtagcagcataggagaaggcaagcaagcaagaggatgtgtatagctgtatagctcgattacttcctgctcatcaaaaatcatgtcgagtaggtgatgatatgcctcgccttcgtcccaaggcaggcatcgctacatggccaaaggcgaggatcagtggtgaacccagaacaaaaatgacccggggtcctatgcatatcatagctctagacaacacacaatattaataaccaatatgacacatagagtaatataattaagtgccacacagagttataaagtcataggaatgaagtgcttactgaaatatggatccaccatcacaaaacgagcaaaaaaggataaaaacctccaaaaccacatattgttttgcctagaaaagagaagagatcacttagtaaaaacatcatgtaaacgtgcctttaaggtctcaaatcgg

SEQ ID NO: 25672 - DNA, 6949 bp, Oryza sativa
  unsure (1)..(6949): unsure at all n locations
ttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattctttattatttaatacgagtgaattgtggattcatgatcttacagttcatgtttataacaaaaagatgaccaatggaaggaatcccttgcataattatcataaccactttgctattgcaatagtgaggtatgatcctacactgcatgtttctactgaagcacatttacatataagaactatttattccagaatgacttagtacaaaaacacaattaggagaatgagacaatgagttaaactcgtaccgcaaatctgagaagcaagcacgatttcccaacaccagaatcaccaatgaggagaagtttgaaaaggtagtcgctgaaattgaccaaaagaaaaaactagtgttacagtagcagtacatagagaaaatgaaataacaattacatgcatacaactgctaccttcttcatttcaacacagtgttttatcacatgtagtaatgcactcctacagtagtgggaattatttacaataaaatgttatctttccatatcccaaaagtcaacttcccttataggtaactatcaaatcatggcatgaataaatgtcaatagagaccattgtattatttaggactcccttatatatgcaggtaaaagtaactgaataatgatgcatatacatctgctccaaaagtatgttgatatccaaacgggaccaatatgcctagtattagtacttgtggaagatatccaaattcaaaactatggcaatgtttttacacataactacagagcagacggacatgagctgatatgatacattggcacgcacataaggcaacattataaactaaatttcctggtagaataaaatccaattcccattccccaaatatgtatgagacatcagcaaatcatggtgtgatgagcgattgccgaattcccccttttgccattgacgtgataatgaggagatcatcgtcaacaaatataacatcccgcgcgtcgtcaaacccacgtgtgaagaagacgaaaaacgtagccaccaagttgagatccggatcgaaaccatgcgaagggatcccgctcagatccgggcaacctaaccaaacgagcagcacggcgaaaccgggggcggagatcacgaaccataggaaggaaggaaggaggaggtgatgaatgggagtgcttactactcgggattcatggcggagggagtgaccgccgtggatcggagcgccgccgctgcttcgacccacggatctggagacgagagagaaggagacggggggtggggaggtgtcgtaaaagtaggaaggattttgcaggggggcaggatgatgataaatataccgtccgccgcgccgactcggaactcggaagcgggcggcgtttgcttcggctcaactgctccacggacgcgtttgcctcgtggattttattttggatttgctacacatctaccagctgtgtaaaaacaaaaaatatgtactttctccatgcttaaaaaatttaatttaggtggtgtttttttctcttagagataaaaattaagtgttttaatgcaaaacgaggtaatattaacgtataattaattaagttttaattattacaaacttgaaacatagattaatttgatagaattctaagcgccaaacatgcatcagcccaggcccaccccaccccacgttccgtcatttcactcctaccgttgtcggagtaaacgatttactcctatcgcgcgccccaaccacccaactttattcgagtaaacgatttacttcgataataaaaacaactccactgcttccgatcccaccccacgtcccgcatcgtgctcccaccattatcggagtaaatgattaactgcgataaaaacaatttctctgcttccggtatatattatatttttcccgtacccaaccaaccactctcgcccctacttcatttttttccttttttttgggatctggatcgatccaccatcccaccccacagatcggcgacacaccatggaggaggaggatgacaccgtggtggttgatggcagtggccggcgacggttgaggcgaaggcacgcttcgggcctcgctgccggacgctaggtatcaccttaaccagcaaagaggtgttcacctgggccaatagcaacaaccagcggctgctccacatcggcgacattgatagaacaagcaaggaaatgacactctgatttgcatatgcatactctccttcaacttcacgcatgaagccctaattttttttgcaaatcaaattaacgtgcaatcttcaatattacctgatctcaattgatgggctgcacaggtcctacatttgcacatcgtgctccatgtggctggctgcagaggatagggtggagtccgccggtgatggaagttgtttgctatttttcttttgctcgtcatctgtattgacatgaacgagaatgtttttgcattttttcgtgcttgctagatgatgaatggctgctactgcgcaacgtcgagctcatctctataccacaccgctacatccttccatgattccatcgtcgactactgctcgccacccggttgccctctccactaccagtcacaagacatagaccgtgctcttcatccttatagcaagatccagcaaagccaccagatggatttttggctgaatcatttttttttctagtttgattcagctgtgagtaattttgtgagtaattttatcgcttgtgtgtgattgagccagtaatttttttcatttatacgattattttgtgatacagatcaacaatactcttagttttagatttttactcttatactgtatattgaacatatcagtaaaaatattactacactgtggctatgagatcatggctatatcgagaggaatgtggtaattgttttactcgcatagtcgcataccaggaaatctcggtttttactcttatattgtgtattgaacacatcagtaaatatattactatagggtggctacgagatcatgggctatatcgaaaggaaggtagtaattgttttactcacagaccatgaaatctaaacaatatttataatattggtaaaagaattactagcgttgtaagctggtagtaattcttttacgaccatctaggtattgcgtatggaggcattcatgcgagtaaatttgttacttttaaatgagcggatgtgggaggctcggagtaaatgaaaaactccacggagtaaatggagtaaatttgttacttttgaaacgtgcggagatactagaaaaacggaaaactcggaaagaaaaactagacagtaaatagtttactaaaacgcgaaaatagaaaaactacaaataaggaacgaaaaaaaaaatctagatggttaatattttactgggcccatggatgaagcacggatgagatggaaaagagaaaaaagaaacacggaaagtggagtggtaaagaaacgaaaaaaaacaaaccgaggaaatgtgggatgcggaggaaaagtggtgtggtaaaaaacaggaaaaccagaaggagagggcgttgtgcagtgctcaaactaatattccgcgctgtagagcaactttcatatagaaagttttcgtatgaaacgcaccgtttagcagtttgaaaaacgtaccacgagtattgaaatgtgtatctagaagggatgtgacacttgtctaattcgttgtatgacctctcctgggttaagtttttttttaaggacgggagagtacatcagtacaatattgctgcaaacaagaggggtcattaggttgcatgcaaatgtgtatagagtaggagtagcgtgaggaaacaacaaccagcgaataggaggcatgtaggaagccgcagaaaaggcgaagtatgatccattttccatcataacatcgtaatttagagcatatacacatttttttttgttcataggacaaaatttcagaaatcagggcatggcaatatcagaaaatgagttactccaacgattgatgcttatctattccttttgtttgatctcttgtatggattagtatttaattttttaagagttacttactccctccgtttcacaatgtaagtcattctaacatttcccacattcatattgatgttaatgaatctagatagatatcaatatgaatatgggaaatgctagaatgacttacattgtgaaacggaggaagtaccagattagacattttatatatatatccagatttgtagtattataaaatgtttaatccaatactatatttttacattttggaagtgagggagtaaatcatttctttcatgtccctggccgacctgatcagaatcgatcagatgcatgcatcacatgagagatctcagtcaccctctcactcaaacaagatttcttcaagctttgtaacctgatcagattacatcataggagtaccctacataaatattgaatcatgagagagagagagagataggcaatgagtacccagtttcagatcagaactgaaattccaaatgacagaaattagtcactgtttcaggaagtctgcgtatattccaagggttgctgccccttttgcatgttcagcagcagtttgtcatttgacaatatgctttgctgattcgatgcattgccctctccagtaacaggagaggaaactgaacatacaaatatctagcttagctagctagctacactcgtatgggcaatggatgccaattgcatatgcctctctgcagcagctgcaacgaaagcaaaactgttcttctcatcctgtacatctccctgatcatgcagcctgcagctacgtacgtgtttgtcgctgaccaagtatttatcgctgcatcatctgacgaagctccatttctgaattctgatttgttctccttgtgtcatgtgccctctggcgatgagccgacctgccctcccttccagacaattggagcaatcaccatccatactgaaagtgcaggtgcaacggcagttttgtcagtaatatacagtagctagtgcagatgtagctcgtgcaattgcgcggctagatattgttatactatctccgttttaaaatgtaagtatttctagcctgtttagtaaagattaaggtttgtggcggaaaaaagatttattttcacttgtatcattgattaagttttgaattggttaggctctcttcccaaaattctgattgtttcaaaatgcttggatttctgtgtgtacacacaatcagggtactataaatacttatatattatggtatataagttttgaaaactaaccatttttatattttggaatgaaaggagtacatggtttggttcacttactatacacgatcgccgcgagccattcgttgacaacccggacccaggtgctcgcccacccgacatcgatcgtccacctgacgcaatcaatcaaccggatcataacaaattgtaatcagttaccggattatggttacttgatctccttgaatggattatcaagttattaagctaaagaccagtggaagttgttatggctgggattattacttctccatggtttgattggcgttccagccgacgaagagcatagcgaagtacatggcgcccatggcgaacacgaagtggaagaagccgaacccgtacgggatgtcgtcgtcctcgggctgctcgctctcggccttcttgaactgcagattctcgagcaatttcagcatcaatggcgatatgatcataaccctgatcactgatgagttcagttaagtgacagacctggaggcacttggaatcgatccccgtagcgaatgtcgccgtgacgatgacgatcaccgcgatcacgaagctctgcagatgttggacatttcattcttcagatttatacagcagcagttaagcagatgatgacattgttcgattttgttaaatttcatttctgaacagttgattggatgattaccgcgatgttaacccaatctgcactcgttgcaacctcggctttcttgttgcaaatctctgtgtgaggctcactgttcatggcccaaaaaaaaaacaaaagaaccaaagttgtgttataaaatggattcgattccatggatgatcagatcacaaattcagaactgagatccgaatgaatctttcaaagaaaataatcacctcctgatcgctgtccagcagaggaacacgatgtagacccccatcagcccaggcgccaggtagccagccttcacctgaaacccaaaaccaatccaagaacagagcaaatgcagatttcagattcagagattcagacacgagaacacttgttccaatcgagatcgatcgatccggatagaagtaagcaaattagtcgcacaagaccttggagctgagcgagacgccggtcatgatctggacgaggacgagggtgacggtgatgaagaggatgttgagcttgcaggacggccgcggcgcgtaccacacgtacatgagcaccacgcccaggatggagcccacgtacgccgcgatcgacaccacctgcacctgcatatggctgcaccaccaccacctcaacccatgtcagacgtacgccgccattgcaggtgagctgtactcggtatttgatgtgacatatcatagtacttccttcgtatttgggcaccttttttttaaggaaaattaaactcggtaacttttgattaataattatactaaccatatatatatatgctaagtattatgcatattatatcattacattcatattttaaaatactttcatgtgatgctaatttcatatttattggaaatatatagcatggaataaactaacgatcaaaatatatcattg

SEQ ID NO: 25673 - DNA, 10047 bp, Oryza sativa
tgcttttaaatttttttttgataactttttaaatgacatgtataaaacgaggggatgtccctccagggacaaaaatccacctcacaaaatgcaagctgaatctgagactgaaatctgaattgaattgcaaagaggatacgaagcagccgaggctgacgcggaggacgccctcggcgccgaggcagtagccggcgccctggcagctgccgcggagtcgccggagctcggcgaggacggggtggccgaagtcgcggagcgtccaggcgagcaggttggtcgccaggaacacgaaggcgtacacgtacctcgccatcatcgggttcggcggcccgaccacgagctgcgcgcacgcgcagcacgtctcctccaccgccaccaccacgcacctctcccccctcgccgccgcctcgccattgccgccgccctcctccgccgccatgccgccgctgcccagcgtcatcgatccccaagaacgaacacctgacaagctcaactcctgcagtacacaacacaaaagaccatatgcaagattcatcaactgaattaggcagacaaagaaagaaatcgcgcccgcaagctgctttttcgcatcgatcacactcgatccgtgaccatgagattgtccgttagcgcgctatagctcgccgatcgagcacgcatgatcgcgacgtacatgcgtgtgtttcctttgcaccaaagacatgaactcccaaatgagagcgtttgtttttgtttgtccgtgtcttgctttgtaggcaagcccactgcaaatgcctgcagctttcatcatctttgactcgcattgaccattacataaaaacatcaaatccgtactagaaccattaactaactagtaattagtaactaacttatgtcactagtagaacaatgtttgcaagaaaagaaagcttgtgtttaataaaagaaagccgtgtaacggattacttaatcttactccttttcatcattagtatttttgggttgtgtgtaaatctgctcaagaatcaacatcactcatcatcaaagggttttcttccaaggcctgtggactgcatgcagaaggctacacgttgtgctgtgcaatttatctgtcttgacagggacatgaaagaacacatactaaacaaaaagaggttttcaaaagaacattgatcaattcttgatgacatggttggctttaaagcaggattaggacgattaaagatggacaaaaagagatcagcatagctccatggactgcactcactgaagaatgagaaggacacaacattggcatgtttctcattctgaattctgatgaccagcagcagccttggatgtatgtagaaaaagagtaaagcagtaaagctatgaaagcatattatgagatggtgtggaatgtggaaagcaaaagggtctggttgggttaaattcccctgagaaatgatagattgatagtactactacttgtgtgacgtgtgagctaagaatcagagaattttttttttcagatatttgattgcgttggtgctagtatcttcctgctatctcgggcacgctatttgccgatctgttatgaatttatgatcctggtttggaatagtttaaatattcaaacataatttgttaaaatctatttgtttcaaaacattggaatcgggagcaaaacacctagtgcttttaattccttaggcctttgtccttttgtacggttctttcttttttatacatgtaacttttacttctcctatattcaataaaattagcacatgttcgttcaaaaaaaatattggaatatgctgatctacagtattctggctgtcatttcatttcgttgcataacaatattcctcctccttttttgactatagttgtagagtactacacgttggtgaaccgaactcagttctgaataccagaatcttttcttgttggattcatccaggttaagtaaaaatctaattaatcctcatgttctagtctagaacttgagcagaatgaaactatctccttaattcgcctctatttcaatctgatttgcaggtggtgactaattaaacttggcaaactgacaggggttcaattgttcatccatctcacctagctacatgcatgcatccagcaaaatcaaccgaataactaattaatctaccattcaaatatatatcacaaatcacaaaggcacatattgatcgaaacttaattagaaagaatctgctagatgtagtagaggaaggcagccaaggaagactcccacgcaagaaacgcacacagcagctgcttgcaagcgaagtcccggcaggcatccggcaactcatcatcattaacaacaggagatcgagaagagataaatctaccaagaaattaagactcaagaagagattggatattacttacctccaccacgaatcgatcgaatcctacatgcaacagcagggatggagctacgccgaagacgaagaggaagaagagcaggaggtagcttcagcggccgccattggcgagagggcaggagggttttattctggcgggcatcgcatatgtgcgagattgcgagagtggaggaggaggacgagtggaggtggaggtggcgcgcggctgcgcggtgcgcttcttttttttttctttttttgttcccgccgcaaccaaaggagacaagcaaaggaagcaagcaaaagaaaaaaagcccgggaatttacctggcgggaatgccctacttggcagcgccgcccgtctctctccacaaacgccctgcgtggtctctcgttagacttgtgcccttgtccatgcataaatagatagataaatagataaaatcttttttttactgttcttgggaattgggagatgtgaggtcctatatcctctgcggttaccacacacgcatagtacgtggtgtttgtgtacataaccaaatgaagtatgtgtgctgatttcttcttgtgcctggggacatcagtttagacattttggacgttttctaactgggtgattttggattggatagattatgaaaccgaggaaaattgagctaacaaatggttcgtgggaaattgtctaagccaatactgaagtagaaagttcttttttaaaaaaaatcataaataatccatcgaaagtcaccgtttcgattatgctgatcataacaaccaaaaaatagtttataaatgaaaattttatgtgagtttttttatcagttcaaaagcaaatactgaaaaataaacaaactataattgagaaaaaaatcaagtccaaaaataagctttaaattttaaaatttaacagtgacttgtaagcggaaaagtaaactacgggagtgcatacctctattaactgtttagagcgtgccatttgtctgagtcatcaaactcatgatccatggttacatcatagagcaaaattcgggggttatttgacactgttgtttccacttatttactgcgagagagatatttactttgggtattacgacgattaaatccatcaagattaattcaagacaaaatacattacctaatactaacaaataaataacaaaaagatcctggcatttaccaactttcaggtatccttaccaaattatcctgacgatgttgggttggacagaatggttggctggacgaacagccaaactgcaccccagcctctaccagctcttgtacatacctgccacaacagtagaagatttttccaatccttgtcacgtacatgtacgcatgcatacaaattacaaaatctttgggagcctttcttgtgtggctctcttttgcagcacaaggtgaaccacacttgaattgatccctgcctgagaaatttcacacgaaaacagagagcattcaaaattttctcgggtgttccaaacacgaatattgagctactttgtgataatgccatgccctcctcactcagtatgaaaaaatctcacagactataactattcatctcccagagcatcatataaataggacctcgtcaaattttgcaccgtagaaattagaaatacaattttttagtgccgggcaagcaaaagagttgtgttcggctctaatgggttaagcaacggctaataagtgctataaaattgaacagagtaataaaaataatttatatgtcatccaaccaatactgaaaaatagaccacaataaaaataaacccctaaaatcaactaaaagttatgttttaaaaattaaattttagttgcgactaataagctaaccagcggacgaagacaagcttcgtatttacattatttttttctccgtggaatggactgaaaaaatacgagatacttcctccagaaaaacaggcaaatgaagtatcaccattcaccagtcagtgtatatatacatcctgtgcacacatgtctcatctcactcacccaatgaatctctctgtcgacaaattgccatcacaaaacgaatgaaaaagagatactatatgccatgctatcctatcttgcagccaaccagatactactactactacaacaacaacatggctagccagctatcctggagtagaagcagcacaagacagacactaatggcgtgagctgaaccgttttctcgttgatgcttgtcgggtaaagccggtgaggcttgcaaaccaagttgacccaacctgacctgacccctgcagaaagctacagccaaagcaagcaagcagaaattcagaagagattcaggaggccagccagccagccagccactgaagaagctgtagctgctgctgctgctgctagtgccaatccttatggtccatgagcaagcaagcaacaaccatcacttgcaaggaacaagaatcgtcacacacacgcagcaacaataacaaaagcttctcttcccttctcttgcttgcccttttggaccacgttgttcctcaacacgtcaaaggaatgtctccttgatctgctgcaaaatgcagtttgttctagtttattgattttacaagggaacaacagttagtttgaccccttggaaaagagggggtggataaatggaggtagagggtgctatctgctttgactatcacttggttgttaccacatcagatgtgcgagtgcggttagttggtgcagacacactcacacacaccccacgaatgcgtcccctgcacacgcaggctctgttcgttcctaggttcccaccgccctaccctcgttttccgcgcgcacgtttttcaaactactaaacggtgtgtgtttttgcaaaaagtatctatacgaaagttgcttaaaaaaatcatattaatctattttttaaaaaaaaattagctaatacttaattaaccacatgttaatacgaacatcgttttatgtgccaaggagcaacccctcctcccgaacagaggctaaggacgtgtttggatggtgccctgacctgagcgctctcactcagacaggtgcatccaaccacatgccaccaaaatcggacgcctgagaatcgtgcctgactcaggcgtgattctcagggtgtgaagcaaacaggccataaatctacaaggatgcgggcgggtgccagcttttccactttttactactactagctaccaagagaggcaattttgcctatgtatgcatgtgttgagtgttgagccaggaagttagctatattctggctctttccaactggcagagacaaatcttgaatctaaatttgataacccatggagtgttaaactagttaaccttgtttgtgtaagactaggattgatactcaaaaatattctaacaagaaaaacttggaaaaaacatgaagcatccatgagagttgagttgagaccatgagtcatctcccacaaaccggagaaggcgaggccaagttcaactctaacaatgctgactagtagtacacaagaatttggctcagattcgcacctagggtccaaaacaccgtgagtcattttatttggcccatatgacagaggaaaaaaaaaacacaggacttcaacaaatcccagtccctcaaatgggaattcaggccgatgtttgtcggcaaaatgatgattttcatgatcagattcagatcaaaagttcgtgcacaggatgtgattattatttcaaaacagaattcaacttttgttgtttcagacacttgacatattcttttagacaaccaattctgactaatattcgtttataaaaaatcagtaaatgttcttcgtcttttattattgatgttaatacagagtattcagagtttcagttaccatgaacagctccgatgggggcggcgtcggtgaagaacgcagcatccaggtgcatgtggaagacgagatgaactcgccggcgcacatacggcggcggcggcggaggctgaccgtggcgggaggagcaggaactcgcggagtcgcctcgcctcgggttccggcaccgaggctggggttcgtcacttcgtctaggagaggagagaagtttgtggttcatccagacgctccaccgcgagcccatccgcggcggccgtcgccggcggaagagctctagcggcggcggcgccgtcaccggagggaaggaagaaaggaggggcctatttggtagcgatcctaaacaacagggaccgaattgcaaaatgtttcggcccaatgggcctcgcaacgaccattcgagttgggccctaattgggccgcaataggctggactcctcgaagggcaaagcctaattaatttcccgtagttttggactaatcaccttcattagctgtagaacaaacctgtgtaagcggcaatctcggcggtgagatgcaaggatcgaatcaaacaagtggagtgcatgttcatggggaaatgggagacagtagaagaatcaagaatagtaggtatagtggattgatcactattggcatactgttatcaaagtgattgattcagtagcttcctttttatcctcttcagttcttcggccaacttgaaaggctccactgaactctgatgcaacagtgtatgcccaccgtccaatttcgattctcacttgttgtcttcacatttttaaaatttgtaggtctttgagagaacattcaaattcggtggcttgtgtcggttgctgttaactgtatgaacatttctggtagggttacacccttgttttaaagaaatcaaattcggtggcaaacatatggggatgggagggcctatttttaaactttgttttaaaaaatcaaattcagatatcttgagtataatttttataaaaaaaagagagaaaactaggggaacacagtagaagaacaggcgtgctagcagctaaagtagtgaaaaggtgcacataacggtcatctcggacacaaagcaagcgagatcagattcatcatcttcacttttttcacctcaaaagaaccaaaggctgaccaaccagtgtgtgtgtgtagtgccactaatcaccacagcttccaggagtaactaatttttaatcttaaccaaagccagtctcccagtcccaaaggcaaaagttaaacaacattataatcacaagctcttttcacttttcagcaagtcatggtttgcttaaacagttctgtattattatttggactgagaatctcgggctgtcatcctctgcttcttctgataccggcagatgttccaaccaagtgactaaccaatcaatgaacttaatcaaaagattattctagtaagtacttggttaacactgttagtctccagtgaacttcacatgttcacagtgcatgagagttcatctcttgcagacctgcagtgttaaacataatgatagtaaccagcaggaacccttctagaacaattctacatgagaaaatgttattggaacagatcatatttctggctggattcttcagaagcaagcaagcacatggcaagaaagccaggatatctgcacctcgactatgccttaatcaagacagagaccctggaaaccctaaagaaagtttgcaccatcctcacatacttttgtggctttgagagattctcttaagtgcatttacaaaagttaatttgaattttgcagttgtagtttcaccattctgctagcattctacataaaagatttgattaaccatttaggtagtgttttgagattttttgtggttggttttagagataaaaattcttcaaccattctagatatgcacattcttaaaaatgccaatcacaaactgctaaactagacagaaagtcagtatgagacagaattcaatcagaagccattgaaaattcagagacagagcatgtggctcccctattattcaggttgatggaatgtatagaaagcaggtcaaagtataaaatgacaagcaaaaccagaacatgtttcttttaatctttatactctgcaaagtgggtaaccactagcagcaattcacatcacaaaacagaaaagagcaggaggaaaagaaagaaggcaattgatcaaactagaggattacaacactagcaagtagagaacaaatccaatccaacacataagaagaacaactctcaagaatccatactaaataataataagaattgaatagccagaagtaattgtgatacagcaggaagaaatgacacagaatccttttgttctaaaacttatgtcttactactactgaatttaactgaactgaactcatgattctcatctatacaaccacatatatccctgcacctacaatcctctgccaaaccctcctgtccctctcaaacttttccttattattcacaacccaattagccatcaatcatatgttcccaaatcctccaaatccccacacccccaccacttcccaatccctttcaacaccacagcaacacaaactgtttcgatgctgacgccgacaaatcataaccaaacaaaattttgtgcaccttactacgctcttcacgccggtagtcatcaatcaaccaaccaagaacactagtagctaataagaacgataatgaccacgtatacttgtgtgcgacttccgctgctgtcgatttgccggatgtgaggagcaagagcggaacacatgcatgtttccaaacattcttcggagaaattctatcaatgcagcgggggaggaggtggtgatccatatggtacgctgtggatcggtggccatgagctgtggtgttgcagagggggaggtggtggtgagccatatggtactccatggacaggtggccatggcccggggtagtaaggtggtggtggtggtggtgacaatgctggtgttgcgccgccgcagggtggcggcggcggtggtggtggcggcagctccggacatggcggatgcggttgtggcgcgggtggtggcggcggcggcggcggctgcggtgggtggaagattggtgcaggcggtggaggcgatggtggcggtggagatggcggtggtggtgaaggcggaggcggtgatgtcgacggtggcggtggggatggcggcggcggcgaaggcgccgccggtgatggtggtggcggcgatggtggcggcaggcccgggacgaacggcttgcactggaacgcggcgcagttgacgggagggcgcgcgaagaacgcggcgcactgccgcagcgtccgctgggcggggcggttgggcaggcagttcctccggtcgccgtagcgcggcacggcgtgcgcgcaggacggcggctcgccggtgaagaagttgtacgcgaaggtgaagttcttgaggcgcggcagctcgcacaccgcctgcggtatcgcccccgtgagcaggttgtgcgcgacgtcgagctgctccaccttcctcatcccggccaccgccgacggcagcgggccggcgagccggttgaagctcacgtcgaacaccgtcacctctcgcagcatcccgacctccggcggcaggcaggagctgaggcccgtgttgatgagcaagatctcgttgagcgtcccggacatgttgccgaggctcgccgggaggcagccgccgaagctgttgtgcgcgaggacgatgacggagaccggcgagttgccgaagttgtccgggaggtcgaagcggaagcggttgtggttgaggaagatggcgtcgagcggccggtcgaacagctggcggggcaccccgccctcgaagtcgttgaagcggaggtcgaggaaccggagcgcgggcatgtc

SEQ ID NO: 25674 - DNA, 4733 bp, Oryza sativa
agaggagagagaggtttagagagagaaaggagaggagaaaagggagagtgagaggcagctataagcctataaacacacacgcggaggggagctagctcagctggtggggcccacgggtgcaagcttttttctttctttttttccttttttttctttttctttttgggtgtgtgtgcgcgtagcgtggggaggatgtgtcagtgggtggggtagggggttgcagtgagagagaggagagggcggtgggtcccccgcgattttcgtctccccacacgctcccgggggttcgcgaccgacagttgctgcgggcgcgacgcgtgtgtggttttgagtgtccgtttgtccagttcaaactgatggtggtagagttaaaaaaaaaaactactgtggtaaaaaaaagtgaacggctagaaaagtgaaaaagggtgttttaacacagaatattccctgttgattgtaatttgtggggatggagggaaatggagaacttcataacagggagatgttggtggcaacaactttcgggggttaattccatccatgccatcgtattttttttcagttttgaaacatgtgattgcaattcgcatattcgtacaatttcaatagcagtaaaagattttttttctaaaatgtattagcatatatatttttcctttaaaattatactccaaatgtattagtatgttattgtgaatgtgcccgatataaggcggaatagaaccccaaaagaaatgtgtagcattataacctaaaaatttgcttagaaatttttactctaaacttaattacttttttttcccactaatgttgtatctagaggaatatcaaagatatggaagtgaatgtaaaacttgatagttagttcatcgaatatcataaagaaataaacagagggagttcggcattatctcaaataatcacggtgcccaggcaaaaaagaaaaaagaaaactcaccggtatgaaccacggagagcatctgaaatagagtaccgcaggctacctttgaagtaaagcaacacaaaatgagtagtacacaacaaaagttaaagtggaaaaaaatatggtctttagtagttaccaaaaagcttattataaaacataatagcttattaactaaaaataatttacgtgtaaaacttttatatatgtgttcttagcgacttaaaatcaaatcaatgctaaagaaactacgttaaatatcaactttataattaaattctaaaatttaaattatgggttttgttatttctattgcaaccgatcagactttttgagcctgttcagatgacaatattatcaaaattttaatatgatttcttatgtatttttaaatttaataacaaactaaacgcaaacatatttttaacaattttttaaaagaaaatagggttaaaaataacgtcaatctcaactgccccttattctaatacttcagtaacagtggatacagtctgtactaaaatggttgtgtactgtacactggactgtctgacataacgacactgttgctgctgctgtgctacattggtcaagaggagggaggggaattaagagaggtcacggggaatcataaactaagctactagtagtaataagatattgtatcacatgattaaactaacctatccctatatccattggatttgctcatgtgcatttgtttgacttgtacgtttgttctcttgtcttgaataaaaataactagaaatgaaaaaaatatagagagcatgggggagatggaagatggaacaagtgaaggtgtgctctaatattgatcattttaggcacctttagaacgcacggatatagaattttgatggtaaacaatggtttagaccctatttgagatagataaaaattaagattaggcaaaagaatgtgaaaccaaaaggccattatcgtatgcataattaagtattaattattataaatttgaaaataaaattatttgatattttagagtaatttgtgtatgaaacgtaccgtttaacagtttaaaaaatacgagtgctaagaaaatcaaggtagaatctacatcttaataaaaaagagaatgggaagttagtttggccagagaaacatgtttgatgagttatcaaaaccaaagtaaagaatataccttggtgggtgtttgtacagtgtaatatgtgaccaggaaaatagcaaatttactgcggataagcctcgagaaaaaaaacgaaatgtcaatttttactctctatgtcttaaaatataagtatttttagctattttactgaggtagtatgtttttacagagtaaaaagtaaatgtaggaaaataaaaattttaagtttaatttgtatatactccaactgataatccaacaatagctctgcttattattaattctccgtagtttggtaacgggcatcgacgcatcgtggcaattctggtgtcgggatagccctttgggtgtttgcgtcgttctcgctgggcccacaacgccgtgacggacagtgcaggggggcccacctacgcggtcggcgtcggatctttcctttcgtgcgctgcgactgcagtgcactgcgctgccactgtatgcgtggtgggccccacgagcggtttttccgctcgttggcttgactcggacaggcgacggtgcaaatgtaaaaatgttaattggaccggggaagtacttccctatgtaaaaaggggagagagatcctctgactttaagggcctgtttggtttccagggacttattttaagtccatgtcacattggatgtttagatactaatttggagtattaaacatacactaattacaaaacacattccatatccttggactaattcacgagacgaatcttttgagtctaattatatcatgattttgacgatgtgatgctacagtaaactttttataattatagattaattaggcttaaaaaattcgtctcgcggattagctctcatttatgaaattagtttttttattagtctatgtttaatactccaaattagcgtccaaacatccgatgtgacatgggctaaaaagttttagccccatctaaacaccccctaagtcagaggcacttggtggctgatatatgggcccatagataatgggtcccacatatcagtgtctatgtcacgctgtacagtaacgtcagagaaattgtttccatgaaaaggagttaattctcacgtaaaattttttaccttgttacatcgaatggtaagatacatatatagagtgctaaatatagacaggaaagagtaattacacagattgcgtgtaaattgtgagacgaatcttttaagactaattgctccatgatttgataatgtggtgctacagtaaccatttgctaatgatgtattaattaggattaataatttcgtctcgcagtttacaagcggaatatgtaatttattttgttattagtctatatttaatacttcaatgtgtctccgtatatccgatgtaacacgctaaacttttcacccctgaacaaaacggggctaaggatgggagtacgtatttactctgctttttgaaaaaaaaaatctatagagatgttgtttgaaagatttgaataaattcatttttaagttttataattattaatattttattaattatgtgctaatgaattttcctgttcacgtgcgttgaaaaattttctcttctacttaagggatagaactcagcctaagaagcacattcgagagaaggatgacatatcttatgataaaaaaaaaatcattgccgactattgcagatgcatatttacacacatgtaacacatataagctaccactataaacattttttaagaatagtacggtatttgttaagattgataaagttatcattgagagtcgcctatcactcaaagaaatagttgtagagaagctcatctcaaaaacttaaatctaagtggtcaggttccaccataaaagatctaaccagttgagcaatgcttattttacaaaaaaaaaattgaattatagtaatgtttaaaatttttttctaaaaaaaatttagttgcttactcctatatatcttgtcatgtccgtatattgagaagcaccaaattagttttatacttttaatagcttttacctatccacctaataataataatactctttattggtgaggggtagaattcttttccacctaacttttttctttgaaatggctacaatcaaagttttttttggacataatcaattgcgcaattatagggagcagtagttggtggtgattaaaatagccagttggatttgggatgtccaattaagctgctggtttcattggtctgttatagatagccgctccacgtgagctccagtggacgtaccgtatgctaaatcgtgctaatgcatggccaattgaccatattgattcgattcatcaattgactcatcactagtagtaatagcttaatctagatagagctaagagcaggtaaatagcaggctataagccagctgcaaacatatactaaggagataaatgaggagagagaagggcagcgagctacagatttatagccagctgtagcacggactccaagacacaatgtatgcatgacaggtgggaccagatattaatagtgtagtatgtaactattgtatgaataagctattagattggttatagatgaattggagatagtagttggctacactattgaacttgctctaattacgtcatctcatttaagcttgctaatgagtaggcttaattaattagct

SEQ ID NO: 25675 - DNA, 3308 bp, Oryza sativa
gtgcagaacgtcgaaggcagaggttccggagacctgctctcccgatcgccggtgcacgccggcgagcgggatggagtagtctacgagcgacggcgcagtacagagtaggaggcaaaccctagattgattttttgcgtatgttgcgtgaagacggcaggtcggtttatatagagaagggtcgcttgatcagggcgccggactccacgccgtttgcacgcaccggatctttcggaacgtttccaaaacaaaaacgaatccgaatttgcaacaaaacaaaactgcaaaaggaggctgcatctgcgcaagggtgaggagccaatttttcggaccattcgacgcgtacgtcgtgcacgcgcgccgcctgccctgccctgccctgcccggcccggccaggcgaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacacatctccttcgatgcattgtctatcacatttcgtgatagtcccttcgtgaagggatctgccaggtttctcactgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccagtttttcaacaacaggcagatccattaatagatcacgcagccattctgcctcaacagtagcagtatccagtgccgttaactctgcttccatggttgacctcgtcaaaatggtctgtttgcaagacctccatgaaacagcaccaccacccagtgtgaaaacatatctactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcacagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagttccgttagcgataatggaatccatttcactacggacagcctccttccagtagtctgcatcaggagatgcatatgcttctgaaattgacttaggagtgtcatccacgaggtacacagtgaaatcatcaccaaaagatttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaagatagaatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgacttttgccaagcacccccatgtgcgcaaataagaaagtgatggttttctaccaatccatatctcatatggtgttttgtccttatttctgttaggaactctgtttgacacatgatttgaggtcaacaatgcctccccccaccatgccttaggcagtcccgcggtgtccaacatggcattcaccaagtcagtcagtgtgcgattcttcctttcagcaatcccatt

SEQ ID NO: 25676 - DNA, 42979 bp, Oryza sativa
  unsure (1)..(42979): unsure at all n locations
attttaagatagtctagagcctcgtctttcgttttcaacaagtacacatagcaaaatctagtagcatcatcaatcaatgtcatgaaatatcgttttccaccattcgtcaacaccccattcatttcacaaagatctgaatgtaggagttctagtggtgccaagtttctctccttggcagccttgtgaggcttgcgaggttgcttcgattgcacacaactatggcacttagaacctttgacaatggaaaacttaggaattaaacacatgctggaaagccgagacattaagccaaaattaatatgacataaacgtgaatgccaaacattagcctcatcatccacactgccacaaatatggttcacagacttattgcagaaatcagaaagggaaaaacggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatatccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtattttcccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatgaaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgcagaacgtcgaaggcagaggttccggagacctgctctcccgatcgccggtgcacgccggcgagcgggatggagtagtctacgagcgacggcgcagtacagagtaggaggcaaaccctagattgattttttgcgtatgttgcgtgaagacggcaggtcggtttatatagagaagggtcgcttgatcagggcgcccgcacgatctctactgcgcgtaactgaaccggataagtcgcgcgtaacttatccggactccacgccgtttgcacgcaccggatctttcggaacgtttccaaaacaaaaacgaagcgcaagggtgaggagccaatttttcggaccattcgacgcatacgtcgtgcacgcgcgccgcctgcccggccaggcgaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaagttcctctcaaaaaaaaaatcatatattagtcaatcaaagggtgtgtttacttcacaccaaaattagaagtttggttaaaattgaaacgatgtgatagaaaaattgaaagtttgtgtgtgtaggaaagttttgatgtgatggaaaagttggaagtttgaataattatcttgaaactaaacacggcgaaagataaaaggctgttcttgactaaagtcctctatagaaaacatgattataaaaatataggaatatggagaaaaaagtaagaatataatatcatatttattttattcctttaggattttttaaaacacaagaaagttttaaaattgatgtttgattagaatacatgaattttaagacataggaagaagaaaccttgaagtgatgcttattttcctttaaaattactctgcaatttctcatttcatagaatttaaaaggaatggtaaaaaaaaatcaatcatctgtttcaactttccagagatccatataattgttttccataagcgctctagaatttctatgtgttttttttttcaaagggtgccctaaatgcctggaaaacaacacgtcctttaatttgcctaaagcgaaaaggcaaaaatggggagcagaaaaagaaatccttgattcgccgaaagctacaaaggggaaatagagaacagaaaagaaaaaaaaaagggagaaaggagggaaaatgaaaacgtttcggccacgcgtacgtaggtatacccaagagatatagccagtgagcctttagctggagtcctacacgtatgtatacatcgaatctccctttcacgcaccaattccttcggtctttcttgccgtcgctctcttctcagttcatacatgcatacacatacgcgtagctagctagttagacgtgctatatatatatatatatatatatatatatatatatatatatatatatatatatatactccctctgtactcgtaaatttagtatttaggacaatatttaagtcaaactttaggaatataaatcatgaataacccttaagctgttgaatttgaaaatgtaaaaattatatgaatatatttatcatgaaaatactttcgtaagagtatacatatattacttttcaataaatattttttatagaaacaagatgttaaagttatgttttggagaccgtgtcgctgtccaaaacgactttctttatgagtgcagggggagtatactcactttgatgatttgatgatcgcgtaactgcccacacaaactcacttcaattcaagctggtcttacagggcttatttgatttggagaaatttaaatccatatgaatgggaaccgtgaaagaatagcaatgtttgcatacatcaatccataaaaattttccaaaaggtttaggtggatgaaaaaattgctatatttttctctgtacaactggttggaaaggaaaattttctttggttttccagtgcttcaatccttttttaggtgaaaaatatggcgccgtaaatatagctactcccccgtttgtacagtaattacacatgtgtaatttagagacttacatatataattttagaacttatattataaatacaataaaattacatatgtaatttagggacttacaatgtaaatacatatcgactatttttttagtaaaaaatttgaaaaatatggcgtcataaatatagctcataccatccggtaaatcgaaaagcactcatatgaattaattattagaaattcaaatccttcggttttcctccaaaacgaactaagtcccttttttttccctacacgaattccctcgctagaaaagcttcttttgcagctgattggcttacctagaatagcaagcatatacggggcttggagcggatagaattggagcatacagatatatacaaaaacgcgtaacgcgtagtttgttgcactggcatcgtgcatatatatatatatatatatatatatatatatatatataacatttcataataacattttcagagacggagaacggcctactcgctttccctgtaaatccaagcagtcgagcacgcaagtgttttgtatctttgctatcgactttaatttgccgtgtgcgtgcgttcggtcctgttcgtttatactacaaagagtgaataaagttttgagtaaacttttgaaaactgtaactttagtcacaaaattatttgtttgctgcaacattagcgacatatgtttcagtttgctgcaacaatatcgtgggaaattatcacaaaactgtaacttttatatgttatatgctgctacagatgttaaactgctaaacgatgtgtttcgtgtgaagactttctatataaaagttgttctaaaatatcagattaatctatttttcaagtttgtaataattaaaactcaattaattacacgttattaccatctcgttttacatgaaacatttaattttcatcttcatttttcattttcagaagattaaaaacaccaccgaagtagataagatgagaactagacgaatggaaaagacgaagttgatttagggtgtgtttgaggagaaggggattggggagattgggaagatacgcaaaacgagttgggccattagcatatgattaattgagtattaactattttaaattgcaaaaatggattaatataattttttagagcaactttcctatagaaattttttgcaaaaaacgcaccgtttagtagtttggaaagcgtgcgcgcggaaaacgaggagctttctcacccaatgtcactggaaagaacacagccttagtcgcacgtaaagcgagaaatataactaatatataattatttaaatattaatcattaacagtttagaagttggatatatttattttaacttttaaaaatatttttgtgtaaacttttttataaaatatatcgtttactagtttagtttaaaaaacgtgctaatagaaattaagagttagctaatccaaaccgaagtctagatcgggcccgaagcagatggattgctttgctttgctactgcatgcccatccgattgcgtgtagaggagggcaagtagctgcagcgccagctaagctgtgcgtcgtcggagcagctccgaaaactgttggcaatttggcatgcatggcaagcagggagagaagaagaagaagacgacgagcttgcctagcgagtagcaacaaagcagagcgcgtgcagcaacttcctatccagctacaattgcagccttgcatttaagcaaagtaggagttagcaggccggtataccataccgctagtgctgtaggagtacatgcttctgtacactatagctagaagcaacagtagcagtgtagcacagtgctaactgctacccaactgaactaccgagcaccaggtttggtcagggttacgctgcctatatatataatgaaacaaaagccaatggacaaggccgtgctcagttccatttcaatttttttaagtgtacggatacacatttggagtattaaatataaactaataacaaaaataaattatagatttcatctgtaaactgcgatatgaatctattaagggcatctccaacagagggccaaataggttcctaaaaattattttttgggattttggttaaaactaggcctccaacagactgtcaatcacggtcctaaaatttaccccctcctaaaatcggtgccaatctcatcagaatttgggaagcggtacgccctcccaatcccaccaatcgcgccaattttttttactgtccgcgccattttttttccgcccgcctccttttccttcccgctccttcctcgcgtcgtttcctttctcgcgagaaacagcgctcacgccgccaggctagggttttgggagctcctcgcgctagctccgtcccgatccgccggccgcccgtcgggggactaccggcctgccagccgtccatccaggggcagcgtcgccggccgcccgtccaaggcaccaccacctcgctgtcgaccgtccatccaggttgtcccgacgacaacgtgtgctgttactgattcacttcgaggtattttcagagaaacaactttattcttttcaagcttgaagttcctgtactgatttccccacaccggcaatcccccacacagccatctagttcatagagatatctcccaattttttgatggagatgcaaagctcctcccttaaattgtttcccaaatcactgccacatacctcagttgcagcacttatcttctgaataatgcaatcaaaaactgttgtcctgtcctcttcaaatgatttccaatggatcaggcatcggtagatgaggtatgcggcaataggccttgcaatagagaaacccatatcttcagatatgcactttatcaacaactcatggatattcagaaaaatatagaaaaaaatgttgaggcacaacacctgaacgaattgtgatactgcttcaaaagaagttcagaattactaagcatcatacctgttgctgcttctcagcttcaggatcattcaggcgtcagttgagaattgttctcctagattgaacttaacttgtgttaaatcaggaactcattttacgaatatactgatcaaatataatttgaggattatactaacatggatgtcacaaaagttactggcctataccaattgttaattcaatagtgtttgcttgcgtttgtgttcagtcagatgcattcttcttcaggttgtatagcaccctaaattaactaaacaatgagcttctatatgtgcagggttttgtttgcttgcagcagtatttgatgaccttttcttagataatttaagtgtttgatgacctgaccagttagctgctcattggctagatattgctattagtttctagtattttctgaccttaactttttagccttttgtaatggattcagtgaacatatgtctgaattaaattgcagagtcccaagatgctagtacttctacaaacgtattagtagtactgttcttatttgatcactaaattaaacaaacatgtactatttgtaggtcctattgataatggaagaagaaggattctatactaatttgatgaatgagggcaacgattccttagattgggatagtttgagtagtatgcctgtggaggatgatatgagtaaccagcttgatgagaatggcatgagtagcgagcctgtcacgcagcagttcccaactgctgagaggactaccgtggctagaccaaatcaaaaaagatcgaagaattttagcgaacaagaagataagatacttgtgtcggcgtggttgcatgtaagtttggatccagtgctaggcacaaatcaaactcgtgctgcatattggactagaatatatgagcacttctacaaaacgagtaaatccacaccagatcgcagccaaaattcacttatgcatcgttggaaaactatacaagagaatgtcaacaagttttgtggacatctgagccagattgagggtagaaggcaaagcggggttagtatacacgacaaggtaatacatagttatgtagcttgtgtttttatgttactttataaataaaaatgtgatgtttgctaactacattcaccatacttgacttgtgcagattgctcaggcaattgctgtatttaaggagttggaaggaaagccctttcaattccttcactgttggtctctcttgcggtcacaatctaagtggcatgataagatgaagcaaataacatcccagaaaccctgtgccaccaacagacagaagccaagcacagatggttcagcaaaagctacacccacaaatgatgaaactaccaatcatgttggtgaagataatgaacctacagagaccgaagagccaaagagaccgatgggtaagaagagagctaaagagcagttgaggcgtggtgaaacatgcacagatgcttttgatcatttgtgggagaaaaaaaaagaagctgatgcagagaagaagaaggagagagatgagaggcaccaaaagtcatatgaactagataagcagaggcttgagttagataaaaaaaaggtcgcgaatgagacggatgagatacagttgaagaggatgttagaagaagagagaattatgaaaatggacatttcttccaagcctctctcacagcagcagttctacaagagtgtacaagatgagatcatcgctcgtcgcatgaacagttccggttgataggtttgtgtttcataacagtttacattcagttgagtgcctgtgttcatgcatatacttgttcttgtgtccatcttgttgaaatgctgcctttgcacagctgcactacaccatctgattcttaaatatgttgcatgatccactacaccgtctggcaattgtgtctattttgtgtctctaaattaggtgggtttactaagtctatgcaatgcaaactatttaaattcagaattgtctattcagtacttgggtaattccctcatcctgctgtcagtaatgcttctgtctttgttgctgttgacagagtcagaagcctcatatattttgaaatttgtactaatgatcggtcatcttgctgacaagctgatgcatatattgcaaattatatataagctgaactgtacctatgactaggttgacaagttaaaggaagtgcacttttattaattctcctgtactattcttaaaccgaacagtacaccatttattcaattcatgaaaaacaaattaagatgatttggcaaatcctcacatatgtatattatttattacatggaattcaaacatataaataaaacctcaatatttatccggataatgttgccacaagtgctccactaggtcttcacgtagctgatagtgagtttcgtcgtcccttatttttttgtgcatctggataaaatcatcaagatcaggtatttcatcgtgggacactctgacattttctcctccctctgggaaccgttcttcccaatcaacttctccctcatcttcaataatcatgttatgcatgataacacaagctttcatgatgtatcccagagtcttttcattccaatgtcgagctggccctcgaacaatggcaaatcgagcttgcagaaccccaaaagctcgttcgacgtccttccttactgcttcctgtgctttggcaaaatatttcctcttgttgccatgtggttctggtatggtcttcacaaatgtggcccaagaaggatatatgccatcagcaagataatatcccatcatataatcgtgtctatttatactatagttcacttcaggagccttgccttcagctagctttgcaaatagcggggatcgatgaagtacattgatatcgttatgagacccaggcataccaaaaaaagcgtgccaaatccagagatcctttgaagcaacggcttctaaaattattgtaggctcgtgcacgtgcccttggtacataccgtgcaattctgtagggcagttcttccacttccaatgcatgcaatctatggagcctaacataccggggaaacctctgtcctccccaagttcaagtaatcgagttgtatcgttctcattgggtgatcttaagtattcatgttcaaaaacttgtacaactgctttcacaaaccttctcaggctctctatagcggtactttctgcaataccgagatattcatccaaagcatctgctgctataccataagccaactgacgcattgctgcagtgaccttttgatgacaactgaacccaattaaaccagctgcatttctcttctgcacaaaatagtcatcgtgatcctctactgcattcattatgcgaagaaacagaggcctgctcattctattcctgcgaatcataactaatgagacatgcatatctatgcatataacaaaaataaattatataaaatttacttatacaaacctgcgcctgaataaaactgggccataggtaggattatcagaaaagtagtcttggtataatctcaagtgccgtgcttctctgttgcgatcaatcacttcatgtcccatgactgacccaccatgtcttggtgcattgacagagtgccaatagctatggacgatttgtgccgtggcaaaaaaaaaatcatcgtcatcgtcagacgatgattcatccacgagctgttgaaacgaggagcgaggtcgactcatcttggatcaaatcaactgccaaaccattattcatcacaataaattaagtttttccccttgcgacgttgtcagatcaaattaaaaaaaaatgtgattggccttccgtttttccaaatatttattcatcatatcaaattaagtttttttttccatcaagacattgtcagatcagaaacataaaaaaaggaaatagaacaaagtaaaaaacatggttgctagcaaaattttgctactcacgcactgcacaagagcttgtgcctgtcaccaatcgttgctgcttgctgcagctacctgattaagtgaggtgctaacgtcgccggccctgacagaggaagagctctgattgagtgaagtgctaacgccgccggcgctgacagaggaagagctctatgtgcgtctatagcactgtgtccttcgatcaatttcgtatatcgctgcgtctgatatataacctcgccaacggtatcagttgcgatctcgcgcgcgactaggatgagcagccatctccttccgtccgcgtgcgtcgcgtcgaccatgcccattcccctccgcatccgcacgccgcgatctcctcctcgcctctcacgcgcgacgcgatctccccctccgctctcgcatgtgattttaacgagcaggtagaaaattagttgggaagggcccactaatgatgatgtggaaaaattttaaaattttgggaaccaaattttagtcatctcttggagaagagggtgtattttaggctaaatatgtttttggctgtccccaatacaggatttttgggagtttaattttagtcatctattggagatgctctaagcctaagtaatccgtcattagcaaatgtttattgtagcaccacattgttaaatcatgaagcaattaggcttaaaagactcgtctcgtaaattagtcgcaatctgtgcaattagttattttgttagcatatatttaatactttatgtatgtgttcaaacgttcgatgtgataaggtgaaaaattttagcctaggatctcaacagggtctaaattttgttttgataggaaatgagctaattattattgctaaagatatatatgcccaattcaatcccaattcaatatcagtatttagttcacatcaaaattgaaagtttggttgaaattagaacgatatgacagaaaagttagaagtttatgtgtgtaggaaaattttgatgtgatgtaaaagttggaagtttgaagaaaaagtttaaaactaaactcagccatcatcaaccactcttccaagtaaagcctgaatttacctagggtgaattcttatgttccaccgggagttttgattatagcctcgtcggatatagaagaagacgaagacgaagtacacacgtgaaacgaaaaagaccattaatgtataattaattaagttttaattattataaacttaaaaggtagatttatttgactcatatgtaataaagtttttttttcaaaaacatgttaataaaaaccgagataaaatcttcatcttggtcgtaaacgaacaaaggcatatgtgtcacctttttagtctttcattactagcacggaattttcgtcacacatccccggtagtagaaacaaaacaagtgacgaaccggcagtacgcgtttactagcggcgagcggtggcacgccgcgcaacggcggcggcgacggcgacggctcaaccgacggacggacgcggacacgcgtcggccggcggcggcgcggcgcgcacatgcagatgcacacgcgttgcagaagtgcagaggagtactggtgccatgggcctacgtgtacatgacgcagctagcactagctcgtggcactgggaaattcactttatacactccaacactccctcttacacgagaccctattaaatctcaagcgtgcttcctctcacacgagatcctatcaaatctcaagcgtgaaatattggagtggactgcaattattttatttaatattggagtggactgcaattattttatttnnnnnnnnnnnnnnnnnnnnnnnnnnnnnnnnnnnnnnnnnntgataccatattaagctgcatgtaacaatcagttacacctaaaagcctaaactaataagaaaagacgggtaattcactctatacgcttcaacaaggagggcaaatcagtcatgctccctcttgacttacgaagaaagtcgtttagaagaatatttaaatcaaatcttaaaaatataaatcataaataactatcaagttgttgagtttaaaaatataaaaattatataaatatatttgtcttgaaaaatactttcataaaagtatacatatatcactttttaataaatatttttataaaaacaagaagtcaaagttatgttttagagaccgcgtctctgttctaaacgacttcctttataagtatggagggagtatccatttcacatatacttatggtcttgtttacatcccaacaaattttagccaaaaacatcacatcaaatatttagccacatgtataggacattaaatataaaaaaacaattacacagtttgcatgtaaattgcgagacgaatcttttgagcctaattacgccattatttgacaatgtggtgctacagtaaacatttgctaatggcggattaattaggcttaatagattcgtttcgcaatttacagttggaatctgtaatttgttttgttattgtgtacgattaatacttcaaatatatatccgtatactaaaaaacattacacccaaagaactaaacacaccctaacataacaacttcatctgtactaaaataaatttatttttcaaccattacacatactttattcgtctcaaaataaactaacctgataggaaacgtgattcatcgtattttttgacgaagggagtataacaatataaaaaacaaaaactaaaatactcctacttaatcacatcccaatataattattttcacaacttttaatatagttatttcttattactcttacaaacttcgatatattgattactcaacaattaatttattttgggataaatgggtggagtaaaaatgaacgcagagtactgcatttgttgctgtggattaatcgccgcgacagccagccatggctatgcccgtacccacatccccctgggagaaataagttgagcgctttgataaactttgattgttgttactcgaacaagacaaggcactgcagtttcagaggatccgcgcgccagtggccatcgccgaatgtgggcgatgtgttgatggccaccagttgtgcgatgatgtgtgtactagtgtcaagtgtttgtgtgtgtggatcacgggacgagacgatgtgtgcagttgccgagcaggggaagggcaaaagcaggcaaggattgaacatggctccagcagtccagctccagatgaaaagagcaccgcgctagtttcccaagtgatctatagctagcaggtgcgacatgtggtaggctggacatggtagacgaccgaccatgaaccaatatacacgtcgactttcgaaacgctaaagttttttttcttttttctttttgcctacaaaactacttaccttggacttgtacaagcactagtactatattattagtgtgtaaattagtggtcaaggttatatttaggagacagtaacaatctagcagagtggtagtacctgggctgcacggagtagcagcagtagttcaacttcaaagcaggcacgggccccgcggcgaaagacccgcagtaattgccggccgcagagtaatgccatttaggccttgtttaggccccatttgatttaaagtaaattcatagaaattttagggcacctttgaatcacaggaatgaaaaaatggaggaataggaaaaatataggattctgacaggaatacaaatataaaacagatgattgcaaaacacaggaaaaatataggaatgatcgtttgattgagccgcaggaaaaacacaggaatttaaggagagataaagactcaaaagattcttaacatgaggtagaacctcatgctaaatttcctccaaaacctgcatgggaagaggcattccatagaaatttcatgggattatataggattcattcctttgattcaaagggctatatagaaaaaatttctataggaataaaatcctttaaaattcttatgaatttcctttgaatcagagggagatgattttatttctacaggaatttttcctatatagccatttaaatcaaaggaatggatcttatagaatcatatgaaattcctatggaatacctaatgccatacaagttttgaagaaattctaacatgaggtagaacctcatggaaactttcctttgagtctttatctcttctctaattcctgtgtttttcctgcggtccaatcaaacggctattcctgtgtttttcctatgttttgcatcctctgttttacacttacgtttctatcaaaatcctacgttttttctattcctacgttttctcattaatgcgattcaaaggggcccttagttcgcgaaaagaaaattttagcgtgtcacatcagacgtttgaccggatatcaaaaggggttttcggacacgaatgaaaaacctaatttcataactcgcctaaaaaccgcgagataaatttattaagcctaattaatctatcattagcacatatgatttactgtagcacttatgactaatcatggactaattagacttaaaagattcgcctcacgattttcatgcaaactagacaattagtttttcattttatctatatttagtgcttcatgtatgtgtctaaaaaattcgatatgacgtttttaaaaaaaaaaattaggaactaaacaaggccttgctcgagcaagggtcgtcgagtcgcgttacaatctgaatatcttatgcccgctgcttttctcgatcggtatggtgtgctcgtacttcgtaagtgcaggaacgcttagatctgttactcgcttgggactttatatatactggaaaccagacgtagattttgcagtaataacaagtatagttcctccagaatatggtttctttaccgggtgggaggtaataagatatggatgttacctgcacacatcacggaatgtgggaaattgcgaggttttgaaatgcaaatcgagctaactggatcactttgttttggtctcctctctgcaccttttcaccatctcctgatgaggtactgtattttcgctgaacaaccgtatctttctttcaacgagcatatatctgacgagaagcaggttcagaaattcagcagtgtaaatataggtagaaactagagatggagatgaagacctcaggaacccaaacacgttcacgcaacaaatcgataaaataacaaacttcaaaatctatcgttggtgccagctgcgtatgatcgtagcattgaagattgatgccaaaataaggtaaatctgtcgccaaaacaaagcagtgcaggacagcaactgctttcggcaagagtaagtacatcaaacttaaaaattcatattcaatgaggtagggaagtgcaaggaaggctccaatgctgcttgcaccgggtgaatgtttatcaaacgaaacatgtccattgaaaacatgacaacataaacttttgtagattcagaaaaaagggaatacctaaagagcaattgaaacagtttactatctgtgtaggattacagtttaagttcatgcggttgtgcagataatcttttaaggtcgcctaaagataagcagctttccctgattggcaattaatttctgcctaaaataaacaatctcagctcgtagatgtttatccggaaaggtgacatattatcatatccttattatccacaactgagaagattccattagtcattttctattactagtgtaaagcattagctgaatgtccatgcacggaatgcttgatacatggaagcatgaagccaaaagctcaattattagaagcaacaaaaagtaggccaagccaggaggtcaagggaaatggattaattttaggaaggaatccaacctaacctggcaaggtgccccatcgtgccagctatttgcgaagccagaccagcaccaatgcaatgtactttggttgtatgcctcttcagtctattcacaaccaactgcactgtgctttggatatatacggggcttgtgtgccacctgaccaagggccaattagttaaattataacacaaatagcatatcaaatgtttgatgcatgttttagacaagtgtatcatagtatcatatcacaagcatgcacagcgacaggtgaatgctgatatattactccttggttgaggagtatgcttaattgcatatagcatcttcaaaatcattatggcatggtaatatcaaattttcaacattacaaattattaatattgttttgagaaactcatttgatataaatatgatagcaaataactatagaattattatattacgtttatagcattataatctatcaatctaagaagtccaagttggagaaatttgaccgcactttctaaagcgaaatatatttctaatggaaggggtaccactttagctcttggtgttctttgtcgaattcttccaaattagttagtacttaaaggagcataaacacaattcatacaaatggaaataaatataggatgatgatttatttcaaaaatgacaatataacgaacgaattaaggaagtattggcacagcctgaatataccactatgaagtgaggcatctcttcccttttggttggcgatcctagtgcaagcccattgagtttatataaataaggcggtccataggagtaataattgaatatacatttaacaaaatgttatataaataaggtggtccatatgagtatttgaatatgtaacaaaatttacgatgagatagagcaggaatacaaaatcatttgtgtaatgtactaagaacatgttgaaatcgtgaaatgcagcaccacatgcgtataatgtcaaatcattatcacacttccaacattaaaccaatggaaaagggcaaataaaacatggaacatgcaaggtatctggcaggaggaaacaagatatcacaagaaaacagtgcagatcatgctatgttcaggtgactacgaagtagaacagcaaacctgtcagaaagcaataaagtcctgccaggtattttgtgttttcaccatgtttcccagaaataaaatgactgagcaaacagttccagtattgccataaatggtactccctccgggttgataatacttgtcgttttggacaagggcacggtctccaaaaaacaactttgaccattattttctattataatatgtataaagtgttaacaaatatataaattttattaaagtacttttcaagactaatctatacatgtagttaccatatttgaaagataaatattttaaaaatgattcataatcaaagattctaaagtttgacctcacccttgtctaaaacgacaagtattatcagcccagagggagtaacttaacaaccattgtgtgtgtgtgtgtgtgtgtgtgtgtgtgagagagagagagagagagagttaccagttgacaacgtggatcccagaatctgatcttccaggaatcaaacagttttgcttccagcatatcaagatgtgtgcaccgaaaatgtcggtttacctaaaggcacatgagggctgaggcacaaagtaggtaattctactgtacttataagaatatttgctggataaagagttaatgacacattttatttagtttagttgataacaagcacataatatgatgtgtgaataattcagcacaagcacgtataggaaaaatattttctgtcatgttgaacctcaaaaaattatctgtacacatatttgaccctgatcctcaacttccaaaactcaaaatataggaatagctaatgaattggaagtttccactgcaacaaataagcaaatagaaataatactaataatgttgcaaaggaagacagtataaaaaatgaagttatcattgatgactaaacaggaagcaatgaaagcagatgatttcctttcctatcaatctcccaagcacattcacgttgatgcaccaccttttcttctcctagtcgtcctctttgcagtatattgagacccagcagcaactttgctggtattctgattatcattcacaggctgctcgtctggagcctgactgacctctggagatgcatttgtgtttggaagagtttttgctttctgtgatctgcttgtactaatctgccttcttaggcgcaatatctcaccctttgctaacgccaactcctcttcaagatgtctagccctcatttcaaaactctccttctcagtctgaagcctagagataagattctgagcatcctcagtgttttcatgagcttcagttgtgatcttctgttgctcagcaagagcctttgataacatttttttctctgcttcaagagtgtccttcctagaattagtttcctctagctcctttgatagtgataatgcactcctgttcatctcgtctagtgactttgttgcttcatccaggtctgcttcaagagcttttcgtgcttcagaatccatctgtagttgtttcaccaaagcctcaagctccctattcaaagtagtgacagttttcctttcatcaacaagctcctgtgacgtggattccaacttcttgaacacatcgagcaattctttcttcaggttgtcacgagcttccacaatggatgcaagctcattagaagtggcttcaagttcttcctgtcccttgtgaaccatctccttaacagagacaagttcgtctgacagagctttagatactgattctacctctcctagtttgttagtaaggccctcttgcatttcattgaactcatcctggagtttagaaatttgcagcaccaggtcctggttcattctatttgcttcatcaagttccactgaaagtttggatacctcacttctggaatctgtcagtgcctcctctgtggattgaagtgattctcttaaacttttaactgcagcaacttcattctctagcattgcttttgttgcatccaattccttgttcagcgcagcgatgttctcacggtctttgctagaatcacttaatgcatcagagagttttccatcaagctgtttgatcatattatctttttctaatagtagctcagagttgcggctctctcttgcttcagaagaagccttcaggtctgtataatcttttgttaactcacttagcttttcctcagcttcattctttgcagagttcagtgcttgaagttcctcattcagtaaatcaattgaagatatcttagaagaaagatcatttctagttctatgaacctcttcctccagttgctgtattttagcttctgcaagttctagactctctttagtttggtcagagaaagagcacagattacggtagtctgcttcctttgacgaaagtaatgaactgagttccctgatgcgtatacccttattatcaatttcttggctaagcaaacttactttttcctgcaaaatgttgacatcacccaacttttccttcagtttggcttcaagaacatctttgtcatccccagcttgtgcaagactgctctctagtcgacgtatttcttccctaagctcctcagccagtgtcttctcccttctgaattcttcacttagcgaagttaccgtcttttttgttgaagacaactgatctaaaagagaggcttcctgctcctgaaacttcattgcttgcttcttttgtgctgtttgttgatccagcaatcttttctcgtagttttccctcatcaatgagattgctgcctcattttcagccagtttgctctccatctgaacaagttagcaaaatggatatgtcagctaatgtcctatattagcacatcattttttaaaaaggttttcaagtatgagaggtacataaaatagttttggtagcctcttgcatataaatctgagttatattgtgctgtgagaacttaagcaacgcttgttttcctaaggggaaacatcatgacggaaaatgagttaaaactttttaagctcttcatgagttctatactttgttagttatcaggttataaacttgagggtgcacagattttctagataaaagaaaataaacaaaacacacaagcatatgtatgcaatcacggaatgtacaactctttaatgtgtatgcatgcaaagatggttacttcgtggaaatttgactatgcaaggatgtcatgggacacttcaaaagtagtaaaatagaaacagtagtaatggacactaattacaggtttgcagatgttttacagatgagacgacggattccagggccttcttttcctgttgagaagtgccatacagtccagcaagaacaccggaggcagcaactgcaattgcattcaaaagaccagaaagtggattcccaggagtttgttcttgcgtgacgggcagggatgattctggttgcaaagcttcaggtagaggagattcagcctgagtttccccaggctgaggttcatcaggcttttgaatatcctttgtctctacagagaaaaacaatataaactatttattccaagtttgtacaggatatttccaaattagtcctaatatgcaagcgccaacatgagatgacaggaaggcagcaccaacaaaatcaatccaaacaatatcacatgcccaggtcccaataccagtttacaaaagaaccatatagtaaatccaacacattccagtggttaagataggtcaaaagaactttgcaggtacacctcaaagtatttatgccagaaaacaaaaataatgcagcacatggtagtagaccacgacagggttcgctaacataatcatagaccccgtatttagtatgagctacttgtatgagggggaaattctgaccatcgacaatagcctcattaggtctacatatgacagtattacgtccaatcttgaaagttttgtagcaagtctgagcttgatgatctatccttgggaaatcaacccgctttcttctaataaatccttggggaaatgacatgccataaactgcgggaaaatgaagaaaaaatgacatatggtcacatgccataatcagactcaaaattcactgggataagttgtgaataatgagcatgcatgactccagtttgagactttgtcatcagaatgtgaaattattttttattaaaacaacacacttccatgcaaataccagccaaattcagcttataaatttatcaaaacttcccttatccctagttccaaaatgcatagggaatccgcgtggtgtactcaggatgcctaacacatggaatggcaatcataaatcatccactgcacctcacatagtggatttgttccatttcaaaactggtcaacagaatgaaaatgaatttgtttgcacaaaacctatacaaaaggggtacaaagggtaagatgatatactgtaagtgtacagtttacttagatgagccatctacagccaagaccaccttcatgtaaaaatatcttactgcataaagcatttacaaactctttctaccttttgcaccagtacaaacgatcactgtgacattctaggtccattcttccatctgatagttccactctagtgctaattgaggtattaacatgtagaagtccatatagaatcacattcaacatgtgtatgtttgcagaaatagtctctgcttgtgggaattgtgctattccaacctcctaattcctttccatccatgcgtatccctgctcaaggaaagcgattgcgcttgtcccatgcatacataattgcttagcagcatttgttagcagatacattgtaaactcttccaccattagcctgaacagaaagttcagatttctcatgtggagctaaaacgtccatataatgcaacgctgtacgttagcagtaatctccatgactgaatccacaaaacaatctatacaattggacattacagaaaatttaaagcccaaccataaatgattcaaatcgcacacagatttcatatggtactccacaatgccagaccgaatagtatccaggctgggagaaacacaaaacgagaacggaattcaaccaactcctggaaaggagaatggcactcacccgttgcgagatccccgctgttaggcgtggccaccgcggccgccgccgcggcttccctggcgcggaggagcgggagcgccgagacgccgaggagcacgccccgccgcgccagcacgtacgcccccgccgccgccgccgagtgggatgggccggcatcaccggacgacgacgacgacgacgccgagctcgacgcgacgatggccgcgcctctccgcgcgcggcctcctcggcggcaccggaacgcgagcggccgcggcgccggcgacggcgcgaggaggaggtaccccatcccgtcccccacgacgcgacaaccccaaaaccctagccccccctcctcgcggtggcgctcgccttcgagctcggaagcggaagcccgcagtgaaaatggcggaggtgaggtgaggattaggcgatggcgaaggcggaggcggagacggcgtcaccgcgtcacgacgggtccgagctggcgagagaaaaagggcaaaacctttttcatgtacccacgaaatgacccttttaccccccgaccctttcaatccagcactgaactccgcgagcacctcggtgagggtaatttggggcattcccccacgcgggtggtgggacccactggcagcgggagtgcgggtccagtgagtgagggtctttctgttttgggatttcggaggaacggaggaagcgagctgatccggagcgagagatgaggattgcgccacgtgttagtgtgggcccagcccagcaaggacaccgtcatcgcccaattagcggtccgcacgtggcccagtacaaatggtccgcgagtaagccacaatctgtgccggcccgatatagatgggccacacgtaaccgcaatctgcgccggcccaatttatatgggcctcacggattccgcaactccgttccgtcccgttaataatgggcctaatacatgtgggctaacacttgggatcgctgtttactaaagatttttttttcaagtacgtctagcattactcaactcccatgctttctgtctaaataaaatgaaaaagacttcggttctcatcgttaatggcatatttacgaatgaaaagtaatttgtgaataaaacttttatatacgtgttcttagcgatctaaaagcaaatgctggaaaataaactttgaagaaaaacccttaaaatcaactgcaaatttaatattgaaaattcagattttggctgataagcataagcataagcgaaaagatgaggctgttccatcctttctcgatggaattcgagcccttctcaaattagtttgtgttttcttgtagttggcaaatgtctgaattctgccatcgcaaagaaaaaaaaaagactgaattccgattcatttcgaaacttgttgcgtgcaaaatgacaataagtttttgcagaaccatacagatggatccaacggcctctgccaaccaaaataaaacgatgcaaacattgcagtgaagtgtccataaaagttgagcaatgtatggccggctctgaattcaatacaagcagtcccaaatgcaacaactgttctgctctgcaacgcttgttttcctgaccaacagagccccatttgtagaaacaggtggtattacagcaaaatctgaatctgctgcaaatcatctgaatctgatctgattatctgaccatagatttcagccacaaaaaaaaaaaactttctttaattctgcaccctctacatcattggcctctgacggtccaagatgagatccagcattcaaaaccatcattaacaacatgacatttagtagcaaatcatccagataagtagtattcataagacggggactataaaccatcataacaacttgacattagtagcagatcagccagttaagtatcttgatgagtctggaattattttcactttcacatgcaaatgctctgcatagtttctacttgggcatgatggtcagtttgccctgtctccttgaatctgcttgatgagaccccaaaatgaactctacgcagtactactactacttcagctttcttgattaagcccactatggttaggaccagctatattctctgataggccaaggcaaaagatgccttgaattcctaaagtgcaacgagcaaatcaggtcagttagatcatcatcatcattatcaccattcatcatgtcatttcatcagggtaaaagaagaatggaaatgacctaaagcagctcaatgtcattatctcacagcagaagtagtgtagcaatattgcagacattgtcactgctgccaaagagcaagaaatgaagaagaaagaaaaggaagaaaaaaaatggatgtgggcactggccagcagccttaggatcaaaactacacgactaaaatcactaaaggcaggcaggcgacctctcttttctctaaaaagcccagatctctgcaagtttccaggtccagtaaaagaaaaaagctcatcgtctccagtgataatgacccaccaagaacattggcttcttcttcttcttcagtttgctgaatcaaaaacaacagactgatgatagatagcaatgtgagctggtgattcgatcatcttgatctatcccctggtagaagaccagggggaaaaaaatttggacaacttgcggaggcgaggacaggttcaatcggtcggtccaggccacgggaagggtcaggtcatgtcgcgacgaacatgccggccatgaagatgtcctcgtggagggaggagcaggatgagggcggggaggagacgatggtggtgttgttctcggcttcctcttcgatcgggatttgttggtcccggcaattggcgctgcagaatgctttctcaccactgcaagagcaaaatcagaattgttcagtgtgcctttcttactgatgacgcagccggcaagatcatgtacaaaagataataataatgcatccagatgaatcaacaccaaagaaatatgttcagtttacttttgatacttttttattagcaaccaatttccaaccaaatcaattgaacctagcaatatataataaaccaataattcagcatgctgttcacatgtccagttcgatttactacatcatactgaaatcccaaaacatttatgatgaacaatgcagcaatttgttcgatgatttaagtaattccagatcagagttcgctccgcagaaaaatgtcttgaacctgaaacatgaaatgttcctccaaacaatgcataaagaagaaaaagaagaagattgcaactacataccggtaaatgtaaatgtcatttccctccagcttcttcttgcaagtgaagcaggagctcaagaagtcgccgccgccggaggccggggcggcgccggcgtcgcacttcaccacccagtaggactcggtgggtgcttccgtcacatccatggcggcggcggaggcggaggcgtccatcgtctggggctccaagatgcagtcccaatatgtgggtcgtcttgggattagggccgcgagcgatgatgcaggtgtagtcctccgactgctcgatctcgctcgccgagaccgagccgatgaaccgccggacgccgccgatcgacgccggcagagagcccggcccagggatcttgccgccgccgagattcgaaggatgcggctgcttggcattggggcttgagctgccacctggattcgaagtgcgcctccagagacacagacattcagatnncccctcgtagatagaacactgccggccacgagcacaggaccatacccgcccgtgcaggcggaagagcaggtggacgggtgggcccgcccagcgagcgccaaggaccatacgtccttggtcgagggctacctcccggagctgcggacgaagtagcctcgctcgccgcaaagtaccttagggctagacgaaggtcgaacagacattgcagtcgggcctcgacagcgcgaggtctgaaggagagaaggcaagttgcttgggcaggcggtcagtacgtacggtcggcaggcaggcagaagggcgaagggctcgaccagggctcagagcgatccccaccacggctctctcgcgcgacccgcgcgcgacccggacgcagtgagctgccttgggagatccacgcgcgcgacgtcggtgcttccatcgacgccggcatccaccgcccatcccccctgccccgcgncttcgcggcctagcccaacaaacaacctcggcacggcgaacagcgccgcgccgccgccgccaccacctcgaaccctccccgcctccccgccgccgccgccggcgtccgtgtccgacaccaccatcctccgcagcatcgccgccaatccaaatccaaatccaaatcccacctgcaaaatcgccacgaaacttaacagactcaccagaaatgaagaaaaaaaaagatcacgacactttcacccccacacccctcgcttcttccaaacaacttctagtaacaaacaacaacaatttatgaaaagaaaaaaataacaagaacagcaagaacaccacctcacctttcctcctcctcctcctcctcctcctccaccggcctctcacactctcgatctcacgagaggagagaagcggaaggagacggtggggaacaaagtttcagtgaaatcacacactgtactactactgacgcgagctcatcggtagcaccatctctctctcctctcctctcctctcctctcacgctcttgtgcacttgtgcgcgtcctttgcatgcatcaaaatcagagacgcagcagcgagagggaggggagggggttggcttctgaaatactcgtacacacacgcaccagtacaccacctcctctctcctctccttctgcttcagcttcagctcggctcgaacccattcatggatgtcagagaaagggaggcaggcagctgctgctgctgcaaccctgcggctgtgctgcctgtactactctactccctccgtttttaattattattatgggtttttatccaaagtttaacctttattttattttattttattatgattagtaatttttattttgttatatagtaaaatataaatttgtattttatgcatgacttattttattttaatattttatatatttttgaaaaagaatggtgaaacgttagataaaaaagcagtcaaaacgttttataacctgatacgaggagcggtagtactatgtactatacactgcaccgtgtactctacgcgtataggagtaaatatacggacctacgcgtgggccgtaggttgcctgcttggcatgtcacttcagcctgtgatgctacagaagtaaacagtggtagagtatttttgtacacgatgctgcttccggtttcgtgtaggggtaggcgttctcagatcccaccagagcatctagaaaaatgcacgagatttttaccaaaattgttactaccgctataaacgtggtagattctcaagaatacggctgcctttgattggagaggtaaaaagaaaattactactccatccgtttcagaaggtaaatcatcctaacatttttcatatttatattgatattaataaatttagatatagaaaatgctaaaataatttacattgtgaaacagaggaagtagatacacaaaataaggtgagttattattatataattaatcaagtattaattattttacatttgtaaaaataggttaatatggtttttgaaccaatttttctgtatttttttaaaaaaaaacatatattttagtagcttcaaaagtatacacgtgaaaaacgagggaaatcttatctccatcagcatcttcgaactcagcctacaacggatatattattgaaacattattgaaacggattatttaccccatcaagaggagtacgtttttctaaaaggttttcttttactgtttactttgatcatttgttttagctgtttgttatatttactttataatatatttagctgtttgttatatttacttataatatatttaattttataatcaagttgataatttgcggcagtaattcacctaatttcttaatatttagaaccaatgttgcattttattcacttggattttgaatctatttccttcatctcaaacatagtctaatcctagttatgaatagacatatacatgtccaaattcacagttaagattaggtattttattggacgataggtgtatgcggtattttgctttagtagcttgcaattggagtaggttgagacgttggatgaatctggacggttttcagcaagccataaaatcacaccagagaaacagagaactgcttcagttttaagtggaaaatgacaagagcaaaacagtagcacggccatgcatgcatgcagtcatcagttagttcagtgattacacatctttgcaacctcattcaaactcattaattggcataattactgccttagcactgttgcacatgaccggttccaccaatctaaactcaacaacaaatttgggaccaaaagatagtaaaatactcccgaaaattaattccgcatcaagattcaatcaatcatcattatcatcctacctaatactaccaccaccacataatgacataaatcaccccctccctgtgaatgatcatcacttgagaagttcagatttctcgttggatcactgcattaggtatgcaatgtactgtatgcaccacaatcattggacttttaggagagttttcccttttctcttcttttcttggtgctgttctgaaaaaagaaaagagaaaacctccccagcgtgtaagccttttccttttcttctctaatttccaagctgtttctgaattattaccactgtttgtaaaggcataaagtgatttggcaaaccatacactctcctggcaattcatcttttcttctctcttctctctctatatatgtctctctctctgttcatcttgtgaacttgctttctttaaagcagagtggctttagcatttaggccattcacaatgcatctacatggcatttggcctcaactgtccagctaagcagatggtatacgtggagaagaaaagaaggtggagcacatgtattcaccagctccgcgcgtcctcatttggctccgagagccttgtcagaaaaacagctttttttaatcgcacttgcacatgagaaagcgggacacagagagagaagggggagaagctaacccaaaaaagtaaatttttgtggtggggcccgcatgagaaacagtttggtggggtccacctaaagacacgcgcccacgccgcattgtggagagaggagcttcacgctgtttcttcgtacgtggctgtttaggttcctcagaaaaacacgacgcagtgctaatgcccttaggggagtagagagagagtggcttttctaatgacagtactacaaacatgctactcatcctttgttttcactgtttactgactgacatcaatctagtggtactatgatactataccacatcatcattgtgtatgtaggagtagggtccttagctacttgtgcaacttccataagtttacacttgacaaagttggcttgtgtcccccttcatacaaaaccgggttcaaactcttttctctcaactctccaaggaccacactgcctatatgaattctttctatgcatcggctcagaaacattgtcgagctataggtgaaaagatactatccaactacaacagtagtagtagatactatcagtatagtattaagggcctattcactttgatgacatttttaaccttaccaaattttagtaaagttatcaaaaaagtaactacatttagtttgctaccaaattttggtaactatataagaaatcctgccaaaattttggcaagactatgtcaaaattgctaaaatttgataaggttttttttggcatcaaagtgaacgggccgtaagaatctcaatgtgtgtacaacatttcaatgtgtgtgtgcagtcaaatctcacaatgtcaagtggctagtacatgtatgaaagggccggtttgatttggtttgtagtgtagccaaactcaacatgcaacaaatagaaatgacattaacatcgttatcctactataaaatttcgtaactccggaaacttacactctcaaaaactacaccaattttggtaaaactttaaaccaaagggtacctacttattaaaatacgccaacatttcgcattgttgctatgattgattttagtgccaaaaaaactaagatttgatatatgaaaatgctgaaaactatttataataatactcataaatatgtactacatctatctcaaaataaatacagcgttggtatgcgtatccaacatttgaccgtccatcttatttggaaattttatgatttttttcaaaaaaaattagtcacacataaagtaatatttatgtgttatcatctaataacaataaaaatattaatcataaaattttttaaataagatgatcaaacattggatatgaatagtataaaactgtacttattttgaaaccgagcgagtaagaaattcaattgctgaatgtgtgtagatacggtgttgacatcttggcatgcaaaaaaagatcaaagaaatgtagcactaatacctctaggatgagatggaatcgaggtgaaatcccatgtagtagatgaaacaaatcctgagcatgatgattttgttagttttgtttttaggcgtggatttgcagtgggggcagtggttgcaaaacccgacaaatcgcgcaaattttcagtagatgctctgcaaagtcccatgacgaaactctgaacccttgcccgatatccgatgctaattggacggttaactctgttgcctctcctgattctctacgccgccaccatctttttgacgcaaaattttacatcagcatgtaattttttttaagaataaaaatcacaccgccacccatctgaatgtattttttattttaaaaaacaaacggagagagaaaaatcacatgtttgaaatcaactattactgcatactcatcagtcgtataaaaaacgaatctaaaatcagatgcgacacattactataaatctagacatacgaagtttgtatatctagattcataatactaaaatgtgtcacatccgatactaggttggttttttatgggacggagggagtatactgttagtcgaggtgttcagcgatttttttttgtcaaacagtacgaattgagcgatagccattttcttgggcggctgaccttaggctttcgttcaaaatttaaactttcgctttcacagcatgatatgatgaaacaaatttcatttttgcaataggtggttgcatcatatatataataatcgttggaggaaaatcttgtacagcatgagtgcaactttagatcatatttcacggagtttctttcatatttcatgaaaattctgtaggtttaataatgcatcttggtgttgggtgaaaaatttcaatatatcctagtgtaaaactaaaagtacgatgcatctacctaggtttgatgcatgcaatggtgaagggaaagagtaacgtcacatggatatgccaccataccctacaaaaggcacgatgattttgggagattttcatgtcggtgaggcacagttgcctgcactctttgagcatgatattatgagagcaaaatagcgacaacatcggcaacaaaaaaagaagaagaagagggaagtcaccgaggtggtccggacctggggtggcgattcgatatgagagcgaagacgacgacaagtgaaagggatggaactaaggggatcaaaagtaatattttttttcctccggctataggtgcatcattagcatggtattaataatttgtgaggggtttgaatttcattcttcataaaactcacatcaaactcattctatgaaccgaacaaaaattagtaatggttgaaatgcatttcgagcccattctagctatttgcattgataaggaaactgacttcaatagtggcttcaatctacatgtcacatcatctcgcgaatatatatatatatatatatatatatatatatatatatatatatatatatatatatatatatatcttataaaggctagtttacattataatatgtttttttatcttagcattgtaaacatgagtatgctctcagtagccggttttgtccaatggccaataaatacaaacagtttgttcactttgttacctatatcttataatttaggacagatgaagtaatggtttaagtatgttgtcttattaaaatttgataatattgaaatttagtaatgcaaactgtaatgatcaaaattttgctggcatatgtccagaccgaagcatacgtacccacaaccgcacaacgtatcccgtgcgctgtggggcccaaagagcagcgagtgatgaccgtttttttataaattggctctttaaaaaacttattctgaaaatagcccctggcaaaaactagaccgtcataacgtctcagcgctgataacgttatcggcgctgagaagttatacctcagcgtcaacctcaatgaatgctgagcgaatgtctcatttatacaataagtttttagcaatgtctaattttaaaataagttttatggaagggtcaatttatcaaaatttcgggagtgatggaggtacgacgtactccaacagtagtagtcgtccacttttacggggacagcgatggccccgatttgacaaagccgaccgaccccaccacctcaatggtggggcccgctacgctggattctgattttttccctcctttctttctactacagtactcattttctcaggtttttaccctccgtgtaaatgtacccaatgtgtaatactactccacaccgtaattttcatatgccctcttttgttggtaataatgtcatctgtgctaacgggtgataatctcagcgtctcggccggcaagaattttgcgcagatttttctctatgtgcaagaatttttaacgtttctcgtcaaaatcaattctataaatatttgacattatcaacatttagtaaggtcaatgtttttttaactggttagaaaaataaataaaataaataaaaataatattttattgatagaacttatatacctgcaaatcaagaggggagaatataacacgatgaaaaaactcctaaaatcatttcttctaaaattaagttagaaaatccgaattttaattgcagcttataagtcagaaaaatagaagatgatttttcaacaatatttaggagttgtttcgtttaataccttatcatttttttttgtatagttacgcaagttgaatgtttcgggattcggaatttttggtaaacgcttatcaaatgctaaaattctgtaatgtttgttttagcaacaaattaaacaaagcccttactaaaagaatatgttggaatgagtagctccgcgataacgattgctggccatcaatatatcgtcgtttccaaatgttcgatgttggctactagttcaattttgagctaaccaagaattaaaaagagagagagagagcaaattttttttttctgtacgtaaatttatcagatgctaatactccatcgtaaaaggattatgaagttgaaatatatcccaaatgcatcggcacttcgaacttcttgctatctttactatgcctttctttcttctaattatcatatcggattaatacgtgtcttttctctaagatcattttaaagctgctccaatattatgagaactttacagaaaaaaaatgagccatttgagaagtttcaaggaaatcaaagtgtactaattaaaaagagaataggagaaagagagaaaaaaaaaggcagaactgagcgagacgcggtgtgtgctcggagtgcgcagtcgagggccctttttgtcgtcttccggagactctctttccacgcgcacgcatctcgaggcagtggtaaaacatctgacggcctagcaggaagatccgcctgccatcgtacggcccgagggagtcgagtgggagagtgggagagggagccccaccgcacgtgctgccgacacgtgacaagcaagcgtttcactcccttttcctttctttttttttccttttcgctttttttttcatatagtagtactacaaacaaatggagtggagtactcctgattgccgacatgggtagagcacccataaaattcactaaggactcatttaaaatgcatgatgaaaagtatatataggattttcataaaaattttagtgtaaaagtaaagattataatacacagtaaaaatacagaaacgatcgtttaattgaataaaaaaaccgtaagaattgaatgagacagactttctgcgatgttagatctcatattaaaaatcctctaaaccttgtattgattgaggcgttaattaggaatttcatatgattcaatagttttcaatcctaagcttcaaacggctatatgtacataaaaaaatcctacgaaattagaggattttcgttcaaactcctatttggttttctaaaatatgaaactaatagctcgaattcaacttttttgtcattattcttcttaatatatttagggtgtgttcggtggttcctttttccctcttctaccctattgttttccacgcgcactttttggaaatgttaaacggtgtgtatttttttaaaagatatatagaaaaagttattttttaaaaaacatgttaatctctttttaaattattttagctgatacttaattaattatgtgctaaatgatccatctcgtttttcatgcagagaatgggttgaattaggccctgtttagatcctccaatatggcaaatattttgccattttgtagcactttttgccattttggatttaaacactagtagcaaaagttggcaatttgacatttgacatttgctagtccatagtagcaaattgtgccaaaaattgctttgggaccactccctctctctttctctctctcactctagtgctagaatggcaaaactttaacatgcatctaaacaccaactactacttttgcaatgccaaaacttttgctaccaaaacttttgccatttgccatttgccattccaaatagatctaaacatgcccttactatgttctaactaagccttttatctaaaaaaatatgatcgaattttcctgtaaaacaaagtatacgatcggacttcttctcactctatgcagaaaaaaaataccgaattaaatgtaggcatatactatatctttttcggatttatttcattccatatatctttttaggagtagaaattatgaaaggcacatgacttgtactagctcatactatccctcgctcttttgtctgcatttgccatctgaattctcaaatactatactccagttgccagttgccagttgccacgcgaatctcaaattaaaaaatgacttttgacgctgtaatgatagcacattagcagcagtaagatgttgtgttagatcatgtacacacttttcccatcaggtgatgcagatgaaccaaacaccccaaggaaacaacaaccactttaattaaccaaggataaagctaaagatctttcacgtgccatgccatcgtactaatattaatcctagattgtcgtatacagaatcaccctaatggcactacaaaaccctttgaaaaaaaatccagtttatcctactaaactattgggttagtaccatttacaacccctaactaatgattttgaccatggcatacataccaacgtactaataactttgttttagctaaaataatcaaagtaccctaaattaatttggactttaaagaagttactaagtggagaccactaagcgtggtcaaagttacatgctttggcaccatatgcataaaaggagattaggagaaacaaacccaaattaactaaaaccaagtggtaatatatgtatttagaatttgggtatacgatgctcaatacagatctcttgtttgtggtatgcatgtatggacaggtcgccagaatgtagaactactactttgtgggaccatcagggtataaactaagtcaatccacaggtttcagtattgcaacaggttcatgtcatgccctctctctgatgtagcacagtctgcacaatgcagggtagtaggagtagtaaattttagtaattttagttactgcatcagcgtgcacatgatgccttccctgaacaagtgcagggatgcaattctgattttctgtccctatgagtttgttaaaaaaaaatactatctctgtcctaaaatatacttctatataaaaataaattttatttgtacaaatatatccgttcagatgcgttcggctatactggctacaaatactatgacaagacaatattgttgcttttcttttttttttaataaaaaagagtaatgtgatgtactgatgcgataaggattttgtatctccaactctctaactaggctttactgcacgctacgggtatgaagcaccatttttcgaacggtcagatcattgccgatggtttatataaaaaataagtgcctcattttaaggaaagaacccttttcccgttcgtgaaaaattttaaggaaagaacatgatcaaaccaaacggcctgttcggttgccttatacaacgcagcttgttgctgtagcaagtgaaatgggtgcaggttgcaggagagcgttgtacataacagccaaccgtacccaaattgtgtcccattatggttttttcagtttttcctaattaattatgtattgttggatacaaaatacctcgtctgacagcaaaatagtggcgaatgtcgatacgtgtttttcttgtcaagcatgatcaaaaggattttatcattgcaaaatcattttgacaagagaaatgaaaaatggttttaattgaaggatttatttttttataatgaaatgaaattatcgtcactatcttttcttgtttttcagccgaagagtaatttactcgtagtatttttactattttctactcgtggtaaatgggtgggcccgcaatcccagagacgcacttcacgagaaactaaaaattcctccagattgtgggccacatctgcagaggtttattgcggctattattttaccccgtggggggtggttgcactgcactgcattacattatgcacagtgacaccaggagcacagatatatttaatgattaattcattgatttacttattattccccagaaacatatagcagtaataaattccaaatatttgcatcatcctcaagaattttttttttattttttttctcatgggaatcagacaagcaagctctctgcttttattccccaatccacacgtcactgtgcaaggttccaagtaaacaatggcgatggtatctgcaggtgggccctctgaactgatagtgtgatgtctgtgtgcacacatacttttgtccctgaaccaggagtggtttgcatgcaaccaccggtacggttgtaatgaaacggttaattagtgtgcttgattatatatattttactattctgatttgatgtgtgtgtgcctgttgatttgacttgcaacatgcaaatttttgttctccgcatgcttaattaggtgtcacagttttattttattgttcattttggaagattttagaagggcatattctttggagtttggaattatttgagatatattaggtgtgcacaggaaattcatgtggcacgcggaggttgtggattcgaaactttgtctttattaaatcaaaggtacttacttatcattgtctataatactattattattacaccttcaagaaaaagaataattgcattaaagattctttacatcccaatatatcatcaggtcttgaaatttatgtttggtgcaagagtaattatatttgattaattgaatcaggaaagaacaccaaatccactccggatttaatctgtctgcgaccatgcatggtccatgcatatgcattatttgtgtcttgctgaatgggtgaagacaatgcagccaaaaacccaattagattcgtttcaactttcaactggagtaagcatatatggtccacgtttcactcatggaaatgggccaggttttatagcccccaataattgttagaattggagcttggtatatagacaaaaaaaatattttggcagttcataaacataagtatatttattaaatatatatttactacatataagacattagcatattgtgagccgaagtactattgtggtatttttagcactcgtttagatcactgataatccaaacattaccaaataattggcaatggcaggatttgacatgccatttttttacaaagaaaggttatttgatttgttgccaaaattttggtaatgcgtagaatttgtttgtttttctgccgatatttttggtagcaatcttcacatgcccgttcagtgctcaatgttggcgacacttaggaatagagtggaatcaaaatttggagttctttcagatgatcactctagcaagactcaagtttgcttggaggggctttctggaggttttcttcttagcagcatggcacatttggaaacaacgaaatagtttaatcttccagaatattcagccctccttccaagcttggagatcactttttgtgaaagaagttcttctgcatatgtgcagaatgaaggaccccttaaaacaaattgtttctgattggttacaaactttatagtttttatttggtttctttcctccttaattttgtaaatattttttgagttctataaaattacactgctgggtaaagccctggcaatatttctggtaaaaaaaatatttttggtagcaaaccgaatgaacaccctagcttattggcattgccaaaatttttctttttagcataattaagaagggagatagaccaagcccttcattccaatattcagctaaaaagacccatggtgatatccaaaactacaatcaagaaagaaagcagattgagtatagtggaaataggcgaacgagcctctaactgagtttgattaggtggctctaataacactcctcaggtattggttcgactgcgagtttcaggcacacactaaagcacagttctaaggctaaatcccctcgtctatcacacgctaaagcacaattctaaggcttagctcaagtcgttggtcgttttcacacgggttacgctgctgctgtgtaagcaaaatacctagggttatcttaccccgcaggtcaaatagtgaaaatagatttttttttgtcccaattttaaaatatcacaatctggccattccaatttagccccattacttgtgttgaaattgatcatcaatattgattggctggtcaaaatggtgggcatgcatgcttgcctgcccactcaattagtagtagtagtagtacccctttactaggtgctttcaaaggctgtgtttgcctttaattagtttgtgggatcagggagacagtctttctagctactctactctaaccatatcattccatcctatcattcatctccagcagatcatggtagctatagtaggatatatatccatgcatggctctatgattggatgaagatatctaataatgtggggtatctaattaattaattaacctagtttgaaataattaatcacgggagatcgcaacagctccataatcaaactcccatgtttcattttgttcatccgtgtgtttcagttcagtgtacagtacagttggagctagctaactagcttcagagcaagtttaataatatagccaactataagcttatagcttatgttagagttcacatgtatagtaaatgagttataatgttatatctttttttctccttctctctatctctcacttatgcatttaatgtatttatcttgaagtgtgtgaatagctagctcttgcatgagagtcaaccctttttatttttcaaattctttttcatccacataagcttatagttggcttatagcctactattatatacttgctctcactgtgacagtgactgacagtgtttaatttgtattttccgtcgcttgattgattcaacatttaaattatattgcagtgcgttgggcttatctattgtagcggagactggagatataagatattcgttgctagtaaaaaaaatgaaagaagagaaatttgaaggccacgtgggctttgtcctttgaggagtctaccgtattgttggtacagcccaattaaagcccagatggatcacgtacgagcacagccatgggcctagattcgtcacgtgtgttatgtgggctagatatgggccgtccatctgtttaaacccgaaggctcaatatttaagttagcaaatactccgcctgtttcaagctatagttgtttctagcttcaaattttatcccaagatatagctcccattcctcctccttttttttcaaccaattaaaacaatttctctacgtatcaaaaacttcaataataattatattttaaaatggaaggagtagttaagtcaaaacataaaaaaaaaacacttgacggcatattggacggtatatgaaatatatagttaatgtactccctatgacttataatataacaatctagtattggatggggcacatcctagtactacgatatgtctcatccgatactatgttactatatgagacagaaggagtagatcatactttcttcgtcctaaaaaaacttaaccttataataattggttgtagctcaagcaaagaccaggatgttttatttcattatcttaaaaaaaaacttaacctaggacatccccttctaatacaacgaatctggataagaagggagtaaatgtcacgtgaggcaatggaaaagtccatgtagttttttctcgcatgcccggacatgtgattcccacttcacaacccccgtggctcgtacttgcgtgaactcaattacgcctttcttcacgccaatgtccagcgtgagctctatctagatttcttatccgaagtattttgaagtaagtgaaaatcatagttgttaaaactggatcataccagcggttcaatctgaaaaaaaatagaaccagatcctctgatgaaccagaatcagaagctccgtcaattcatccattggttcaagtttaaataactacggtgaaaacaaagtgagccatgtgcgtaggagagcttcgcacgggaggaaagactgacgcgtggtaagaaattatgggtacctccatcaatggtaccttttcttgatgtgataccttgggctagttgcagctcacaattagtttcaatttctcaatgtagtcaatttttctgtaattccaaaggtgggcataaatgaaacatgaaatacaaaatacaaatacggtaagaaattaagtggcggaagacgaaactagtgaccctaataaccaaactagagtgagacatatcatccttattagctactgttcgattaattattgatccaaagctgaaaccaagagactaatccagcatgcatgcgctcccttcgtttggccacgctcaaatgaaacgacctaggaccccactgccacttccgccatggtgcttcccgccacctcttttgtgttctccgcctcctccagctctggcaccaacgccaccacccatcccggcacctccacctgctccggacccacctctagcacccctgcttgcaccaattcctcctcctgcaccaccaccgccaccaactccaagtccgccgcctgctccagctccgctactaataccgccccatcccagcaccttcgttggctccagacccacccccagtgccaccgcccactccaagtcctccacctataccaccaccgcctccaaggcctccgccgaacccgcttccaccaccagttccgaacccgcctccagcaccaccactccatccgaagccgctgcccaatcctgtgccagcaccagctccaaccccaaagccattgccgactccttcaccgattcctgcaccacctccaaagccaccactggcacctccaccaatgcctccactagcaccatcaccaccattgaggccattgcccttgcccccgtcgaaatctctacctgtattaccaccaacaccgccaccgcctccaaaacctcctccacctcccatcccacccccaccgccacctccaacgccgcctccagcacctcctcctatgtcgccccccatgccacctccagcaccacctccaatgccaccactggcaccacctcccatgcctccgccaactcctatgccaccacccacaccccctccggcaccaaacccaccacctgcaccacctccaaacccactgccaccacccattccacctcctccgagttcgcccccaccaccaactccacctcctgcaccacctccaaaccca

SEQ ID NO: 25677 - DNA, 13284 bp, Oryza sativa
cccacgccgccacctacaccaacaccgccaccctcgccacctcctacaccgacaccgccaccactgatggtggctgtactatgtttgtcgccgcagccctcgccccccaccatgctctgcctccatacccacgccaccgcagggtcatgccgagcgtcgacgacgacgccggccacccacacggcggccatgagcaagagcaccagcaccggccgccggttggccatgatcagaatccccgatgagcttagctacagctagcctatccactatcttcgtgctcgactattgctgcgtgtgtgttgtgtgcagcggaagcgggagaaaggagaggtatttaagctgcagaatccacgggtggagatggctgcttcttctgcttttggttgatctggtggtgggtgactggggagcaggggaaggttgactagtgtgtgtgtttgtttgttacggattaattgcgcagccttttgacaattttaaggtggattccccatgcatctaggtgagcttggcttagctgggcgtgtgcttttgcttggtttgattggtttttggttggatagctctcgcttcttttgtcatgtgaactctctcactcgtgcatgcaatggcaatggcaatggcatgcgtgtgtatgcggccgtgcatattgatggcgagctcgtggtgttgggattgggaagaagaaagcaggcgatcgatgtgggtgagcgcctgagcggtgggaggagcagagcaacagcttattacagctcggaatgcgtttggatgctatgcttgatgcagcagaacaagtccattcctctgccctttgtgttgcatttcagtctgaattgtacattgaatggaaggtttgaaactgagatgctcgttaatttcttcgtcccagcatgcttcatcagtactcgatttcaggagaaatcccatcgtgcatgtatgatgtatgatgtatccattaacacattgtaaacccctgcctaaaatagcttctgaagggtgttgttttaataaaccttataatctattgttccctcggtttcaaattatttatcctaacccatgtttatgtttgaccattaattttaaaaaatccatatagtttaacagcatatgattattatgaaagcatttctcataatgttagattatataattataattaatgataaaatatacatgtttgacttagtacgaagcagacaataaataatgtgaaataggggagtagatcattctgagcttcagtcaaacaggccagattactatagctctgattgagtatacgacatactgtatatatacagaactagagccatcaattaaaaacccctgattacccataataaaagataacaccggacacgcaaaagatggcacttacatggatataaacattgataattagtgatggttagtgctgaccgctcaacgctcacctccgtttcctgaagtgagccttcagctcatggaagacgcagaacagcgtgtccatggtgtcctcgtccaggtgcgcgtccttcacgccgccgatcgccacgatcgtcctcacccactcctcatggagggtcgagaactccgcacgctcctcgctcgacctgaagttcccggcgatcttcgacctcatcatctcgccggcggccgacgccctctccacgatcgacctcgggagccctgccatggtggcgacctgcaggccgtagctctccgggcaggcgcccgaggtgagccggtagaggaaggtgagctccttctcgccgccgtcgccgccgtttcttggcttcagcatgcaggccatgtgctgaagggtgacgtgggggtgagaggcgaactccttggtgagaggatggtagtgagttgcgaagagcagacggcatcggaccgcttcgacaaggtgtcggaatacctggacgatgataaatgtgaaatcaacgaatcaaggggaaaaaagtagttagtgttatccatctataagagcagaccaactccacatatctcgttagtaccttaatcgataggtgtaataaggtcataaatcccattagctaaagcaatagagaagcagagcataaattcatagctttcacgagagatcattatctagcctacccatactgtagcctattgagcaacaaaatcacataacatgtctagagcaaaaaaaaaaaaaaaaaagcaattggtgtcacaaagaccatgcatgtgaaaaccagtattgatttgcgcattagcccagattagttcataccatgcgctgcaggaactttaggccatagtaataacatctacttccatggaagtgcatggtgctcaaacagtgtaagcagaagaattttgggcggtagaggtaagatgggcagttggtcagatatactcactgcatatgcaattgcatatccatcaaatgtgctagttcctctgccaagctcatcaagcaagacgagagaatcctcggttgcattctcaagaatagatgcagtctcagtgcattcgacaagaaaggtacctgcggcaacaattcaagttagaccactgtcacctcatatctgcattgtgctcaaatataagagacaaagtacataacacaatgtaaaggaattgagaaatttgactctgcagactcatggttcatcaaacagctcaaataaattggaaaagtgctttctactgaaaatctatagatttacacagcatatttcatatgccaaaaaaactggcatgtacttgatgccaagtatttcttgattgtacaaacaacatttcaataaatttgatgtgaatatcaattctattataagatagtatttggttcggacgtcaatgtatgtacatgtattatttagtcatgaaaattatgactaatgtcagacgattcagatcgagtgaaagttaactcatttaaaatgcatgctctttcaactaaattttggactcaaagcaataggtcaataggacatgcaagaattatcaaatctgttcggtaatgcatccttactttctccagacataatccgatccattgcaccaatccgtgtaaatatggcatctgcaagtgtcaactcgcatgactgacagggaacataacagccgagctgcagatcagaagcaacttcaattatacactcgaatagggaagcctataagtagccaagtataggagcataatttaatgatgttatacaaacctgggcaagcacaatagctaggcaggtggcacgcattattgtagatttcccgcccatatttggaccagtcaacaacaatgcaaagcgattttggccagataaattctgaccaagagatagatcatttggtaccaacccatttacactttctgcaaaagcataaggatgccataaacccttcatctgaagtacaggcgcttttcctttcagcagaatgttcggtctgcacgttgtgccaaatgacgacaatgccatggctgcaaaggacctaagcacatcgatagtgctcagagcattgatcactagagaccattcagaagcttttccaactaaaagatccactagcatagccaaagtgtttgcatcatcgtctttgacactatgatcctaccaaagctcacatgatcaaacaataagagaaatcaggagttcaggactaaaggtgataagctgataagaataaataacagaaaaaaagctaccactgcttcgttgatagataatgcacattgcaccatatttatacctggtatcttggaaaatcatcatctattgcctcttcaaaatgatgaattaattcaccaagggagctcaatgttggaatatccacagcctttgacaatgctgagatgccatgatcttgtctttgtaggatgtctagtaagtcaattccaacacggaggcccttgacaagcatgccaaacgtttttatctggaaatattgcaaaattttgcatttcagcagtcagcaggataggtagaacacaaaagaataaggcagacatcatactttgtaaaaaaaaaaaagaatggcacaaatcaaactcaatctgtaagataagagtgaaaagctaccaactaacccttctttttaatatcttttctccaacaaagggcaacagaaccgcagatgataaaccaacagtggattttactcgtcctagtaacctctcgagatcagggactttacgtagatgctctagtgtaacagatcctagcccacaattttgaatgaagccctcaacaatgtcgagcctttcattgatagcatcaatatcttttagtgggtggcaaatccatcttcttagaagccgcttaccgcatggagttatgcagtgattgaggtgcttatataaggtacctgccataaagtgaagagtacagaaagattatttttgctatatatgatttgacaaaattaagtggaatggaacataggtcaaagccacatcccttacctgatgaaccaccatcaaagttgttgctgaaaatctcaaggttcacaagagtctgaccatccattcttagacatgttctgtatacatggtaggctaagacctccccgtttttcagagcatcctctagctgttttcagattgtagctataagaatttggaacagaattcatgctttgtgacagataatctattgataaccataaaagttatagtatggctcatgggagttttttttttttacatgaacattgatttgaaacagaagtcctctgcacatatatagttatagttgacacatttaaactattgcaaacttgtgctggaagactacataaacaaaaggaaaatactgatgagaaatgacactattctaaactgacattgtgtaagcgaaatggcagttagtaaaaagaaatgacacaactgactggcatgacatgaagattagcaagaaaatataatcaaggaaaggattgaagataagtataccataagtctagttaaatggctcacaagtccaccgagtgcacaaataactgcatctttattcactgaagaattcaatgcagataaccatgaacttgttgacgctttaaagtatcctctagaatctattaacgtttgaatttctgaaacgtcagagaaatataacccatatagtggggtcagctgcattttcacagaacctgcaatttaaagaaaagtagttttcagttaatttcaaactcctctagttcacctgcagatttaccttttttaggtaataaggcaggagagtccctacattatatattaacggataggccagatacatgtttgaaaaaaaaagaagaatgaaagattatgaacttacctgctgaagcatatttcttaattaatctatgagtttcttttgaaaggcctgaaaaaatgggaacatgtaagtgaagattgaagattccttatatatgaaagttgaagattaagtatgttctgacctgaggtttcatagattatttctttcggagagacctgaaaaggtatattagtgatcattgcttctaatctgttgaactaatggaaagagatcacaaagcctacctgcaccagcagagcccccaaagctgcaaatgtatcatcatcatggactgaacccacccaaattttaagtgcagcataatctaaaaatgcaaatccatagacccgggaaccatttgaagctagtgtaatctgaaagttcaaaaaaagggcattagatcaagagcgccgataaagaatgctaacacagaccaattccattttattcagaatgagaccaaataagatcaataaaaaaactgaaacagaagaacacaaggcgccatcacaacttgaccattagaccactatcaacctattatatataaatttctgacgtaaaagtactgttataccattagaccacatgaaaaaaaaaatcatgctaacaatctaaataaactgcaagaataaaactaaatcttggtataacactaggattttattgaatgtttcggggaaagatggtatcaaaacgccattttaatgtagctacaagttgttccagtaaatatcttgtacacctgctgatttcacatgtccatgtggtacagtactacagcagtcaaccaggttgtagattcaatataattctcttcagcaaatttatttggttataatgtcataacaccatgcttttgctgactttgggaacatgataatgttatgcaatgattaggtttgggatttttattttaacctttttaaacaaaaaaaaataaccataaacccttcagggtcttattttcttaattgttaaccatttttggaagcaaactttgctatgcccgagtgataaagccatggagcaaaaacctgctttctgcaccattgtggtagcgtgacaagataattctgccaccacccacaatggcatggcgaggagaagcctgtcatggttagtggcgtggcaaccatgctaaaaattaaaagtactaatggttggtggtactgttgtgtacttctcatatgacttgaatatactttgaaagcattacagcaaatcatatagcctaaatccaacacaatgctttgttaatatggaagcatacctctttgagtgaaagaaggtgaacagcatcagccccaatgttgctgtcccctactgttgatggtgtggatacatgaaccaattttcttagaataacctagcaaaagaaaaacaatgttgtatggcatcagtctctcactcttaacttcaaaaggaaagtttaccttactctttaaacaagagtaaagggtattagagtgtgaaagcctcaatccttaagttgcataaaacattgcaactaaacactccatccaaaatgatagctagattaaaaaaaaagcttatcatgaataaaaggatgaacataaaccatgcgggagaaatgttctagagtttataccgaggtacagacaattttggacatcctgagagagcaaaagaactctcccagagagagagagagagagagagagagatcggtcaaaaattttaaaagataagcattggaattgcataaatagcacacttttgccactagctatttagatgaaaaagaaatcagtacaatgtccagaaagaataaatttggggttgatgacaataaggaaagcttaccgaatttgatcctctagatttggcttggtctgcagattccatttgttcaattctgccaactttatacctgaaagaaatgctggatttatgagcaattcattcaccaaaagatacagaaaagggaagaggaaaatggatgccacaactcaagaatcatataaattacattcaaaagataaataagtacattgtaaaaactaatggttgaacaggactatttttttctggaaatcaatgatgacaaagtgctaaacaataaagtgtttatcttgcaagtacgtgcatattatcatatcattagggtgtggtggtaaagtcgtgagtgaatgactcacccatcaagattcaaatcttggtgtccaattaaattgttgtgtgcatccctagttggtacaaaggtcaatatcccttccatattaacttctattatctaaaaaaaaattaataggaatggagatgtacataaactaacaaaagacctcctataaccaacataaggaataataagcaggaacctgctgaagttcgagatatgatgtaccattttacaaagtgactcttattattaatatgctgaaaatgaccaaacataagggggatacggaatttaccctcgagctaaaagcttttcaacggcaacatctatcccactttctgaaatgccaacctttacataagataagaaaaaggttactatcatgtaccataaggtggcactgatgctagatagtttgtaagtcgggtaaaacagattaaaagaacatggaaaatgctaagatgacaaatgaaatatggaaagcacaaagtgaccagaattaaatcaaaataaataaagaaaaaaaatgaagaactgtattgctataatcctgatttatttagtatttacacagttgttttggtcatgccaggagaaaggttagagggatgttttgattaaatactatagagtactcacaagtgaataagtgtgcattacttcactcaacacaataaacgagttgtaaatgacatcatttagacttggtggcaacagtatagcagactttcagaactaaaccattcaatgataaaaacaatactctagacagtactagcattcatacctgccggcactttcccaccccactgatagtcattttccagtcaagttccttttggccaatctcagcatccacctcatagagctcatagaattttccctagcaataagggaacaatcattgccataggttatacttatacaatcccaggtgctaaaaaatgttggtatttggtcgatgtatgtaactttgggaaagatttaagacagtaatagaaattctgacgtgtcggcaatctgggaggatgaacaaataaaaggccttaaataaggcaaatcattttggtactaggacagacagtctataattctagtttctgttgcatatctatcagtatgcatcaagtaatgaagctcaaattatggccagcaaacaaaaaaataaggggaactcctatgacaaaaaaacatctcctatttatggagttaggcaataactcagtatgacaccaaggcatgagagatgcatattatccacagcagtaatttctgaacttcagttttagatcatttgcccaataggcactgatgagacatcaaaaatgaaacttacagaaacatcagccttcagtgtcaatcaaagcagtcagggtaaacattgaaacttaccactttgaaaaacaaaacaacatccatatacttgcacttaatattccaatattgcttttgagatgtagacatctttctcaatgcatcaggtggaataaaaagagttgtcttatcataaagtgggtctgccagccgccttctatttgcatctctgatattcgaaggattcagccactcaaacttgctgcgtgcactttcagccatttcatcatggaccttattctcaactggagaacactgagctggtttcaccttcttgtttggaccccagaaaggagagcatgagtcgttggtagtcacacgttgatcttcttgaacccgcttcagacgaggaattactgctcgcatcactggtgtttctggtttcaggggactcggatcaaattccgaaaatagttcagcacctgctccaatgcgtttgtcattcttaggcactgaggataactttttcagatggttctgtgatggtgttccatttgaatcaaattctgtaaataattttgttgctttaatgtatggaaggtctgaaggcccagaactaagcttctctgaggattctcgtctaggagtataattggaatcaagtgcaaacagtgtagcgccccggacatattcaccattaggagatacaaatgagaactttgatggatgctgcaaaggagtttgatctgaatcagattctgttaaaggtgtatcagctccacgagaagatctccagaagactgtttttgaagtatcctgaggagtttgtacgtcaaactcttcaaatgatgaattagctccaatgcagttattattggaagactcaaagggtaacttctttggacaatgcggtggaagattttgatataaaccaagttccggggacagtgtgcttgctctaacaaagtcatctttggaaggccataaggacttcaggggctcctgcaaaggagtcatattcgaaccttcttctgcaatcaacatggctgctttgttatctccagcattgcaagattctaagaacaatgcacttgagcactcatttgaagtagtttgatttttcacaggtaaggctctctgctccacatgtctagcctgggaagcatcctggtctctgaaacaagcacaaggaaaatgtcatgataacgcaacaagacacgactattttgaaggccctagcaagtgcctggttttgtccatagcagttagcaaacaaataactttggtacatggaaaagaacaccctgaaatgaaataaaccaagagaaacaaagacggccgatttaagtaatcagtacaacaatccaaacctgcaaggctgcaactaagattaaggatggactacttcactaaaatataattctgaaccagaaatctgatatccattgaggctaatcacaatgaagattaataaagataaaatatgtgcaaattatcaattttgtagttgatgccgttttgtgctagaccaatccaaactcgaacttgattttggtttcaaaaaatgaagctctgtggatgggtcctccttccttgcctgaagaagcaaattaatcgcaaaagtacaatcaaaaccacagatcgcattaacatactatctgaaaacccagacacaaacttgaaacaaacttagatgagacagaccgatcaaacatgactaggaccacgcattgcaggccaaaactaccatacatcgcacaccgcagcaatcaaataccattaaacctcccattatgagtcaatccacagataagccaaggggacgaaagtaggatccatggcatattcacatcaatgtcacccttattggatacagacctacagtggcagtaagtactaaataccaccaatataagtcggcgcgcgatagcaactagaataatccgaatggcgcacattggaaccaacccaatagtacatcgattgaatccttcccgtctagtattaactagtgatacgaacgcgcttgaaaccctaaacccgaccaaaagctttgccgcaacccgactgggaaggcccccaaaccaccacccccaaaaccctagccgcctcccgccattcacagtacgacggctgcgttacatagaagcagccagcgatcggcgcgccgtacctcccctgctgctgctgccgcggcggccgcacgagcctctccatgatccccgcgaccgacgcggcgggaggccgcgggggcctctcgggcgtcgcgccctcctcccccgccgccgccgccggcttcttctggaggaaggagaggatcgactgctgctgctgctgccgccgccgcggctgcatcgtcgccggcgagggtcgggcggggggaaggcggagggtgcgagtttgagaatgggagagagaggggaatggagtggaggcgacgaggcggggggaggaaatgggatttttcgggggggaatttgcgagcgggaaatgcttgcggagcaacgaaggcgcgcgatgacgcgggcggtaagattgtttcccgcttccgcttttgggacacgggtttcgatagaggaagaagaagaagaggcggatgcctggacaaacatacaagggatcaaccataccgaattttgacttattttggtactgttggttttaccaaattttggtagagttttaaggaaggaagttttttagaaatgctaaaatttagtaagtagtactccatccgtttcacaatgtaagactttctagtattttccatatacatacagatgttaatgaatctaaacacatatcattaacatacatacatacatacatacatatatatataggcaatgctagaaagtcttacattgtgaaacggaggaagtagtaatagttgaagtgtgtgttgtttgttgcgtaaggttgtaagcagcaacaaactgagaagatccttaaacttaacttttaatgcaaaatttgatcatatatatactcctttagaattatgaaactttaacttttaatgcaaaatttgatcatatatatactcctgtagaattgtgaaactgaggattaagggtttgactagcaaaccatataaaaaattaacgatgcaaaaaaataatttagggtataacttctgctactattttgatgattttaaggtcaatgttaaaaaaatgaaacgaaaaacacctagaataattttaaattaagtttcaaaacttaaattttggtagccgctgtacttagcgtgatcttgttgaccccaatttctgtgtgacccaaatgtcggtgacacaagatgaataattcctctcaatgtttacctgaagtagtactagtaatatgatcaaatcccagctgatccacttctgacaccatcaaaaacagcagaaattcaactccctccaacgcccaaagtacaggcacaaaatatttcacagcaagcagcgacatcgtgataaacagaagttctcataaactagacctaagtggtgacgcgcgcagttgacgcatatgtacaatcaccacagcaactgggtggtaagtagtggctggtgctgcctgctttcccctacctgatacaattggaagctggtgagaggactgaactactgaattcacaagcttccaacaaacaaaatgcaaaagggggcataagtttatctaaggtgagccggactcctcctcagagtctgcaactatcatttcacgatcatcttccgagcctgatagagaaaactgctttgagatagatgttggcctctgcctcattgttttctttgtcatggatcgaggagtaagctgtcctgggcgcatgacgtcttcgtcgtttttcatatttctccgactccggcggagcccttgcggaggcttgtcaaaccgacgggaggcaagacgagtcctcttacgtgggacaaatacttcctcctcttcagtatcacccttgttgggatcataagcatcattttctccatcactgccaacatcattttctccatcgctgcctgacgagtcatcatccttaccattgtagtctctgtcttcatcctcatcagaactcaggtcatcaagggactcgacatcctcctgtccgccatctttgtcctgctccggattgacgtcagaccctccagcatcctcctgtccatcttccttctgctctggaccaatgtcagaccctccattggctcctttattgccctgatgtgaggcacgcttctcttttttgcctgcctcctgtggatcagattcttttgatttcctgcattcaagcacgtgaattcttttcaagaagaatgattttgcatttggattacttgagcaacaattcctaaaagctcagtgctaaataagcatggagaatgtgatccatacttcaagtttgctgtttctaaattctagtaaatctgacatgtcaattcctggaaccaacaagtctcaaacctgttaccagttatccccccccccccctctccttctaatttgcttatactatcagatgctgctaatgttagtaatgagggactatgctgtaccacaagaaatcgaaggtatttaattgcttag

SEQ ID NO: 25678 - DNA, 11248 bp, Oryza sativa
  unsure (1)..(11248): unsure at all n locations
gcttacagtatatggattggaaacggtaaatgggtaaagtatctacacttctactaaatgagggactggcagaagaaatgagagatgcaacatgaaattcaatgtacccagcaagctgttggttatgcatccagactactattcgtaaaatatgatgaacagtctcaagttgtcatgcaccttgtgtactcaaggatgctaaacagaaagccccttacagtaattgtagctgacaggcctacgttcacgcaatgaacgggtttggaaacttgtagcataagctaaaagttcatccttcttctgctgacgttttaaatcccgctccttcttctgcaaattaaacagacaaaaatgtggtcataaatcataaaagtagagtatgagcttcatatcttgctgccaagcataaatcctgattccaaagtagaatataaatgcattcatgtattggacacccctggggaaatatagacgcaacagagtagaaagcacgtgagctgaaagctaccttttgaagcttctccacatctggaataatttctgtcttaagatgctcgccgatggcagattccggtcgacctttactgcatagtttctcctgttgataccatatgtcaaatatgggaacaaaacacaagctgcacaagaaaatgaacagccaatacacttaccgatatctcaacgaactcatcaaggttagtcgcaactgtttcccactgaatattgataactggctttgtcaaacgaccattctttcccttcaagttgcgcttgaaatcaagtgttacatactcactatacaatctatggccaatagttgagtcaccatcatacctaacaagcagaaatatttcaatggacagtgtcagcaggaaaaaaagaggacgcaaaggcatgctaacagtgactcattgattgcaaatgataacatgaaagtgaacagaaactctcttaccagtatatagttccgttactactacttcctaacttttcttttcggaaattggaaatatcaactcctcttttcatctcgtcattaacataccataccgcgtcattttgctgcaggatagataatgtctatcagaataatgtgcatttaaaagctgaaggacttgggggtatttgactaattagattattaaacctgaaaggaaactgcaattacaacaaggtgaactcatagaatcgttacctctgaacgaacttcacagagtgctttaagtatcaacaagcgtttaatcggatcttgctgtttatacgtgtcaatttccttcctgggtaaacaaataagtcgcgatatgaagttacctaagagtcatagtcaaaaagcttatttacaatgcattatcctgcataccctggattaattttgaacgggtttgcaccttcagcaacctgaaaccaaaatgatgttaatgtctgggactgctctagttatatttacactagtaaaaattttatgcaaactaaaacatacccatgtccaccaatctgataatttcttggcagttgccgttatccatccatcatcgaccttcagatttttgatagttggtggtattccctgatacacgtgactattacaacttagcaaacatcatttcagacaaacatggcaaaacagtaacataaacaggcttattcgtcattacatcaacaacaaaaaaaaatgaaacttagagaaaagaaaaggtatcataatatttggtctccctaatacagggtagtaatgcagtataagaataactgatgcaaacatcttgttactagtacacaatagctcaataaggaaagatgcctcccacagcaacgcagatgatgcaagcttgttttatttgtatgtcacgtgatttagaaatctcaaacaggcatgtccataacagttaatgaagttaatcagtcactatgtcactgttttttaacaagattaaaaaatgattgattgaacttattcagtactttcaaaagaaaaaaaaagagaattacatatagataaagttttttaaaagataactatggagaaacaggttatggtttttgacaagcctagctgattacataacctgcaacttactcggtgattgcaaacaaaaaggacaaggacaaagaaatgaagttttttccctttttgcagaaaacctgtcatggtttgtgacaaggttaaagattacatagaccaacgcaagtgtgtattcagttcaaaccctccctgcagatacacaatgcctctagtgcaaagcaagcacgaacaaacctacaggcagagtatctgctgccttaaacaaatcagatcaccaaactgtctacaatgcaggcattctgcaatccaaagcctacacgatccaaccataactacagaagtcaggagtgcataggtgcagcctgaaaaaacaaactacacctttataagcgcaatatggatgcgggcaaggtcgtggttattggcgatgagcgcggtctcgatctcctccgctgatagccccaggttcccctcgatcaccggctcaaacacctgaaaaccaaaaaaaatccccaaaccgaaaccccgtaagcccaacacgccaataccaatccaacccaacccttgaagcaggagagggacaaaaaaaaaagaaaaagaaaaaaaaaggaagccctagccgaaacggctcacccggagaaagtggagcaccgacgcgagctcccagctgcggcggaggaggacgcaggggtcctccggcgccggcggcgacgcgggggggtccaccggggacgaggccgggggcctcgcgcgcttcgccggcgaggccatcgtgcggggactggaggagacaggcgggaaagtgggggaaattttggtggtgggaggcgggagggaggggaggaaagtggagaggcgggggaggaggaggagacggcgctgcggctcgtggggcggtggcggtttatggatggtgcgggactgggagagtgtgggtgtgggcctgtggggtggtcgagtgggcttggctaccatttgggctttctgtgatgggccaaaatctgaaatgctgtattcgcatgtgtccggcccaaatctgatgttaggtaagggttatacattcatccaaaataaattaatctagaactgaatgtggtatatttattacgaatctgaaaatatgcatgtctagataatctatcatatgccaccgagtttaccttatttcaactgtttgctatcgactttatctccttttgtaaatatataccactgaccttgttgttttctacaataattttcaagaattgcctaaaatgctctttgagacatactacaggtgttgacaattgttcgatccactataatttaaaacaaatataaaaaattgtatttagccttagaagcttgtgtgtgagattttctttcatgctttttgaaaaaaaatgtgtagcatatgaaagagaaatcacatacatagaatatagccgcattagaaaaaaaattatagcatgtcaatgatgatgtacagcagtacagaaaagaacattaacacgagagtactatattaacaaacataaattacattttgtttaagttcatacatgtaaaatgaaaatcttgaaatatacacacacttctatattatgtagaaggctacataaaaaaattcatattttattgaaacttctagtaaatcaattaattgtaacatatattttcttgaaacttctagtagatcaattaattgtaacctcttataagccttgaaggtattattttgaaaagtattcaccccaataacatattatagaaaaaatgacaaagccagtgccatttataaagagagacaaagtcgatggcaaattgttaaaacggagtaaactcggtgtcatatagtggattctctcaaaatgttaactatcgctccctgtaccaataaaacttacaaaaacttagccaacagtatcgctgtaaaacaatcacaggacaacgttgtggagaaattagattgtatgaagattataatcataccaagtaaaatctctgatcaaagagcaggtagtacttagtaagccatgtcttgatatatatatatttaagtgtaactacacatccactcaaacaatgtgtatgaagcgagataggtacacgaggaaggaccgccagggtgaggtgtggcatggtgctccgggcacagccaacaccgggctaagccaacacgaggcttcgcgactcccgagccgaagaacggagagaaataatttcctctacaagcatcgtccgaccttgtggtaccacgcgcttgattgccaactcagttcggctccgatgtggaggctttagaccactggatagagtggaacattaggcttggccttattgatgttactacttatccatcaagaggatgtacggtttggaaccttatagcttgttggtctataatgttgttattggatttaactttttttaatgggataggacataaacaggaatggcgaaaagctgatagccatatatgaatgggttacagatgggatagtagagggatgagtaccatgaggaaagtgaaagacatgttaagtgttaacgatagatttgcacagaagaaagatagcttatgtcacgtctcaaatctaactttccagttgcattttattttcttttctgccacttcatgttatatgatgctatgaccaggacccatggtttctgtcgattataattaaaaaatgctattgtttaactaaggaggtgtttgacggtgctatattatccgtagcagctgcagttgccaccggaaaatcctcttttgctttttagcgtataaaattttgatttatacgtattactccctccatttcaggatataagatgttttgataaagtcaaactactacaagtttgactaagtttatagagaaaatagtacttcctccatctacatttgatagtcgtatttcatcttagcacacagaccaaggataagtaattttacttatcatccatttaaacatgctactagtcattcctcgtaaacaagcgattcattaatatttacatttctcaatgcccatgtagccaatcatgtgtgaaagaatggagagtcatgcgagaaagtcattaagatgatagtttgttgaattgaaatatgactatcaaaaataaatttttcagatttagaaatataactatcaaaagtagatggagggagtaatattttcgacccgagataaatttataaatattattttttttataaacttggttaaacttgaagcagcttaactttgaccaaaatcaaaacaacttataacctaaaacgaaggtagtatatacttatatttatatgtataaactttgtaactaaatatatacacatatgcttatatacacatctatacaaaattatacattatacatataaactttgtattcgtacatataaaattacacattctttagacatataaaaagtttatacatatacgcacaaactttatgcatatacaatttgtacgtatacgtatggaacgcgatgcgctgatcgtggattagcattttcgactaggtagctacatatagcattatcaaataccctcacaataataaatatctaattgtccttctaaagcaagtatttcctacgtatgttgaaaaaaaaacttatctttatatcttgggctactatgaaaaccgaactatctttcattagatacgcaaatatatattcatttgattatatgcattattatgaataagtgcgcgtagcgtataagcacatgcagttatactgtgttttaaaaatacacaatcatatttatagtcaggtaaacgtaaacgtaccatgtattcatttatgtaccgggcctgttcatctgcactatagcaggctacgacgcagtcacctcacacggtattttgtgtagcataattatgtgttggattgggatcaggtgcagtcccaactacaactgcacacgttagggactacacaggatcatgtccatttaaattttcaatggaaggttcagattaaatgctacagtagcattggtataataatttttgttggattatctaaatgaacagcgctctattaaatttgggcctttgaatttgcatcctgcggccatagtataactgtctaagttgcagtcatagtaataactgcataagaattaagggtctgttcactttgatgccaaaattttgacaggatttcttatatagttaccaaaatttgacagcaaactaaatgtagccacttttttttgtaactttaccaaaatttggtaaggttgtaaatgatatcaaagtgaaccggctccaaatccgtatgtgttgtagccgctttaacatgttgccgaacacggctgctgcaactttatagagatattatccttactaaataaaatacaccatcgatgtccgaagaagaaaggaaaaatcatattgaacgatcaaaccattgtcgccgtatgttggtacacggtattaaacgtgccaaaaccatcttccccctccccacagacgtcaaacgtggcgaaccacttgacaccaacgtgtgcacgtctgacttcttgcactccctatacgtcttgacccccccaccccccaaacgcccaacggatccttctggaacccactcgcgccgtcaaaccaccaccgcctccgtctccttctccgttcccgtctccgtctcccccagagagctctcgtcgcgcgcgcgcacttttctcctctccgactgcggggcccaccagtcagaagagaactctcctggcgcctctctctcccccaaccccaccggatacctgatccgggccgtccgttcgatcgatccgacggcggagacgttgtcctgggctcccacggcaggaattggatggttctagaactcacccgagtcccgaccaccccacccccaccaccacagccgcctctcatatatcaagcggccgcccacgcgcccctcgcatctttcgcgaaggcgattcaggcgagaagagagagagagagcgcgaggccggcggttctagaagcttccagacccttcggcgcgagcgagctcacctcccccgtaggtacggcccacccttctcttcccaggtcgcgccgcgagttggatccgcgccaccgcccgcccgtggatctgatcgtgtttcggcgatttgttcgttgcgtttttgattttattttatttttttctggggtctcagcctggggggatggtttgcgctgctcgggtttcagccgcggagggatgatgtttttcgttgttattttttttttcgcggtagctgcgcgggattttgactcgctagggttttagatcggtcgtggtgcttagagtaatctcaaatccttgaattgttacaaatttttatttttgcagctctgcagatcgagatttatgtgattttagtgttgatgtttaggtggttataggtttggatcctgctgtgagtaactcgtagatcctgatcctgattgattgtatttatgtgcgcaggagctgttcattagatctgaataagggggattgaagcagtgaggagaagatgagcgtggtgggctttgatctagggaatgagagctgcattgtggccgtcgcgcggcagcgcggcattgatgtggtcctcaacgaggagtcgaagcgggagactccggctattgtctgcttcggcgacaagcagcggttcatcgggacagcgggcgctgcttcctccacgatgaacccgaagaattctgtttctcagatcaagcggctcctcgggcgcaagtactctgatcctgagctccagcgtgatattgcggccttccccttccgtgtctcggaagggcctgatggatttcctcttgttcatgcccgttaccttggtgaagagcgggttttcactccgacgcagctcatggctatggtgctttctaatctgaagggtattgcagagagcaacctgaatactgctgttgttgactgctgcataggcattccggtgtacttcacagaccttcagcgcagagctgtgcttgatgctgccaccattgccggcctctgcccattgcggttgtttcatgagaccaccgcaacagcattggcatatggtatttacaagactgatcttccagagaatgatcaattaaatgttgcctttgtggatgttggacatgccagcatgcaagtctgcattgctggttacaagaagggacaactcaagatcttgtcgcatgcatatgaccggtcccttggtgggagggacttcgatgaagtcctgtttaagcactttgcagcgaaattcaaggatgagtacaagatagatgtttaccagaatgctcgtgcctgcattaggctccgtgtggcttgtgagaagctcaagaaggtgctgagtgctaaccctgagtcaccaatgcacattgaatgcttgatggatgagaaggatgtgagaggttttatcaagagggaagagtttgagaagattagtgcatcaatactggaacgtgttaaggggccactggagaaggctttagcagaagctggtttaacgacagagaatgtccattttgttgaagttgttggttcaggttctcgtgtcccggcaataattaagatactcacagatttctttgggaaagaaccaaggaggacaatgaatgcgagtgaatgtgttgccaggggatgtgcgctggagtgtgctatccttagtcccacttttaaagtgcgagagtttcaggtatgtgcccgctttcaccctgctgccttctctgctttggctatctgcacaatacattaatagaaatcttgctgcttcatgccttaaaatctctaattaaggattgtttaagacgctcatcctcatgtgcaccgtcattaaagtttaattggatagtccaataagatttgtctccttacatgactccattaagatcatgcaaccatcaccaatagttattcatagtgtcgtaattttcatgacaattttatccggtactccaatgaaactgtttccttaatatcatgcaacctctagttataaccaataggtttatgcagaatgttcgtcataattttcataacaacttagcgtgatacttaacatgactcaaatatcatgcaacctctattcatgagttttgtgaccaatatggcttattatgcagaatgttggtcataattttcgttgtaatttaatctcatactccaataagattgtttctaacatgacttcattaagatcgtgcgaactcgcttatgcagagtttgtcttgttggctccttgaatctgggtttacccaccaatttaattcttgcctaataacattgctggaatctataaagctttcagcatattcttactgtttaaggataacatatgcactgaaggcctgatttgaatgagtagtatttggttcaaaaatctatttcactcccttgaagtcttaaaattaaaacaaatcttagtatactactactcaaaatcattttaggataacactaacactaggatttttttctttcgtgagtttacaataaatcatcctagttcttgcttgtacaacactaaagtatgttttttccccagctataacgctaaaccctgtgcaggttaatgatggtttccctttctcaattgcaatgtcatggaaaccagactctcagaatggtgataaccaacagactgttgtattccccaagggtaacccattgcccagcgttaaagcattgaccttctataggtccaatacatttcaagtagatgtcacgtatgttgatactggtgatttgcaaatatcaccaaagatcagcacttacacggtaactgacttaatatttccttttttatgttctcgaatgtgcttcgagtccaactatcgtgtattgatcatgttcttttgttgtgtgtgtttatgttaatgtataggttggtcctttcaatcccggcaaaggtgacaaagcgaaactgaaagtgaaagtccgccttaacatccatggggtggtcacagttgaatcagcaacagtgagtgataatgcaggctgttttttttttgtagttcttttcctaaatgattttcgttgaaataaatctgagagtatttctattggtctggtgcagatgttggaggaggaggaagtggaagttccagtagcagctacaactgagcctccgaaagattctgccaagatggagacagatgatgcacctaatgaagctgcttctggaactgatgtaaacatgcaggaagccaaagcccctgcagatgctgctgccgannnnnnnnnnnnnnnnnnnnnnnattctgaggaaaaatcagtccctatggaaactgatgccaaggtaaattttcattactgacaaaatcttgaattatcatgctagcaggtgcctgaagccttttaatttgaaaccttttgctttttgaagtatcatcagtacaaggtggaagttgaggaaacagtattctggacatgttttttattcagagctaacatatcttgcctttgtagtttatatttatagataaccttttgaagcttacatgcgcaagctgatctgattagtccactgcactgttatgccttcgatttgacactttccttgcattgattttatcacgactttttccatgccaaccacaatgtgccagtgtgcaacaaattcgttgcaattgctgtttttgtggtagttatctatcattctattgctgaaactatacttgatacaaatatgatcattctttactggatccttcctactgtggttcaaaatttggttttatcttttcctcaattcctcagtctgtttcagtttgccctaaagggacaagtgaattgatgaaatgcgatgaaggaaaaagtaaactgtatcagatgaactaacagttggcacattttgatgaaaaaactgcaggttgagccatcaaagaagaaagtaaagaaaactaatgttccagttgctgagttggtttatggtgccttggggactacagagttgcagaaggctgtggaaaaagagtatgaaatggctcttcaggacagggtgatggaagagacaaaagataagaagaatgccgtggagtcttatgtttatgacatgcgaaacaaggtttgatcgattccactctttcctgacttcatctttagttagaggcagaaactgataatatgttatttttcagctgtatgacaagtacaatgattttgtgactgctgaagacaaggaagcattcattgctaagcttcaagaggttgaggattggttgtacgaagatggtgaggatgag

SEQ ID NO: 25679 - DNA, 768 bp, Oryza sativa
gcgtcgaggagcccgacgtcgccgctggaccccaaggcgctcctgctccggtcgccgcggtcgccgaggacgtggtgggacgccgagccggtcggcctcgccctcgccgccgccgccgacgacgacgccgccaagaactgcctcctcctcagcccgcgcgtcgggccgctgaagtcgttcgcctcgctgcccaaggactgcggcggcgggcactcgccgcgcccgggggagctcgccaaggcgatgtcctgcgccgcggcggccaccgccaccgcctccgccgccggcggtatgtccgtgccgtgcggcgtgttcttctacggggatctgaagtctggtccggaggccactcgatccggtggcgctcaccccaatgccaagcgccgctccttcgatctcggcggcggcaagatccctgggccgggctctctgccggcgtcgatcggcggcgtccggcggttcatcggctcggtctcggcgagcgagatcgagcagtcggaggactacacctgcatcatcgctcgcggccctaatcccaagacgacccacatatttggggactgcatcttggagccccagacgatggacgcctccgcctccgccgccgccatggatgtgacggaagcacccaccgagtcctactgggtggtgaagtgcgacgccggcgccgccccggcctccggcggcggcgacttcttgagctcctgcttcacttgcaagaagaagctggagggaaatgacatttacatttaccggtatgtagttgca

SEQ ID NO: 25680 - DNA, 928 bp, Oryza sativa
ctacccgtcttgacggtgccttcaggcagggatggggtggggagagccgagcagccggtgctgtccctactactggcacaatcaaatcgtcggcgtccaatggggagggtgaaactgcgaccgcctccaccaacctcgatgatgggagcagggttttaaatttcaaaatcagcagttctgccgcagctgagcgatagaaccaaaatttcggaaaaaattttgtatgattttttttgaatttttgacggattttgaataaatttgaataaaaattgaccaaattcacaaaaaattgcaaaaaaccaaaattttcgggcgagatgttagcatttcggtgggggtggggggggcgaaatttccgaagaacagaaatttcaaacactggatgggagagatcgcggcggcatgggcgatgacacgcatcctggcgaggacagggccggcaaaggcgagggcgcacagattgcagcagtcggcggagacaggggcgcacataccgcagcggctaccactggcctcgacaaggagagggctagtggcatcggctacggaggagagcgaggcggcggcggcggcaagaccacgtcaagcgccaccaccgacctcggtgatgggagagatcgtggcggcggcggcgacgtgcaaggcgcacagatagaccaaggcgaggagaggcccggccacgccagcggcggcagcaacatgcacggcgcatagaccgcagcggccaccaccaccggcctagacgaggctggaggcgttggagagcacaacggtagtggtgatgcgcggggtagcacaggaggtggcccactgcggagcttggccggcggcgaagtctcgggtggcaacaaggggcctaatgacggccgaggtggcaaagacaacggcggtgcgccgctggtggcgtcactatcttgccggtgga

SEQ ID NO: 25681 - DNA, 540 bp, Oryza sativa
gttgatctcttcagtaacctaaatttcaagtccatactcttttagcagagactatggagccctatactttggggagtttcctctgctggagaaggatagtagtgaatgaagatgaattttagatgaaaaagtagcctgtttaatgaatcagttgctagcacacaaaaagatatttcataactaatagattgagcagcggttcgtatactgcctgaaagggaatatttattatttgcgttatatcctgccataagaagaccaatagaaacaatacttgaaatggcaattcattacagagcaccaatgctaagacctttcgactcctaactaaagaggtagccactgaagtatcacaagaacaaatatctaaatagaaagaaattgatgcttaagttgccgatttgaagtaacagcccaaatatttctcaatctaggtattgactcaagattattataatcctcatatgcagtagtacttttaattcttattgatatagttcataacctgccctatgactcgattcaacaaacctaggatat

SEQ ID NO: 25682 - DNA, 479 bp, Oryza sativa
ggtgggagtcaaggtgggcaaggaggcgccggacctcgccggcggcggcggcggaatcgccggtggcggaccatggcggtgagagcaagcaggttgggtttggattggaatcggggcggctcagatgtgggtggagatgaaggtgggctttctattgggttttaattggaccataatggacttgtgcaatatttaatgggctttctgttggatttttatttgggaccttggtggtgagacggaccaaagcaggtttgggtttggactgaatcggggcggctcagatgtgggtggagacgaaggtcttgtaataagttcactttgggtccctctatttgtcgaccattgaccacaaaaccgggtatgacccgtcccccaacttacgaaaaccagacaaacgaggtccataggcggttttgatagtggttttggctgacatggtgcctacgtggcttgtttgactaggtctccatcacatg

SEQ ID NO: 25683 - DNA, 1276 bp, Oryza sativa
  unsure (1)..(1276): unsure at all n locations
ttcctgtacatatctatctcccatgtgaatattcatggttggtggagaggaggcaagtatggaaagatgggtggatttgttttggggttttgaggtagtagcaaaattacccacaaaaaaattaggtgaaaaaaaaaagaggagtagaaatggaggtgattcagtgtctcctgtgtgcatagggtgtgtggaggtgaaggaagcacggaaggaagaagatcatggcggaagaagatggccggatttcggccgccgtcgcggcggcggccttgcctatttcagtgatttctggggtttatcctctgttcatcgtttgttgcatcatcgactagctgatgaagatcgtcgatcgatttcaatcaagccccccctcttgttgatttcgtattttgttgatgtaatctttgttttgttaagaaccccaacagcatatttgtaccttagctttaaatctgagaatcttttgctgactcatctacctatatgtggtgatgaagcccccctcaatgtattgtaatcacctgcttcaagtaaatgatccaataatattatgttgctatatgtttcattacttccttgatccaataacactcatcttaatatcttgttcattagtgacgaaatcgatgtgttttgtggagctgagcggngggcgatggtgccggggaacctgccgtgacagagaccggcggagagtgcgacggcggcggagtcgccggcgagtcgttgtcatctttggtggaatcgatggtgcaggattggcctgcacatgctgcagcctctgcttcttccaccgcaccgctgcttggccacaaaaagacacgtcctctntattcgagtatgtacatgtactactacccggtagcgtagcgtcggctttgccttttgcaggcagtgcgactgttcatcgtccgtacacgtcgccggagttggggaagacgacgatgacgccggctgcggcggcacccgaatctgacccggatcgatcggatcgcggcgactccgtctcgagacgaatgggttggtgggttgggtcgcgaacgcatcggtcggagtcagggtcggggtgggggagaaaatatcggctgcttgtgtgtccggttcccacgagacagcaggcgtggtggtggtggcttcttgttgctccgtttcgtctcgcacactttcactttactttctttttttgatgggcatgtctagtccttttcgacccttcctgtgtacgtcacgacctcgcacagtcagacaatctccatacacagtatcccgtagaaaa

SEQ ID NO: 25684 - DNA, 449 bp, Oryza sativa
ttgattttttaataaacgtttgaccattcgtcttattcataaaatacttatgtcatgattagagaagatttgatgataaatcaagtcacaataaaataaatgataatgacataaattttttaaataagacgaggtcaaacgtttattaaaaagtcaacggcgtcgtacattaaaatacggagtattactaacatgatcaaataatcactcgattcatgttaccgtagaaaggtacccgaaaaaaaggaaaaagggaaaccgataatgcaaaatcacaaagtgcgatatcgcgaaacaaagaacgatcaacgggacagtgatccacgtacgggaaaaccacccatctccggcgacagtgatccacgtatgggaaaaccacccatctccggtgaacatcggccaatccgcggccccgctggcccacacgcatgcgtccaaacagcccaccc

SEQ ID NO: 25685 - DNA, 837 bp, Oryza sativa
gcacgtcggcggtgcgcctctgaagaagtgcttagcatggagtgcctatcgtcgccgtcgccgtcgccgtcgccggcgtactacgccgcggtcgccgtcgccgcctccaactcgtcgccgaccgtgtcgtcgtcgtcgtcgctggtgtcggtggaggaggccggcgagaagatggccaacgggtacctctccgatggcctcatggcgagagctaggaggaagaagggtgagttcttgagagacatatggtttgtgcatgcttcactaatttgttgtggtttagcactaattacagccacctgacagtgatctaatcatcattaagactgaatttatttttgttgatgagaagttatttgacttcttttgttatgtccccttctccaatttttccaccagttgctgtctgccatacaagcccatttttatgcttccaacttgtacaggaatatatgcatgactgacataaatttcctaagaatcagatttctgtctctcaagttgcaacctgaaactctcatccttatcacaaacaaagacctgatttatcctagttgtctcgtcctaatcatttgcatctagattcttgaactccaaacactagattgtttttgcagatatcaacagataaaaaaaaatcctctaaattgctgtgttttctacacctgaaattctgaacatgtcaaactcatcagttaactgtcatcaggtgttccatggactgaagaggagcacaggaaattcctggtagggctcgagaagctcgggaaaggcgcctggcgcggcatttcccggcacttgtcacgacaagaacaccgacgcaggtggccagccatg

SEQ ID NO: 25686 - DNA, 1119 bp, Oryza sativa
  unsure (1)..(1119): unsure at all n locations
cactgtctgtattgctaacttcctcctttactgaaaggtcagtcagggagaaagagagagagagtgagcaatcaatcattgggcaaaaagaatcatcaagcttagagtagatgttggtcaagctcgagctccaattctttaatcctctgaaagctaaaaaagtccggtcatctctcaacagtgaaccctcctatatgcatacagctatgagcagcctctgacatctcaatcacatgatcatgagtggttttcacataggtatatatacttccatttgccatatataccccttccacacttggaaccttggatcatctcatctcacacacccaaaaacctaaattgcttgattgctcttgtactgcagtngtgcttcctacactgccattgcatataaattntgcactgcaagaataantcagtctgagagaccagagagaacatcatgggtggcaagcctgtgcctgctgcggcgttcgccgggtcggcgccgccgctgtcgcaggtggcaacgtcggcggcgcacggcgaggactcgccgtacttctgccgggtggaaggcctacgacgaggacccctacgcacgccgtctataaccccgacggcgtcatacagatgggcctcgccgagaaccaggtctccttcgacctcctcgagcctacctcggaccacccggaggccgccggctggagcaccggcggcgccggcgccggtagcttcagggacaacgcgctgttccaggattaccatggcctcaagagcttcaggaaggtacgtgagagagagagagagagagagagagagtttgcaattcttgctttgcttggctcgaacgccatgctggtggactgatcgagatggcggcggcttgcttggccaccattgttgcttgcaggcgatggcgagcttcatggggaagatacgcggcggcaaggcgaggtttgaccccgaccacatcgtgctcaccggcggcgccaccggcgccaacgagctcctcaccttcatcctcgccaaccccggtgacgccctgctcatccctaccccttactaccccgggtaagccactgtccattgccattgccattgccatgcatctagctagcttgggatcgatcgagc

SEQ ID NO: 25687 - DNA, 299 bp, Oryza sativa
cggttgatcggaggtcgtgttgccgccggcggtggccatgatgatgatgggggaaggagtcagcagcgtcccgccgtggtctcacctccccgtgagcggagtcgatgtactcggcggcggtggtggcggtggggatgagatgacgccgtacgtgatcgccgcgctgcgggatacctgccggcgaatgatgtcggggtgggggctgacgaggaggaggaggccgcgccgatggccgcggcggtggacgcgtacgcgtgcgacgagttccggatgtacgagttcaaggtgcggcggtgcgc

SEQ ID NO: 25688 - DNA, 1445 bp, Oryza sativa
aaatcatgtggacatgacaaatttgtactctgtttggacaacaaattggaattgtgcctgtattgtatgaataatgtcaataggaaaaaattacctttctcgcgaaatttcctcttccacttggtgcaatgatgcgaacacactcgcgagggtggccgatcttcatggcagtaggttcaaggcaaaagagcgccggcgtaatccgaacaaaagagggtaactagcgcgagcagcaagaggataactaccagatgcgaccaagtagtgagggtgagaacgatccgaagcctcatgaattccgacccgttgttgatatttcttaacgacattactagaaatataatttccagcaatggcgcagaaatacttctggtatattatggttatagagttcatccgcaagcgtacggatataccattgtagcatttcacccgagagtattccaagggtatcgtatttgtttaatcccgtggaaagattataatagagagaatcgtactaataatttatatattatttgtatcaaccaaagtctaagcaggggttaatataattcatggggtagagtgacactaagcagaagcattcatactcttactcataattatctaagctaagtggcaagaatatagaaagatcctattcctatacttctagtatacatatatattatacatacatctgtcacgaactcaccgagatttcgcggcggaacgccagcttaattggaaattggaaaagaaattgggtttcagatgaacaagaggaagaacaggttggggaatgagacaattcacatgaggagtagttgattttgattgctctttctcgataccgtttccctgacggatgggtcctcctttaaaggttacaaccactcacgcgacgtgaccaccgaacctgcacggcacgtctgcaaactcactcacactcacacggcccaaccggcccaatactcagaacaccacacaacaccagagatacataacattctccaccccttaaagattggcttgtccccaagccaatgctgcgggaaatctttctttcaattgccgtaaattctcccatgtagccaactcatcagggagtccagaccaacgaatcagcccatacggtacaacagatttgcctcgcttgatcaattgtggacgaagaactgcgacaggagtaagctctacattgtcaatgaagcaatgctgaggaatatcagaactcacctgaatgtctggtttgactgccttcttcagaagagacacatgaaccactggatgaacatgagagccagccggtaagtcaagacgataagcaactgctcccacacgctccagaattgtaaagggcccaaaagtatcgaaaactcagtttgtgacaagagcggtgagccactgacatttgcacataaggttggagcttaaggtatacttggtcccccaccgcaaaa

SEQ ID NO: 25689 - DNA, 1948 bp, Oryza sativa
tattaatttcgaaatttttagtatccgggggtggttagttttaatcgtcagctctctttctctgtttgcttggttctggggggggttttcaaatggggacgaccaggagaaatgttaacaccggtgaaggcaaccaacccgaaggcagcaaccacaaccaccaaggcaatccacctccacctccacctccgcctccaccaccaccgccagacaccaacgccattctcacccaaatcctcgcccagcaagccaacatgatgaccgctttcctccaccacctccaaaacccgccacaacagaatgctccaccaccacctccccaacactctaaactcgccgagttcctccgcatccgcccacctaccttctccagctccaacaaccccgtggatgctttggattggttgcatgccgtggggaagaagctagacacggtgcagtgcagtgatgaggagaaagtcgtcttcgccgcccatcagctgcagggacccgcatctctctggtgggaccacttccaggctacgcagccagagggacagccgattacttgggctcgcttcaccgccgctttccggagaacccatgtgcccgctggagtcgtggctcttaagaaaagggaattccgagagttgaagcaaggcaaccgctccgtgatggagtatttgcatgagttcaacaatctggcccggtacgctccgcaggatgtgcgggaagacgaggagaagcaggagaagttcttggcaggaatggaccctgagctgtccgttcgtctagtctctggggactatcctgattttcaacgactggtggacaagagcatccgcttggaagctaagcacaaggagctggaatcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagggtcagcaggggactcgtgcgccccgtcctcctacgccaactgtgcagcctggtcaaggccgcagggacgctcaaggtcagcagcgtctgtgcttcaactgcttcgagcccgggcactatgcggataaatgcccgaagccaaggcgtcagcaaggccaagcgcctccccgctccaacaacggtgggaaggatgtcattcggggtcgtgtgaatcacgtgacggccaaggacgtgctgacaactccggacgtcatcgttggtacgttcctcgttcattccatccctgctaccattttgttcgactctggagcttcccactcgtttatatctgtgccattcgtggggagaaatcagttgggggtagaaaggcttagaaaccctctgctcatcaccacccctggaggggttatgacagcaaagtactatagccctgccgtccctatagaaattcaggggattccttttccctcggatctgattctgctagacaccaagaatttggatgtgattcttgggatgaattggttggctcaattccaaggagtagtggattgcgcgagacgcactgtcactctgtaccgagggccggaacaaccggttgttttctttgtacccccaacctctgtcaagagttcagaactgcatcagataggactgtcagaaatccccatcgtcagggagttcggagatgtgtttccggaagaactacccggtatgccgcccaagcgagagattgagttccgaatagatcttgctccaggaaccactcctctgcacaagcgaccctaccgtatggcagcaaatgaactgaccgaagtaaagaaacagttggaagagttgaaagaaaaggggtatatacgttcgagtacttccccatggggtgcccctgtgatttttgtagagaagaaagaccagacgaa

SEQ ID NO: 25690 - DNA, 22423 bp, Oryza sativa
accaaaatatcctcgtcttctacattcatcccttcttccttctctctcctctcttccggccaacaaactccgatgtgctgccgcccgtcccgctggaagaacttggcgagggacctgctcgattggagcaggcagggcagcgacctccgtgctcagaggacacaacattcagggcagcggacggccacgcggtcttgagcacagaccggaaggatgctgcatcaggggacaagaggaacatgagattagttagcacttagtacgacccatttcctccatcaatgaaagaaccaaactgattaagcatgcctgaattcagattaatcaacataaatgttattcatatgacaagataagccttttctattcctaaaattcacagtatcaatcagttggcagtagcaacactagtataaaataaacttgccaaccaacgcaacattccagaaatcactaactacgcaagaaagtaaaaacacaaaatttcttcaaacattgagacccctcagatctgtcaacacaatcgcaacccccaaaaaagagaactttttcatcaccatccacaagcactagcaaaccgcataagccgcactatttactactcctcgacggcggcagcggcaagcattggagctctctctcccccgcggttgccgtaaatggaggcagggacctgctgcagcatgatgcgggtggctgctcgttggagttcattgcctgcaaaagaggagagaaggggaaggaagaagacgggggtattttcgtctaaaagaattgataattgaagtgaaggggtatttagtagcatatctcttatacttatgaaattgtaatggtatacttttaaatagcaaaatagtaatggtgttttttaaaaccgtgaaatttttaatggcatgaatccaattaaccctttttttttggcgatgccccattttacaaggcgtgatgatttttctgctgattttctctcgggagtacccttcgcacacatgcaaatgaccccttgatacctgcgtttaataactaatccattaactatttgccacttttagatttagctaattatttgtaaacccactgaattactcgctgaattcagtgggttggcactgaactgaactgggccagaagagatgagagaaatcgtttccactaaaagttgaaaagggtgtttagtacgtgttagttttttgaagaatggaaaggttgtttccctagctaattcgtttcccagtaacacgagttgcttgttaaaacttggtttttaattttctttacaacgaaacatcagctggttctatcctgtatttttcgccgaaagctagaactaagagcagtagagcatgtagtgatgtacaatggtacaacacttccatcgagattagggtgagttcgaatctccctcttctgaacttatattctctcgttttccaagttgactttcggagaaaactaccaagttggatgcacaacaggcaaaaacataaatggaagcatgaacacacgaacagatgcatgtatcccaaatttccatacacacaaaaaaaaacccaatcttataaacaaatcaggcccaaaacgcatgtttgtagtaagacaaattgaatccagaagaaaacaaagagaaatcgagttggagaagataaaatcaaatacaggctcgaggaggacatgggtctggatgcttaaggggcatgagtgttgcaacatgggtctggatgcttaaggggctcgaggaggacatgggtctggatgctaatcggatatggcaacgtcgacggcgcggcgtcgacggcctggggagaagggaagacggtggttgtggtggaagaggaggtggcgacggatctggctcctaaccatgttgtcatccctgttccgcaccgtcaaccccgtcttcgtcctctgctccaagccgcctcggccagtccgcaacaacagtagcttgacggcggcctcctcgaatccactccaccgtgccgtcggtcatcaacacgcgtcggagttctctggctcccacgctagcaacctccgctccgtcctgctccacgtcattgagcggccatcccgctcgtagtccccgagcttcacgtcggcgcgccagtcaggggaggagggacgccggtcgccggtcgcgggaggagatgaggacgctagtcgggggaggaggagagggagctgaagtcgccggctcgctgtcaagagtgagtggaggaaagtccgagaagggataagggagagagaggggggtggagggggagctttttgtttctggagtctggggcatttggtgtaaattttgaacctctacacaaaagtgaaagaagggactgaaatataaaattaaagccatacctaaagccacttgcactgtggagaactcaaattttggattcgtagccctagcatacgtggcactttgtggcctctcatataagtgagacgcaatgtgaatgccctatgcaaaccctccgactattcctctcctttttttttcttctatcctttttgttttgttcaccggatcttgaatcgtgatgcttaaaagaatgtatgtgttggaaatcaaagctattcactcactcaatctcacaagaacacaagcgcacacacacaaggactcagaacacagagagtttgcaagtgcgtagcactctttttctgtttttctctcacaatgaaactgattacattgatctctatttaaagatgcacatgacctgcttaagcctaaagaaatgcaagaatcctagataacaaactcatccacgtctaacagaattctcctagtcaatcgccgatacgtgcatgcagcgttcgaccgcttcctgctcctgacgtgtgctgatcccttcgccacatttgcatgcatggctaactaattagctagatgtactctcacctcctggcaacacgatcagccactactcactgccaatctctctactcactaagccatgcagcacaaccactaagctagcactcacgccatgtaacacacatacatgtgacttctactcagctactaccatataaataaacatgctgaaactaaaacaacaagattatacttctagtaatcacccccttaatcttgttggctttatttgacaccttccatttttttcttcaaagtagcgttggctcgttgtcggcgctcgcgactgcaagcaacgcctgcttctccttcagaccagcacacttctcctcccatgaataatgcccgtacccttggcacttgtagcagcgcacctttgccttgtcaaaggtgtccttcttcttcttgctcttcatgcgttccatccactgctcttccgtgagcagtaaacggccatatgcttcacttccattgccatcgatttcatacctttcttccacggacttgagacggccggtaagttcctcaacggacagcgtcttcagatcgatcagctgctcgatggagatggccacttgggtgtacttggatggaaccacacgaagaaacttcttgaccaccatctcttcttccatcattgcacccaaggtatggatgttgttgacgaggcccgttagccgcatggcgaagtcgtctacagactctccttccttcatgcggatcagctcgaactccttgcgtagggactgcgccttcgcctcgcgcacacgctcaacgcccatgcgcatcgtgcgcacggcctcccacgcctccttcgcggtgtccttcgacgccaatgttgccaacatttccgacggcaccgcttggaggatggccgccaatgccatcctgtcgatccggtgctcagtgttgccgagctcaacagcatcccaaacaccttgagcttgcatgtttaccttcatcaagagtgaccactcgatgtagttgctgcttgtgagcacgggatagcgcaatgtcaccccggcctcctttacttgctgcacaacaagctcacgactatcgttcctgccatcggtgccgctgccggtcggtgccattgccgctactgctactgcggcggccgggcggcgtgtacactccatcgccagacatgacagtagacactcacctcagctctgataccaattgttggaaatcaaagctattcactcactgaatctcacaagaacacaagcacacacaaacacaaggactcagaacacagagagttgtttgcaagtgcgtagcactctttttctgtttttctctcacaatgaaactgattacattgatctctatttaaagatgcacatgacctgcttaagcctaaagaaatgcaagaatcctagataacaaactcacccacgtctaacagaattctcctggtcaatcgccgctacgtgcatgcagcgttcgaccgcttcctgctcctggacgtgtgctgatcccttcgccacatttgcatgcatggctaactaattagctagataacacatacatgtgacttctactcagctactaccatacaaataaacatgttgaaactaaaacaacaagattatacttctaatagtatggctgcaacttctaggttatatggaaatctctatcgttcttttttcttcttattttttttactcgtcattttgttggaaacagaattgtttttctttgacttagatagtaatatgttaattttattataaaccaaagtagtattcttttgtgtgcgcgatattgttaaatggataacttaaccactcaaataacgaggaggtagctcaactcactaactatgaccaagcaaataaaatctcttttcattcatatccggccaactaaacatcttaaatcagtcaatctgaatgtagtccagcaaccaaacaacccaacatggattaggcaaatgagccaggctacctgttatgttgctcggtggataggaacgaagtggtcaatgggttggaactgagagagacgataatagacagagatagagattgttgctatacaagccgatgattagaggtatgaattttttgagtatttgaaaaatcattctcaatcggcatcaaggatattgaaatataaggctcttaaatatgttgtatttgatgatgatctttattatccgacgattgatggagttttacttaaagtggttatgtgtgaagtgcacgaaggaatttgtggaactcatcaatcgctcacagaatgaagtggttgattaggagagttgggtatttttagtcgaccatgctgaaggattgtttcatatattataagggatgtcaagattgccaaaggttttgagcaatttagagagcacctgcgtcagctatgaacccaataattaagccatggccgttcagaggatggggaatcgatatgaccggccagataaatccaccaccaaggaaaggtcacaatttattttggtggctacatattattttaccaagtggattaaagcaattccactgaagaaggttgattctaaggatgccattgaatatgtcaaggaacatatcatatatagatttggaataccccaaacaataaccacatatcaaggatatatctttgtgtccgatgagtttattcaatttgctaaaagtatgggcataaagttattaaattcttctccttactatgcacaaagccaatggacaggcaaaagcatccaacaaaagtttgatcaagttggtgaaaggaagattgccgaacaacctaaaaagtggcatactatattagctaagtctttatggtcttatcggatggcatgtcatggatctatacaagttccactttatcaactagtttatgggcatgaagatgttctaccatgggaaactaacatcagctcaaggagaattattttacaagatcggttaacaactgatgattatcataatttgatggttgaggagccagaagatttggtataagctagattatgtggaatggaaaaagttaaaggagacaaagaaagaattgtaaggcattataataaaaggttgtgccaaagtctttcgtggaagaaaaacttgtttggaagatgatattattgataggaataagagataacaactttgaaaagtggtcaccaaattgggaaggaactttcgggatccataaatatgtgctaaaaggggcttatatgcttaagggtcttgatgaagaagtttttggaaaaacacttaatggaaaatttttgaagaaatattacccaagtgtatgtgttaactcataattggttgattataatgatgtatgataatagtcgatgtttgaacatcgctttttagatgtccgatatataatatcgcccttagactaaaattttgtgaaatatcgcaagtgtgagataagcaagagtaaaatcggcttagtagctgatggatatattacatgaaaatgtttaaagttgcggtatcaaaaaatatttacggagctaaactattacatcagccaaaaagttctaaacttaacttaatgctacatccgttaagtttgatctattaagtcgtgatttgaatctttaactctggcctactttttgattgccaataagggtagaatcgggggtttcagccgatcttacctgatatagatgttttaatatgtttagttaatctaatcatgcttttcatgctatatttgccattatatatatgtatcacttaagataaataaatttggtgtacatcgagtatatttctgtgacatcttggcccaatcaggatgaggtctgtgtggcccatgtgagctgtgtgcgcatgtttagtactaccttgctagtttagcaagggtggaacaaactcataaggccttttcccttcaaccataccactctcgagttaacctttttacacgaagcgaggacgaaagtataagtggggtggtatgtgtaagtgggtctgcccgtcggatgggctggctacgcggttctggagggagggttgttacaaattctctagattgatatgtatatataaagttgtattagagtattagctaatacattatctttttatccaagtattgtctatgatataaacatatctaatctctgagtccatattgtctcggttaggtccgatctatacagtttgtctataatttagataagattgatttagagattatatgattgtttggctgtggtattagagtattagctaatacattatctttttacccaagtattgtctatgatattgttggaggtacaccacagggcccttcggccggaaccaccgaaaccaagagcttaggtgacaagcccggacgggaggcaaatggcgaaggtcaggaagacaaccacaacgggcgaagggcgcatggcgaaagccgtagctgggaatacgtcaacttcgccaagcggagaccatgtcggagggccgcacgggcgaaggtgaagaggcgaaagcctcggcacagaggcacgggtttcaccaaggtaccgaacctcatcgccaggaggcccagcgggccgtcgagccctcgggagacttcggcaaatagatgggccaagccatttatggcccaataggggctcgtacatgtaaaagacattgtgtacccctgataatgtccctatcataagagtaaccatgtaaattctcctgtaaaacctaaaccctaaagggggagcctataataggattataaatagccccctaagactatgtaatggggggatcaaaaaaattttcaccaagtaatacaattgttcttactttcaaccactgttgagagaaccacgcctttctgcgtgacgcagttgtctattcgacaacagctggcgccgaccgtggggacctctgagcgaaaccactaagagtgagcgaaaccactgatgccaccgaagaaggtcggcaaggagaatgttgccaagcggaaggaaggtggaagcgaaggtgagacggtagctgaagagggagcagagccttcggcctccgagggcgaagctggagctacatcgcctccgctggggccgccatcctacccgccttcggcacccacaacttcgtccgatgtggaagcggtgaaggcggtagcagcggcgaaggccctccaagtcagagacgcggtcttgtcatcctatgcaccatgggcgccttcgatcgctgctttcgcccaaccagcttcgacgtcggcagcgatcactacctcacaagccaatgccaacctcgaagctcaagctgaagctgacatgggggccatgtgccaaaacatggccaaacttcaagacacgcttcgccagatgcaagagcagcagcaagcgtatgagcaacaagacaagccaaggcccacacccaatagttctacactcagccccaagtcactcctccatacgctgcgtatgaaccggtgtacttcgccaggcccgccccagccattgtcgtgcgcctgacacctcaagtgatccaagcaccggttcgcccggcggtgcctcaagtccagtacccgaagcccactcacacaccgcaagcgatgatggaagcagcttcaaccttgcaggctcaattccaagcttttttgcaacaactcaaccagccccacaacaacttaccaagagcttcgcctccggctcaggccgagggaagcacaactcagggtacatcggcggggcagctgatgggacagttcgccttgccaagtcaagtccaagggccttcccctcaaggtccaccttcacagttcgacccaagtacaatggcccaagcaccaacaactttcgcacaagccgtatccccaggatacggaatccccaggatacggaacagcccaactaccgaatcaggcctagaatcaaaccatgatcgacccagccacgacggtacaagtcacttcgacagaccagcaaaatcaggaaatgatgttcggcttaacgcatcaaccgttgcccacagctcaaccacctatgcaagctgtggcttcgccgttcgcacttccatacccacaattgagttggcctgctcagcaaggggctatgatcaagccgcgaactgaaaagggtttgcctctcaactgggggatcaagaatcaccccatcccaccccaattcaagtacccccccagtgccacggtactcgggagagacagatccgaaagagttcctgtccatctacaaatctgctatcgaagcggctcatggcgatgagaataccaaggcgatggtaatccacctcgcgctcaatttcatagctagatcttggtatttcaatttacctattaatagcatttactcatgggagcaattgcgcgatgtttttgtccttaacttccgaggtacctatgaggagccgaaaactcaacaagaccttatgggcattcgccaaaggccaggggaatcggcaagggtgtacattcgccggttttcgcaggcacggtgccaagtgcaagatataaccaaagcatccatcatccatgctgcttcggcctgtttgctcgagggcgaactcacaaggaggctcgcgcgaaaggagcccagaacgtttgaacacctctttcgcataattgacggatatgctcgaggtgaagaagataccaagcgaagacaagagatacaagccgaatacgacaaggcagccgcggctacaacagccaccatgcatgctagcacccaagctcaggtccaagctcaagttgtaagtccaacacccgcccaggctcatccagtaccttttgcgaaccaagtaccgcatccaaggcctaaccaagcacccatgacatggaagaagtttaggaccgagcgagctggcaaagtggtgatggcagtcgaagaggtgcaggccctccgcaaagagttcgacactcaccaagcgggcgggcaacaacaaccctttcgcaagaagattaagaaggacctgtactgcgcctttcatggatgctcttcgcacacgaccgagcagtgtcgaaacattcggcagcaacgcaatgcttaagtgccaaggtcgtagcagccgagggtcgaagaggtaccacgtgaagcagccacaaaccaggcaccccaggcggagcaacgccaagacgtgcagcgaagagtgattcatgacataacaagatttgatcccccctcacaagtgtcgaaacgacaaaagaagatgcaacttcgagccgtgcacaatattgtctcagcaggtgatggggttccaagatacttgtcgcagccaatatccttcgggctagaggacaccgaaggagttcttttcccacaccaggacatgttgttcgtttcggcagagatggctggctttgaagtacggtgcatcttgattgatggagggagttcggctgatgtcatgttcgccgggacatatgccaagatgggtttgccaactttggcattatctcaagcaccgacttcactcagaggttttggaggcgaagcggtgcaggttctgggacaagccctcatcaaagttgctttcggctcgcaagagaacagaagagaagaagagatactcttcgacatcgtcgacatcccctacaactacaatgccatcttctgtaggggcactttgaccaagttcgaagcagtctctcatcacaattacctcaagctcaagatgcctggcccagccggtgtgatagttgtaaagggttctcagccttcggctgtcgcagcaacccctttcgacagggaggtccacaccttagaggtcgaagggcaggaaaaagcaaagtcaataccgaagcccaccccacacggcaaagtcatccagcgacagatagatgattttgaccccgccaaggtcatatcactcggtggagacctaagtgagcaagaagtcgatggcatactagccgtgctaaaaaagaacattgacatcttcgcttggggactagacgatgtggggggcgtttcgccatatctcatcatgcactacctcgcagtcaaacctgaagcaaagacgaagaagcagaagctaaggaaaatgtcggcagatcgccaagaggcggcgaaagtagaggtgaacaagctactgagagcaggagttatacaagagattgaccacccagagtggttagcaaatccagtaccgatgaaaaagtcaaacggcaagtggcgaatgtgtgttgacttcacagacctcaacaagatgtgcccaaaggacgatttcccattaccacggatcgaccagctggttgattcgaccgccggttgcaaactcataagcttcttggatgcatactccggatatcatcagattcacatgaacccgacagatatccccatgacagccttcatcatgcccttcggcactttctgccatctcagaatgtctttcggcttaagaaatgcaggggttacgttcaccaggttggtgtacaaagtcttggggttgcagctggggcgaaatgtcgaagcctatgttgatgaaattgttgtaaaaagctgcaaagcttttgaccacgcatcagatctgcaagagactttcaacaaccttcgcactgctggcatgaaactaaacccagagaaatgcgttttcggtgttcatgccggtaagttgttgggattccttgtgtccgaatgggggatcgaagcgaatcccgagaaaatcgatgccattcagcaaatgaagccaccatcgagcgtacgacaagtacaaaagctcgcggggcgaattgcggcactaagtcgattcttgtcaaaagcagccgaaaggggcttgtcatttttcaagacccttcgaggggcaggaaaattcagtttgacgcccgaatgcgaaacaacctttgatgagctcaagcagtacctccaaagccctccggctttggttagcccggtgttggcgggtgttaaatgtcgattctataccgccaacatctgcataaagatcagataataaaacatccaacatagagataggcacttaatctcacatattccacaggtgttggtgtatatttgtatgcagatgataaaccctgaaggtgggaggaaaatcagactaaagtgaggagaattctgtatccatgcaaggatgggttgtgaacttcatcgaaacatccgtaaatcagcccaaaataccaagaaatggatagaggaggaccaggggaggactcgggccaaaggccacgctagatgggcccagctcaggttcggccgaaccccctggttcggtcgaaccacaatctcagccatccaggctggggtttggcatggacgtcccagatgcatccctgatggcggttcgagggcacttcggacatttccccttcgccaaccgtcatacctattgtactatattgtactatattatataaggacatcatctcactcacttcaacatacacttccaagcttgagctgaattataagaggctctattgtactatattgtatactagaataggaagagagtagagtaggagtcggaagaattccgaagttgtcggtaatcttctcctatttcttttattctgtttattactctgaattcaatataatattcttcttgagtaatttagatttatcttgtgataattatctcttggttagttcctaatcagcatacaggattattgttcgctataatcaactaaagtatagtgattgctttggtgagttataaacactaaagtagatattaatttattagatgtggtgtttaggtaattattatccagtaattgctgcgtatcccacaatatgttgaggtgggtgtagaggtggtgacagccctcgagatcactgaagtcctccctgtccaggtacgtagtagagtgacatctgggaacagcgggttgccagtgcctgaagtattgcattaggattaaaattaagctttccctggacactgtttctcactagtaaatcctctctatcctagcctatcatttgcttggtgtccttggatgaactggaggaagctctgatcaaacacgttcccttggattcgataccgttggaatactccgtaggggaagtgctatatcggtatatccgtgcgcttgcggattttatctgtaaccgtatcaaataccaacaagcatttctagtgccattgccggggaacggttgctaatcatttccgaacccagttcatcttcgtatcctttttcattttttattcttccttcacccctgctatcctagagaagtattcctgtcaacacttctcgactatggagcaacctctgtttgagctgtctgctcctcggggcgaattctatgagccacctccttcatcggagcccatttatacaactggctatgaaattcgtcctaagctaattagtatggtcagggaaaatcctttttctagctttgatttagaaaatccctaccatcatctgcgagactttgaacaagtttgctcatgccttaagattcgtggcatgagacaagaaattgtgctgtggaaattgttcccgttctctcttcaagagagagcaaagcaatggtacacctctaccgttggatgtgtaaacggtagctgggaaaagctgcgagacagattctgtcttgccttcttcccagttacccgtattactactcttcgagtagaaattctcagtttcaagcagatcgaaaacgaatcaatcggtgcagcttggtccagattcactaatttagtgcagtccggaccaaccctgtctttacccgagtatgtgcttctccaacatttccatacgggtttggataaggaatctgcattctatatggacataaccgctggaggatcattcatgcacaagacaccgtcagaaggaaaaacgattttggatcgcatcctagaaaacacttccttcatgacgcagtccaatgaaccccagccggaggcatccatgtccaagatagaggaacctctaaccatcgagccacttgctgaaccatctacttctgctagctcgattgatgagaaggttcctgagcagccgtccgtcgagaatgaagaaattcagacttttgattgtgccgcaattatgtttagggaaggttttgacgaagactacggcaataccctaaactactttagtaagaggaaaccacccgttcctttgtcacctcccgatcctatggaacttgggttcctacgagaaactgtccgggagctgacatccataatgagcgacgaatggctaagggaggcagagcgttcatccgaagtaattcggataaataccgctccccgaatcattccttgacatctggaagggaacgatgtcggcattcgcttatttgagtgataaggcagtgaccctgataaacaaattcttcaagcatccgaacggaaatatcatcgaaggatttgggattgtacaaggcgtgactgtctgctttgaagatagggaggcgatcttagatttccacgtctttgaaatccaagactttgatatcctaatcgggctgcccattgagcaacttctcatcaacacaccccgattaggtagcctcaaaataacactgggagagaatgaattctctattccattcttgcgggcaaggatcaccttgaccgaccctctcccaaggcccttctagaagatgaggtccccgacttcatcaaggaagaagcagatcccggtgagactctcgacctgccaatcgtggaaccgctacctcgacctctgcttgagcttaaacctctacctccaggcctacgatatgccttcctacacaaagacagagaggctccggtcataattagtgacaagctctctgaagatgagactcaacgtcttcttactgtgttggaaaagcatcgttctgttcttagctactcgcttcaggaccttagggggattaatcccgcactttgcacccatcgtattcctattgaccctgagagtactccctctagggaacctcaacgacgactcaataatgcaatgcgagaggttgtaaagaaagaggtcttgaaactgctgcatgccaggattatctatcccgtaccatacagtgagtgggttagcccagtccaggttgtgccaaagaagggaggaatgacggtcgttgcaaatgctcagaatgaactaattctgcaacaaaccgtaaccggatggaggatgtgtatcgattacaggaaactcaacaaggctacaaaaaaggatcatttcccgctacccttcattgatgaaatgttggaacggctggcaaatcattccttcttttgtttccttgatggatatttcggatatcatcaaattcccatccatccggaggactagagtaagactacgttcacatgtccatatggcacctatgcgtatcgtaggatgtcctttggactgtgcaacgctcctgcatctttccaaaggtgtatgatgtctattttctcggacatgatcgaggatatcatggaagtcttcatggatgacttctcggtctatggaaagactttcggtcattgtctgcaaaatctagacaaagtcttacaacgatgccaagaaaaggacctggtgcttaactgggaaaagtgacatttcatggtccgtgaagggatagttcttgggcatcgagtgtccgaacaaggaatcgaagttgatcatgctaaaattgatgtgatagatcagcttcctcctcccgtgaacatcaaaggtatccgcagcttcttgggtcatgtcggcttttatagaaggttcatcaaggacttctctacaatcgccagacccctgaccaatctgctagccaaggatgtgccctttgagttagatgacgcgtgcctaaaatctttaaaagtttctcaaaaaggcactcgtctccgctccagtcattcaacctcctaattggactctacccttcgagattatgtgtgatgcaagtgacttcgctgttggtgcggtcttgggccaaaccaaagataaaaagcatcatgcaatctgttacgctagcaaaactctaaccggagcccagttgaattatgcaactactgaaaaagagctgctcgcggttgttttttctatcgacaagtttagatcttacttagtaggagccgaggtgataatttatactgatcatgctgctttgaaatacctgctcactaagaaagatgctaaacctcgtctcttaagatggattttgctactccaagaatttgacttagaaattaaagatagaaagggagtagaaaattctgtagcagatcatttgtccaggctgcagatcactaacatgcaggaacagccgatcaatgatttcttaagagatgacatgctgatgacggttagcgactctaacccatggtatgtcaacatagtgaactacatggtatccatgtacataccaccaggggaaaatcaacgaaaattgaagtatgaaagtcgccgtcacatatgggatgagccatacctgtatcgggtctgctccgatggcctactacgaagatgtgtgccaactaaagaaggactaaagatcatagaacgatgccatgccttaccctatggtggccattacggtgcattccgcacccaggccatgatttggcaaagtggtttcttttggccaacaatgtaggaagactcaagagaattcattagaagatgcaccagctgccagaggcaaggaggaatcactactcgcgatgcaatgcccctcacatacaatttgcaagtcgagatattcgatgtttggggtatagacttcatgggacctttccctaagtctcgcagctgcgagtacattctggtggcagtcgactatgtctccaagtgggttgaggctatgccgtgcagtgccgcggatgcgaggcatgccaagaagatgttcaccgaaatcatcttcccaagatttggtacccccagaatggtcataagtgacggaggttctcattttattgacaaaaccttccgagaccagtggtcaagcagaaacattaaacaaacaaatcaagaatattctgtaaaagacggtcaacaaaatgggaacaggatagaaggatagattgtcggacgcactgtgggcataccggacagcatacaagacacccattagaatgtccccacatcagatagtttacgggaagccatgtcgactccctgtagaacttgagcacagagcatacttggccatcaggaactggaacatggattttgagggagcaggagaatggagaaaaatgcagatcgctgaacttgaggaatggagagaaaagacttaccacaacacaaagatatacaaagaaaagacaaagcgctggcatgaaaaaaggataaaaattaagaaattcaagccaggagacaaagtactgatgttcaactccagggttaagcttttcgaccatggaaaactgcgcagcaaatgggaaggaccgtttgatgtcatcgacatctcttcgcacggggcaatcacactccgcgacgactcaggtaacatatttaaggtaaacggtcaacgcctaaagattttccatgagccaaacgaaactttagatgaagaagtggatgatatagaattaattgactatgagccatgatcccatctattgcatgcttaaaaccctgtatagttgtcatttttgtgcttagaataggtttttgtgggcctaggaaaaatttgggggcctgccggacccaccagggtttggccgacctgatggtttggccgaaccggggcggcccccgatcggccccaattttgaatggcagtctcccccgctcatcctgagtctgtttagatgcgagttaggaggtagatcagtcgtacctgaaccagagcccctgttcttcctcctctctctcacatttttgcaacctttctctccatctcaacccaattcccttgctccaccatctccaactcaccgatggctggcaaatctttgatcccattcatcggctcctcaaattccacatacaacctcgacggaaagccgacactgacgaatcaattaatcccggtggagcactacacaatggaaggggtaaatgcactgtgggcgcagccccttgcaacagtgccaggctccgtagcaaatttggagcccgtcggcgagctccctggttcggccgaaccaggggttcagccccccgttcggcagcgcgatccctctcccctcgacatgtcgcaagaatgaaaatccggggggattcgcctgcacgatggccgactatgggagagctcggcttgttaaaggcacgatgccttttccaagatgataagaaggccactacgcctcccgccgagcattatgtgggcaccctcttcaccaaagcaagggatgaggtgctccacaagtaccccacacccaccgctactccatctactccaaagggggagcgtttctgtattcagggagtgcgaactctcggcggtgggtatggtaagggtctactccggcctttgacggcatcagagaaggagggggcagcggagtcctgtagccctccacctgtgatggtgaagcgtcatttgatgccccctccaatggtgagggctcccggctaattccaagaggatgaggtgtaatcgctggagcccttgatccacaagctcgccgcacaagtgaagaaactccgcaaggagaacatagaggttagggatcgcaatgcggagctaggggtagaacttgctgaacttaggaataattttgataccctgagtcgcggtttgtgctctaagatcaagcgtgcattcatagagatgggaaaggaaaataagtattatgctaattagatgtttcctttcccatgaataaaatagtagtaggtgcttggttttatttttccagtcatctaagcacttgctataaataatgtggctcattggtgttaaccctaatgtttgccaaattttgtttttttatgtttaataaaattcaggttttgaataagtgtgggggagatatcccagcttctgacgtgcatatgctctgagaattgttgaaatatctcaacacctggaagcactgaactatgcagaaagttgcagagggattaggcactagagtggttcggccgaaccaccaggttcgaccgaaccaagtctagccccaacccttctcaactttcacaggtaagcaggtgagcatgtcttttatctgaatatctccaccatggtgtagtactagagctgaaaattcagaaacaattggttcaagcataagtgaaagataaaatttccaactattgaaattcttcaagtgattgatcttgtatatttattattctcagctgaacttgtgcttgtgaacaaccatccatgttaatggaaccttatgcatctaggtaattgctttatgtgagatgattaagatgaaaggaatccttgtaactttgttgtgactcttgggaatttgttttcaaaaataaaactgttttaaaagctatatcctccaattgactttaccttatacttaccaaggccatatgcaagtacattaatgatcaaccttatcatgcatatgattgcttgacattatattgagcttagtcataattgtgtgacttgtgttagatatctttcatactctcatgatcaaggggtcattatcatttccacatataaaattgagctaaacttctacactggaagttggctttccacacaaatattcattcaattaaactcctacaatgaactatgcattcttctcctagaaaagttcttggcaaaaataaaatgagaaaaggagggaaaggcatggctatgaaaaaaaacgagaagaaagagacctatggaaataaagtttgctctcaaaacattgagcaaagaaaatatagccatgccccctccacaatcatgccaaaagaaccaatttggagagaaagtgtagaaaaaaggaaaatcatctctttattccataattccacaaaatattttacttttccattttccacctttatttaagacccttgatctaggagtatgactgattatcttcttgagtccatatttttggctttgcaatatatatgatgcaggtatgtcacaatttatccctaccaagccccacatatcagccttagaatagggatgaattctggcacatttttgccttggagaggatccaaaaagaaaatatacatctttgagagacaagagagaaagtcaatatgaggaaaagagctagtttgcgaaaattcatgaaaatcccatgagtctgacagagaagtaagaaggactggaatcaagatcgttccatttatcaattactcaacatggtaagatagccactgaaaaagttcacaggtgcaggtatggttgtgaatgatttatatgcttgattcatcttttgaagaaattcattcacaggtgcaggtatggttgtgtgggtggtttttttggcgggtgttaaatgtcgattctataccgccaacatctgcataaagatcagataataaaacatccaacatagagataggcacttaatctcacatattcgataggtgttggtgtatatttgtatgtagatgataaaccctgaagttgggaggaaaatcagactaaagtgagaagaattttgtatccatgcaaggatgggttgtgaacttcatcgaaacatccgtaaatcagcccaaaataccaagaaatggatagaggaggaccaggggaggacttgggccaaaggccaggccagatgggcccagcccaggttcggccgaaccacaatctcagccatccaggctggggtttggcgtggacgtcccagatgcatccctgatggcagttggagggcacttcggacatttccccttcgccaaccgtcatacctacccctatataaggacatcatctcactcacttcaacacacacttccaaccttgagttgaattataagaggctctattgtactatattgtatactagaataggaagagagtagagtagaaggagtcggaagaattccggagttgtcggtaatcttctcctatttcttttattctgtttattactctgaattcaatataatattctttttgagtaatttagatttatcttgtgagaattatctcttggttagttcctaatcagcatacgggattgttgttcactataatcaactaaaatatagtgattgctttggtgagttataaacactaaagtagatactaattgcttagacgtggtgtttaggtaattattatctaataattgctgcgtatcccatagtacgttgaggtgggtgtagaggtggtgacagcccttgagatcactgaagtcctccctgtccgggtacgtagtagagcgacatctgggaacagcgggttgccagtgcctgaagtattgcgttaggattaaaattaagctttccctagacactgtttctcactagtaaatcctctctatcctggcctattatttgcttggtatccttggatgaactggaggaagctatgatcacacacgttcccttggattcgatacccttggaatactcctaggggaagtgctacatcggtatatccatgcgcttgcggattttatctctaaccgtatcaaataccaacacccggtagcagggagcgaactacggctctatctggcagcttcgcctgtggtcgtcagtgcagctttggtacaagagaccgaagcaggtcagaaaccagtttactttgtttctgaagctctccaaggggcgaaggtcggatacattgaaatggagaaactcgcttagaccctggtgatggcttcaagaaagcttaaacagtatttccaagcccatagaatcgtggtaccatcacagtaccctttgggcgaagtgcttcgaggaaaagaaatcacggggcgtctaagcaaatgggccactgagctatcacccttcgacctgcactttatcacttgcactgtaatcaagtcccaagtcatcgtcgactttgtggccgaatggacgcctgcgactgtcccagagcccaaaccggtcgaacaaacatgggtcatgcactccaatggttcatggtctcataagggggcgggcatcgctgcaatcctaacctcgccatgaggtgtcccaattcggtatgcagcaagactgcagttcaacacaaccaacaacacagcagagtatgaagcagtgttattgggcctgagaaaagcgaaagctttgggcattcggcatttgctagtccggacggactcaaagcttgtcgcgagccaagttgacaaatccttcgaggcgaaggaagagggaatgagaaagtacctagaagccgttcggtctatggacaaaagtttcgccggcataacggttgaacacttgccccgaggccagaatgaagaagccgatgcattagcgaaatctgctgcttgcggaggaccgcattcgccaggtgtcttcttcgaagtcctttatacaccaagtgggccagaagatagccaagacatcatggcaattgaccaagtggagccgggcgatgacccaggcgattggcgtacgcctttcgtcaaacacctcaaagagggatggctgccagatgacgaagcaatggccaaacagttgcaaatcagagctgtgaattataggctaatctctgggcaattgtaccgaacagggatgctgcagcctatgcttcgttgtgtttctttccccgaaggtgagtgatgaactact

SEQ ID NO: 25691 - DNA, 23522 bp, Oryza sativa
gaaatcaaaggtgttgttgagataagcgcaaagtaggcccaagtgcatacccgaacgaggaggctcttcgccgcggtgcatccttcgacaaactcattcagttcggggaagggcacaaggcctcccaccggtgaaacaaggtgtcccaccccctgcacaatagggatgagttccgcacgagtctcgaaatcggaagagacgaagcggggagcagacagcgaattgtccgaacccgaagtttcgaccgccgcctgcttcccccgcgcgggtgccaggagcgaaaggtgaggcccagggagggagcattgaaggtggcgcaagccgccgccacagcaccttcggcagatgcagtggcgcccaccatgaagctttgcacctcctcaccagcagatccagcgacagcagtggggaccggggatctcgaggtccgctcagccagcaaagtgggggtgccatgcgatgggtcatcatcactgaaagcattcccaatttgcacgacccctcgcgcacgggcctcggttccaacctcggtccgaagtgggggaacccccgcgatcgcggtgagagtttccgcccttccacctctttcaagtgaaggggagatgagctagatgcaacccctgctttggcatgggaagggctcagagtgtaacggggagacatcaatttttccctagtctcatcgacggtctcctcctccccctcctcttcgtcttcgccctcctcctcgtcatcggcgtcggactcaactgaggcagccgccttacgctttcacgaggcagccttacccttcgcgcgcttacgcttctgtgaaggctcaacatcgtcagcgtcaattaagacggtctttgtagggttcgcccgggccggcagttcgccggagaagacacgattcgcccggccgcctgcctggcgggagagcaattgactgaactaatttatggtgagttcgccaatcatcttccgggcctcgctttcggcctatggcagcgtaagaactgtcgaaaacaatagtacagggcataagtgtaggatcgagatgtcgactagaggggggggggtgaataggcgatttaaaactaaatgacacctaatcaaaactaacctaagttgctaggctcagtgaggaacaactctaactaagctactaagttatgttttgcaaacctagggtgatagtggctcaattatatctctaggaaagtaaatcacactcctatgtcaatgtctctagtgatatgatcttaagtatgtctctagaaatgtaaattgcataaatgtaaatgcgacaatcaaatgagacaatgagacaagagatttttcaccgaggttcggaaactcgccggtttcctactcgccattgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcacaaaccggcgccgggcctcctccacaatcttctcggagaggtcaccgggcaactcctccacaagccgtctaggaggtggcaacctccaagagtaacaagtaatgacccggcgtggagatgatcaagtgccacactagctctacaatggaagtaaatgcacttgactcttggctaaatcaacctcagtcactacaatggatgaacactaagctcaatggtgtgtgagagaggtgcaaggggtgtatgcaattgaattgggtgccaagagagtccccttgctgctggtggaggagtatttatactcccacccaccaaaactagccgttgggggtgaaatcccccaactctgtgctctgccagtctgaccggaggaatgtggccggtcagaccgtgctactctgcaacggctagaaaactagtcgttgtagctctgtcagagggccccatcggcatggccggtcagaccgacgttgagtggccggtcagaccggcattggctcggtcaaaccgccatcagctcggtctgaccgaatacggctccgtcggctctgtatcggccaccccgagcaacaccatgccggcctccagggggccggtctgaccacacatgtgccgccggtcagaccggccatatgcgccggtcagaccgccgttttgtggccgattagactggccagggcactccggtcagaccgccactctgcggccggtcggaccgcccctggtcaggccgaacccagtgaagggtgatatgagaagtgtgtgtgtgaaatgtgagcacaagtctaaatgcataatgacctaatgtggcaattaaaatcatctctttgctaggtcattacccctcttaatagtacggcgaaactaaaaataaactagcaaatttgttcgccctatacctcgatcaattctaaattaaagcgctagttttaccgtcttctttccctttactttgcaccgtcaattttaatccatcgataatcatccatgcgcacatgtgacgtggacctaacttaaaatatatagctcaaagacaacggttagtccacaattagtgcttgttattaattaccaaaattagcaccgggggcctagatgcttcaatctcccccttttttgtaattgatgacaaacaccacaaatatatataatcaaatttaaatcacacggacatatattgcaatgacaagcaaaaagctccccctaaacatatgcataacaatcacaaatagcaaatatggagccaatgcacatttcaatttcacatttcaacatagcacaaacacaagagcaatatctcaatgtgaacttcaagaaatatttatccatgagcataagatggtcacatatatatcaatatcacatacaccatccatcatcgcacaagttcacatcacttaaccattcaaatcacataagttacaaatcatcttaaaagggctcacaaataaatataggctattacaagaccacgaagggtccaaatgacatatagatcaacaaaacgataaagaacacacaatatagagtaatagtccatacccatacataatatagcccaaaccaccttaacctattagatatgaggtgactaacctcactaccactagtcccaacccacaagacataagtatatatatttcattgttaacatatatttcgatctaagtgatttatattatctcagcatgacgtccgatctatcccaatcacttgatttaagtatgtatcgacataacgattatatattgttaatatctacagccgatcgaatagatttagtcctttcttatttatttacatctgccgatcgattcaactatgacatcgcctcagagaaaaatgatatgtcatcggcaattagccgatcggctatcatttatggttttaaccgcggtttatttgtctttatttcttgtttattgctggaccaaatcaactggcacgctcacgaacctaaaaggcaagatttttggacctgcactgaagttaagcagatcttccaggcctcgtgtttttgcatcaacacgcttttggcacgcccagcgggatccgataaacttgtcaggggacaagcaagctttgaagtcaacagatcctcaaaacaagccgccaaatccagctgggtctgaagttcacgaaggaaatattattctagtcacactagacaaattgtcggctgaacataggcaggagcttgaacagatgatgagcagcatgaaggacaagttcatgaattcattcaaagaaacccgccaagggacaattgtccagaaatacaagttgaaagtggtcgctgccgatgaagttggttcaagctcagctcaaggcgataaaggtactgctggtgaaccaggcgacaaaggtagtggtttttaggagggcatggttgaagatcttggtccagatggcagtggattacaaccacagtttgacaacttccaagatcggattgactacgctatgcaacatgctttgatcaatcaatcaggagtcttagtcaatactttaaccaacatggtgaaaacaatggttgatggcacaatagctgagcatcaagttacagaaccagtgtatttgccaggtggtgtttttccaaactataagcctttggttacaggcaatcaacagggttcttctaacacaccatcaactctgctgatggcaccggttacaacttctgctccagctgcaccatcatcggcacaaaggcaaatgaccaatcctcgattgtatacaagagaacagccacagcatggtggacaaaacatcaatcggctaactcaggagcaggtggctgctatgttctttccaaatccaccagctgccaatccagcactgccgagccagcatatgccaccaaggcagcagattactcagccgattcaatagcaaagtttgctaaatgcatcagctaggttgaggacacctgataatcagctaaggcagcatgttgcaactcaagtcgtccttgagcacttggttcataatgtgcaaccagatcaatcagttatacctcaaattatccctgaacatttggtgcgtaactgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagtggaaaataagataaacggcgcagacggctccactccacaagcagctcgaccagggctacacctaatcctccacaccattagcaccactgtagaactcttcctctgatgaatgattgcaaggtgagtatatgacatactcagcaagccacgcagcaaatatgcaagtgcacaggataacaaaggatggcatagtatagggctcatttgcaaaagcagcatttagcaaacatttgagaattataaaacagttaagtgataattaaacaatattaatccaacactatacaacataccctgttgcataggcccaaccattctgaacaaccatacccggctgtacagatctatctccaaaccaggaatgtaccattccaaaccaggagctaatcaaattattaccagttatagcatcatttattatggtgagaagtgtgagactaatcacgaaagacattgttagacccgcccataaccgcgggcacggctattcgaatagttttactctgatcagaggtgtaccactgtacccacaagacacagccccatatcatgtcaccatgtgccgcaataccaccacggtacctcggaaaggagctgtgacaatacccctcgtacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtgtaacgtcccgccttcccccaggccgggcccgcttacatatgatagctttcataggtcatagactgccctcacagaccaacacatgtcttttctgcacactttgtcctcactcgtgtgcacccgggaagaatttcccggtcggtcacccatcccaaattgctccaggccaagcacgcttaaccctggagttctttggagattggcttccagaaaagaagttgcaacttgttgatatgagtattctattaatcctattaagccctaggccgggatgttacaccctcaccccttaagagagatcgacgcccccgtcgatcaaccctaggctaggaacgtcctctcttggccacgtccatgtgtccagtgccagcgcatgtagtcggctctgataccattttgtaacgtcccgccttcccccaggccgggcccgcttacatatgatagctttcataggtcatagactgccctcacagaccaacacatgtcttttctgcacactttgtcctcactcgtgtgcacccgggaagaatttcccggtcggtcacccatcccaaattgctccaggccaagcacgcttaaccctggagttctttggagattggcttccggaaaagaagttgcaacttgttgatatgagtattctattaatcctattaagccctaggccgggatgttacataatgtttcacaaccgaaactcgtgaaccggtccttaattgtcatgagcacgaccatcaaaactatgtgctcacaacccaccattatcaagttttagttggcaagtaattaattaacaaatcacgattgaccatcgtgaactatcattaagccatcattaaataatagtgagtcatatgttatcccaatagtgtgctaatgtttctaagcatggctaagcaatcacatctaatatctagctgaaccaatatatagagctcaactagtcaagttataataacccaaggtatcaaggaataaagtaatcaagtacaaaagggccataacaaagaataggttaattccacccaatgacattcgaaaatagatgcaatagttgaatagaaacaatagctttaaataggatcaacatgctcaaagggttgtttgggatctgtgtgacttgccttgctggccttggaactcttcaaaatcttctcctgcgaaaacggactctccggaaacgtcggaatctaaacagaaaagagcaaaaacaccaaaacagcacataaacaagcatgaacagtacatgtggatatttttaatatgtagatctcaattttagaaaaatttagagacttgaaccaactaaatccgagctaagatgaattagttatgaatttttgaagatttaatcggattaaaacacttatattgattttaattgaattatgacgcaataatgaattatttttgaaaaggaaaaagagatttattgcgtcagcggctagggtttgcggtagaccgggcgcacggcggcggttcacgggaacggacggccgagatcgatcctatccaaaacggacggccgagatcaatcgggtccacggcgagtctacgggaacagcgacaatgacgtcagcgatgacgtcagcgatgacgtcagcaccggcggcggctcggcggctcgggagcacttgctcgtcggcgaacgacggcgcgaaggcgcgaacggagggcaccaacgggtagaggacgacgcggcgaactcaccggtgaccaaaacggcggcggaagatcaacggacggcgacggcgtcgaggtcgaaggggcggagaagatcgggtcgacggcggcgacggtcctccggcagtcttcagcgacggcgaaggagcggacgaggatggcgacgacttggcgaccacgatggcgaccttcccgagcgacggcgacgactggaacggcggcggcgcacggctggagcggcggcgacgacggcggcgctaggttacacggcgctggggcgctaccggcgacgagaggcgaagacgagggtggcggcgggcgggtagaggagacaccggggatccttttaaaggggctaggaggcggcggcaaaggcccacggcaaccggcggcgagatggaaagctcgggctcggagagagagagaccgatccgaatcgacctcgaatcaaacactttccaagcgattttagccgatgattccaaaagagaaaaggtagaggagatcccgaagatcattttccctcaattgatttcaccggaaacggaaaggatcggccgaatttggaaggagacggcggcgcggctcggctagggtttcgggcggcggcggctggaggttgacgacgaccccgacaggcgggccccacctgtcagcgacgggaacgcacgcgcgcgcgcaggcgctgctggactgggcggacttggcccgagggacagagagagagggttttgggccgactttcggcccaaagccaaaagaagacttttaaaacctttttcaatttaaattattcatgaaatgcaattccatttattaaaaatacttcctcagctcaaataaatcccagaaaaatctaggaattatagaattaagcaaagtatttaatgaaattttatctggccccattttatattggaatttattatttaaaattagatcttcttttctagacttttaaaatcaattctaataattccaattaaacaacaatttatatatttggaatttttagggtgtgacaaacctaccccccttaaacagaatctcgtcctcgagattcgaaagaactggcgaacagatgcggatgagctgacttcaattcatcttctcgttcccaagttgattcttcttccgagtgattactccattggactttgcaaaaacggataactcgatttctggttcttctctcatctatttccaagatacgaattggtttctcaacataggtcagatcctcttggacttctatttgttcaagattagcttcttcggtaggtactcttaaacactttttcagttgtgacacatggaacacattatggacccctgccaaagattgaggtaactctaactgataagcaacctctcctcttctactgacaatcttataaggtcccacaaaacgcgatgccaattttcctttggtgtggaaacgatgaactcctcgaagaggcgtgacacgaagatacacataatctccttcttcaaaacttagatctctacgacgattgtcggcataactcttatgacgagactaagccactcgcaatctttcttgaatgatctttaccttttcttctgcttcccttaggatatccgtcccgaaaacctgacgttctcccgtttgatcccacaaaagcggagtgcggcacttccgaccatacagtgcttcgtaaggagccatctgaagactagcttgataactattgttatacgaaaattccgcataaggtagattcttatcccaacttccaccgaagtctaaagcacaagctctcaacatgtcttccaaaatctgattcaccctttcggtttgtccgtctgtctgtggatgataagcagtactaaagttcagcttagaacccatctcttcctgaagcttcttccaaaaatttgaagtaaactgactgcctcgatcagacactattttcttagggactccatgcaaacacacaatccttgccatatacaattctgccaaccgactaccagaatatgttgtctttactgggatgaaatgagccactttggtaagtctgtcgactatcacccaaatagagacatgacctgatgacgttctgggtaaaccactgatgaaatccataccgatttcctcccatttccattctggaatcttcaaaggctgcaacaaaccggcgggtttctgatgttctgccttgactcgctgacaaacatcacatactgctacgtattctgcgatttcacgcttcatacttgcccaccaaaatctttccttgagatcctagtacattttggtactaccagggtgaatggagtataaggtatcatgagcttctttcagaattgcatcttttaaatctttgttgtcggggacgcagattctctcacccaaccatatagttccttgctcatcctccaaaaaaccgatagcttttcctcttctcatattcttcttgatttcttgaatatcatgatcattaatttgtgcttctctaacttgatcaattagtgtgggcttcgcttctaaggctgcaacgaaacctctaccgacaattcccaaattcaatctttcaaattccttacataactccaatggcaactgtcgtccttccgtagcattgcaatagcctttcctactaagagcatctgctacaacattagcctttcccgggtgataatgaattcccatgtcataatccttaattaattccaaccatctccgttgtctcatgttcagatccggctgagtaaagatgtactttatactcttgtgatcggtatacacctctgtacgagtaccgaaaagataatgacgccaaattttcaacgcatgaactactgcagctaactcaagatcatgagtagggtagttcttctcatgcggacgtaactgacgagatgcataggcaatcaccttcccatcttgcatcagaacacaacctaacccaagtttagatgcatcgcaatacacttggaaacccttctttggatcaggtaaaatcaaaataggagctgatattaagcgactcttcaattcttgaaaactctgctcacattctgtcgcgtcccaaaacgactctaaaatacatcctcgaaattgtgccgagaataattaaaattcatgtgaaagccttcaacaattaaaatgtgcaaatttaaaaagtcaaataaggcttggaggatttttgtatatttcctaaaagcctaaaatgcgtaaataaattttagtggaattttcagagcacaaataataattgagaagaaataaacaaagttgaaaaggttttataaaaagaaaaatccctaaaagtcttcttttcccccccttcccttcttgggccggctcggcccaattccctccctctctctcctctcccccgcggcccatcggccctcccccgcgcgcgcgccgttgacaggcgggcccgcccgccaccctcgctgacgggtggggcccacctgtcatcgcctacctcgcgccgcgcccgccgcccgcccgtgccctagcgccgccgccgccgccgaatccgccgcatcccgccgtccccgcgcgccataaagagggggaaatcactccccgtgattccctctcccttttcccccgtttttccctctctctctccctcggattcgtttggaatctctcccgcaatcctcgccggcgcaatcaatggcggccggatcctccgcgccggtttccatctcctccggccgccctctctcactcccgacgctatataatcgctcctcgtgcttcgctcctccgtttccgccactcgccgcacactctccccgtcggattcgtgcccgcgccgtcttcctctctctccgccgtcgccgccgagctccggttcgccgccgtcgtcgctccggacctcctcccgactcggcgtcacctccttcggcttcgccgcgttcccgtcgacctcgtccaccccttcgtttcgcccgccgactgtcggagcgccgccgtcctcgtcgatccgaaccgcgccgccgccttcctccgctccggttgtcgtttccgccgtcctcgtcgtcccggggtgagccatggaccgcctccttcgcttcccccttccctcccctctctcggccgccgctccgccgcgccgttggtcgccggcggcgaccatcggggcgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggtcggcgtcagccgcgtgcacccggtccaccgtggaccgagaggctgacgcgtgggccccactcccgtggacccggtccgcgcgccctctctcccggctgacgcaataaatgagtttttaattaaaatttaaatgaagaaattcgtaaatatccatttaaagagcatataaacttcaaatggtcataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttacgaccttattattgttattgttattatttccttgttcaccctagattaaacaaaacctcaactagtggacactctactcatgacaccactagtttaattttaggtagatgcttcgcaatttaattaggtaacattaggtggttttacaactatagactttgggaattattcacatcacctggacactttggaatggtctggatattgtggaattggattcacaccactccttctattcaaaatccccaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggtgttccggccgtaggcgggattgggtcggtactcttgtctatggctaggatgggttggaaactatgtcacgtcttccgtctgtataccgtggtggtatgtggcacgtggttacacgtgaggaagaggtgtcttgtgggtaaagatgtacacctctgatcagagtataatctattcgaatagccgcgccctcggttatgggcaagccgagcaatgtatccaagttagtgttttaattcttaaaacctgcttaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtgtagttctaggatcgtgtttacaaaatagctttgagcaactaaatgtccttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttctgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaaagcccgttgggttatttccggtcgtgacaagttggtatcagagccacccttgaccctaggacgagccgtagaacccaagccttagcaatattttcaaaaataaaaatcctttgttatttgtgaaaactgtctagtctctctctgtcttgctgcttcatttatcgccaaaatctgacctttgaaaatgttgcttttctttttgtttttgtttgtagatggccggcagcgtcacccgtcgtggtttgggcatgactggcttcgtcttggagttgcggggcatgtgcgtggccctggggtatccacacggagtggactaccaggccaggccgcttccggagcaggagggtgacgatgcggagccccgcgctgcttgggaggtcactgcagtgatcctcgctggctcttctgagcggacttcgctgacagtcaccgcgggtggcgattccttccccgccgcttgccagagcgccgctctcctcgccatcggcactctccaccagcgctacccggacgagttgcagcactcgccctaccgctaccacccccgccgcggaggagcccgcgactacgccaccttccgggatgctagctcggaggatgacgctaccatcgtgcacctggcgcgcatggtggaggcgtacgacgcggctcgtatcgacttccatcagatggtgcgccgtgggatggtcgagaacaacatgaagatcctggagctgcgtcaggagaacctgcagctcaagaaggacctggacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggagggtgcgctgttgctcaccttccgtcctggcccgtcgcagcggtagacgagcagttagtaggtttgcgcgtgtgttctttctcgtttgtctttttgagttgtgtggggcatggtttatgccggtgtgtggcataactatgtcggagcctgtcttattttatttgcctaagcaacttgaacattaatgaacccatttaatagcagtaataaattcaagaattatagtagtcgtgggtggttagttttaattgtcagctctctctgttgctggttctgtgtggggttttcagatggtgacgaccaggagaaatgctgttaccggtgatggcaaccaacccgaaggcagcaaccacaaccaccagggcaacccacctccacctccacctccgcctccaccaccaccaccagacaccaacgccattctcacccaaatcctcgcccagcaagccaacatgatgactgctttcctccaccacctccaaaatccgccacaacataatgctccaccaccacccccacaacactctaaactcgctgagttcctccgcatccgcccacctaccttctctagctccaacaaccccgtggatgcgttggattggttgcatgccgtgggaaaaaagttagacactgtgcagtgcagcgatgaggagaaagtcatcttcgccgcccaccaactgcagggacccgcatctctctggtgggaccacttccaggctacgcagccagaggggcaacctatcacttgggcccgcttcaccgccgcttttcggagaacccatgtgcccgccggagtcgtggcccttaagaaaagggaattccgagagttgaagcaaggcaaccgctccgtgatggagtatttgcatgagttcaacaatctggcccgttacgccccggaggatgtgcgggaagatgaggagaagcaagaaaagttcttggcaggaatggaccccgagttgtccgtccgtctagtctctggggactatccggattttcaacgactggtggacaagagcatccgcttggaagctaagcacaaggagctggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagggtcagcaggggactcgtgcgccccgtcctcctacgccaactgtgcagcccggtcaaggccgcagggacgctcaaggtcagcagcgtctgtgcttcaacttgttcgagcccgggcactttgcggataaatgcccaaagccaaggggtcagcaaggccaagcgccttcccggttcaacaacggcgggaaggatgtcattcggggccgtgtgaatcatgtgacggccgagaacgtgctgacaactccagacgtcatcgttggtacgttcctcgttcattccatccctgctactattttgttcgactctggagcttcccactcgtttatatctgtgtcattcgtggggagaaatcagttgggggtagaaaggcttagaaaccctttgctcatcaccacccctggcggggttatgacagcaaagtattatagccctgccgttcctatagaaattcaggggattccttttccctcggatctgattctgctagacaccaagaacttggatgtgattcttgggatgaattggttggcacaattccaaggagtagtggattgcgcgagacgcactgttactctgtaccgagggccagaacaaccggttgttttctttgcacctccaacctctgtcagaagttcagaactgcatcagataggtctgtcagaaatccccatagtcagagagttcggagacgtgtttccggaagaactacctggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatccgtccgagtacttccccatggggtgctcctatgatttttgtagagaagaaagacaagacgaagaggatgtgcgtcgactacagagctctcaatgaagtcaccatcaaaaacaagtaccctcttccccggatcgatgatctgttcgatcagcttaaaggtgccactgtattctccaagatcgatctccgttccggatatcaccaattacgtattcgggaagaagatattccaaagaccgcattcaccacgcgatacgggctgtatgaattcacggtgatgtcgttcggtttgaccaatgctcctgccttcttcatgaacttaatgaacaaagtgttcatggaatacttggataagtttgttgtggttttcattgatgacattctaatatactcacaatcagaggaagaccatcagcaccatctccgtctggtgttgggaaagttgcgggaacatcaattgtatgccaaacttagcaagcgtgagttctggttgtccgaagtcaaattcttagggcacgtgatatctgctaaaggtgttgctgtggaccccgaaacagtgaccgccgtcaccgattggaagcaacccaagacagttactcaagtccgcagtttcttaggtttggcaggatactaccggagattcatcgagaacttctccaaaatcgctcgacccatgacacagttgttgaaaaaagaagagaaatttgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatgcaggacggtcatgtggtagcctatgcctcacgtcaactacgacctcatgaaggcaactaccctacacatgatttggagttagcagcggtgattcatgatctaaaaatctggcggcactatctcattgggaaccgctgtgaaatatatactgatcataagagtttgaaatacatcttcacccagtcagatctgaaccttcggcaaaggagatggttagaactcatcaaggattatgatgtgggaattcactatcatcctggtaaggccaacgtggttgccgacgctttaagtcgaaagagccattgcaacactcttaacgtccgtagcatcccacccgaacttaatcaacagatggaagccctgaacctaagcatagttagtcgtggatttttggccgcgttagaagccaagcccaccttgctcgatcaaatccgcgaggctcagaagaacgacccggacatgcatggactcctcaagaatatgaaacagggtaaagccgctggtttcacagaagaggaacacggaaccctatggaacggaaaccgggtatgcgttccagataacagagaacttaaacagctgatacttcaggaagctcacgagagcccttactccattcaccctggcagtacaaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggcggatatgattctatatgggtagttgtggatcgattaaccaaggtagctcgatttattcctgtgaagaccacctatggagggaacaagctagccgagctctacttcgctaggatcgtgagtctccatggtattcccaagaaaatcgtatctgataggggaagccaattcacctctcacttttggaagaaactccaagaagagctgggtactcgattgaatttcagcaccgcctatcacccgcagacagatggacagaccgagcgtctaaatcagatcctagaagatatgctccgcgcatgtgtcctagatttcgggaagacttgggataagagtctcccctatgccgagttctcctacaataacagctaccaagccagcatacaaatggcaccctatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgcgacctggaattcgcagtggatgactttgtgtatcttcgggtcacgccattgcgaggtgtgcacaggtttcagacaaaagggaagctcgcacctcggtatgtgggtcctttccgtatcattgctcggcgcggagaagtcgcttaccagttggagctgcccgcctccttgggcaacgtgcatgatgtgtttcatgtgtcgcaactcaagaaatgtcttcgagtgccatccgagcaggccgactcagagcaaattgaagttcgcgaagatttgacctatgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaatcgactctaaaattcatcctcgaaattgtgcaaagaataattaaaattcatgagaaagcctccaacaattaaaatgtgcaaagataaaagtcaaatgaggcttggaggatttttgtatattttctaaaagcctaaaatgcgtaaataaattttagtggaattttcagagcacaaataataatagaaaagaagtaaacaaagttaaaaaggttttataaaaagaaaaccctaaaagaagttctttttccccccccccttccctcttgggccggctcggcccacttccctctccctctctctctcctctcccgcggcccatcggctccccgcgcgcgcgcgcgccgctgacaggcgggcccgcccgccactctcgctgacgggtggggcccacctgtcatcgccttcctcccgccgcgtccgccgccgcgcccgtgccctagcgccgccgccgccgcggattccgccgcatcccgccttccccgcgcgccttaatgaggggggaattactccccgtgattccctctcccgtttcccccgatttcccctctctctctccctcggatccgtccggattcatcccgtaatcctcgccggcgacatctatggagcccgagatccccgcgcccgtttccttcctctccggccgcgttctccccctctcggtgctatataattgctccccgagctccgctcttccgtttccgccgctcgccgctcgctctcgccgtcggacccgtgctcgcgccgtgctcctctctctccgccgtcgccgccgagctccgtttcgccgccgacgtcgctccggtcctcctcccgactcggcgacacctccatccgcttcgccgtgttgccgccgaccccgtccgccgctccgcttcgcccgccgaccgccggagcaccgtcgtcatcgtcatcccgaaccgcgccgccgccttcctccgctccgttcgtcgtttccgtcgtcctcgtgtcccggggtgagccgaagaccgccgttcgctttcccccttctctccgctctctcgggcgccgctccgccgcgccgatggtcgccggcggtgaccatcggggcgcgggcgcgccgctcccgtcggccgtgccggcgaggccgccttcgggcgcgccctcgcggctgccaggtgggcccggccgtcagccgcccgcgcccgcgggtgcggctgacgcgcgggacccacggcgccgaccgccgccagccgcgtgcgcccggtccaccgtggaccgagcggctgacgcgtgggcccccacccccgtggacccggtccgcgcgtcccctccctcggctgacgcaataaatgggatttttaattaaaatttaaatgaagaaattcgcaaatatccatttaaagagcatataaacttcaaagggccatatcttggccatttgaactcggaattggaccgttcaagtctctaatttttccttaagatgtaaagaacccatttttgtgctttgtttctgctgttatgtggagttatttagtgtttaagccttttcttttccgttggtcgtgtagacgctgcagcttcggaagatccgctcttcgtggaagtcgaagccgtcgattgggaaggcgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgttattgttattattactaccttgttcaccctagacaaacaaaacctcaactagtggacactctactcatggtatccctagtataattttaggtagatgcttcgcaatctaattaggtaaccttaggtggttttacaactatagactttgggaaatattcatatcacctggatactctggaattgttgggttattgtggaattggcttcacaccgccccctctattcaaaatcccctaaattggttttaggctgggctcggggtgcatggttttgatggtagcacctcgtccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcgaatggcagagggttggtgccctgctgctaggggctcagtcctgcctgcctgtcccgggggttccggccgtaggtaggattgggtcggtactcttgtctaaggctaggatgggttggaaactatgtcacgtctttcgcccgtataccgtggtggtatgtggcacgtggtgacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaacccctttttggtataattcccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtttctcgtttgtctttgtgtgttgggccttcgctgcccgtgtaataattttatatacgcttccgcttgttaaactctgaattgtatcaactttggtgtaccttgcctcctgggacaaggattaatgcacgcacgtcaggaacgcccgtcgggttatttccggtcgtgacaatttattctagcattattagtactgtacatctattactgtactaatggctcatttaccagcaaaagttttacgatattgttttatttaatcttgctgcaaaaaaaaataaatttagcatgttgattttataactttcttttatttcttttggaacctgatgttcaaaagtacaaaatttgtaaccttgtttccaactgtttcaacttatcttgcaagcttgttttactttatttacttacctttttactttgattttctaactttattcaaattaatccaaaaacttgtgctattaattggataaatgtcttaactccctcctttcacttgtctttagatgccgcgctacaagcctgagtacttgtttggtgttgaggggtttgtccaggagttgcgtacgatgtcctttgtcataggatttgggactgcccctttttatgcccagattcctcatgatcgtcacgaagaaaagtgccgagtcaaagtcaccctaaacagtaatagtgaagatatcccctcagtgatgttcgaagctggaggaagaaactacattcatgcatgtcaggaggtggcaaggatcgccataggagagctccgtgatcgctacagtgatcagttggccgacactgagtatcgctaccatccttgccaaccccagggaagtgaccgtggcagttaccttgagactgagggaattgagaatgatgctaccacaaggcatttggttgagatgctgtgggctatggatgaaacccgtgcggagattgtgttagcagctcaagatcgtgaagaccggaatcgtggtaagatttgcaagctagaggacaaagtggattgtttggagaaggaactagccgcattgaagggagaagcaccaccgcagaaggccaggattcgtcttaccgcaaggaagagagctctatttgtccctcgctaccaattggcgccaaaagtccgtgtggtggagaaagaagttaccccagccctagcggatcctccggtcatcaacataagtgatgattaagaagaagaatccaagcacactcattccaagatcgagtggggagcaactcaagatgatgaagacgagccgaacgagccttcaatcaactccgatgcccggaagaactagaagccttgtcaagccgttgtcttagat

SEQ ID NO: 25692 - DNA, 2810 bp, Oryza sativa
ctattttctctagtactactaatcctgttgaagctggtgattggctgcatgctatagagagaagttggatttgcttcagtgcactgatcaggagaaagtctcatttgcatcacaccagttgcatggccctgcctctgaatggtgggatcacttccgcttgaataggactactgctgaacctatcacttggcttgaattcaccgctgctttccggacgacgcatataccatcgggagtggtgtctctcaagaagaaggaattcaggtcgctcactcagggttctcgctctgtcactgagtatctgcacaagttcaatcgtttggctcgttatgctccggaaaatgtgcgcaatgatgaagagcgccaggagaagtttttggaaggacttaatgatgagctttcttacccactcatgacgggggaatatcatgatttccagaagttggtggataaggctattcgccaggaagacaagtacaaccgcatggagcaaaagaaacgccggattgctcaattcaaggcacaacaggggaatagtcaaaggccgcgtcttactttgggaccccagtccatgccacagggaggttcttcgtctgttgttcgtccgcagcgtcagatcttcaacaacaatactggcaacaacatccgcaatcaagctccacgccctgttgcggttttgacacagcaacaacctgctaagagggagcaaggcagcaagcccgtggtgtgtttcaactgtggagacctaggacattacgctgataagtgtccgaagccccgacgcgtgaaggttgtccctacccagagcaactctaccgtaccagcatcaaaggctcgtgtcaatcatgttgctgctgcagaagctcaagatgctccagatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcctgttagaatccaaagaccttgatgtcatcctagggatggactggttagccagacataaaggtgtgatagactgtgccaacagaaaagtaactctcaccagcaatgatggtcgcgttgtaacagttcatgcattgttttttgagtctttaaggtcaagattgaaccaaatatactttggaaaagattcctatagtccgggagtatcccaatgtgttcccagacgatttacctgggtatccgccttaaaaggatatagagttcagaatagatttggtaccagaaccactccgatccataagagaccttatagaatggcagccaatgagttggcagaagtcaagaggcaagtagacgatttgcttcagaaaggatacatcagaccgagttcatctccatggggagctccagttatttttgtggaaaagaaagaccatacccagaggatgtgtgtggactatcgtgcactaaatgatgtgactatcaagaataagtatccgctacctagaattgatgatttgtttgatcagcttaaaggtgccaccgttttctccaagatagatcttcggtcagggtatcaccagttgaggattaaagaggaagatatacctaagccagcttttaccactaggtatgggttgtttgaatgtactgttatgtcttttggacttaccaatgcccccgctttcttcatgaacttgatagtaaggtgtttatggaatacctagacaagtttgtggtggtctttattgatgacattcttatctactcccgaaccaaagaagagcatgaagaacatcttcgccttgcactagagaagctacaagaacatcaattgtatgctaagtttagtaagtgtgaattttggttgtctgaagtgaagttcctgggtcacgtcttctcagcagagagtgccgtcgatcctagtaatgtggaatccgtaaccaactggaaacaaccgaagatagtttcagagattcgcagtttcctaggcctcgcaggatattatcggagatttatagagaatttctccaagattgataagcccatgacacggctgcttcagaaagaggtggagtacaagtggtcagaagaatgtgtcacgaccggaaataacccaacgggctttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcagaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaggacatttagttgctcaaagctattttgtaaacacgatcctagaactatacaatgttattaatcaaggccgtgaacccacacgaacctgccttaacccaaggcctatgatgatttagaccgaactggcaacccgaccctgggtcccagctcgtcctaagccaacccaggccaaccatttcacattttagttgttaagcaggt

SEQ ID NO: 25693 - DNA, 1911 bp, Oryza sativa
gttaagggattggtcatcaatccatacccttggataaatttcctataatagccaaccaaccctaagaatccccttagttgtctcaaatttttgggcactggccagtcttgcacagcctttaccttaccaaggtcagtagacacccctgccactccaattatgtgcccaaggtattcaagatgagacttagcaaatgaacacttgcttgcctttacatacaactcatgctgttgcagtaattgaaatacctccctgagatgactcacatggtcctccaatgtctgactgtaatcagaatatcatccccaaaaaccagtacacattttctgatcaaatgagcaaagattgtgttcattaacccttgaaaggttgctggggcatttgtcagaccaaaaggcatcactctgaactcatagtgcccatggtgagttctaaaagctctttttgcctcatcacattcagttaaccggatttgatggtatcctgatctcagatctaacttggtaaaccattttgctccagccaactcatctagaagctcatccacaactggcattgggtatttattcttttcagtaatgtcattcaatcccctataatcaatgcaaaatcttcaagaaccatccttctttttaaccagcaagactggagaggcaaatgggcttgaacttgactgaataattccctgattcagcatttgcacaacttgcttctcaatttcatccttctgttgaggtgaatacctgtatggtttcttatttactggtcttgcaccaggaatcaaaggtatattgtgatcaaagtccctgtgtggtggtaagctggtgggctcctgaaaccttgctacaaactcagttaaaacttctgtcacttgagggggtacactatctgattctgctgcatctttttttacaacacacaactgaaccatccgtgatacagctcctgatttaaccaacccagaaagttgttttgcattcaccaacttgtagtgttccaccctatccttaactcctgtcagggtaacccttttatcctggagattgaacctacgcttctttctcttccagtctatccacataggactgaattgctctaaccactccattcccagaattatatcatatccaccaagggccagcaccttgagatcagtaacaaaactgctcccttgacaccaccactcaacccccttcacacaactgttgcactgcattcttcccccatcagctatggtgtgagctgcaatttctgtaccaaatgttcagctatgaaattcctgaactgcctgagtccaccaatatcagtactcctatttgttgattaaaccttgcagcctgattgtttttcttcccatggtaccatgcacaacacattcaaataggaccagctcctcctcacttgtatcctcttcatcctgattagagtctgactcttcttcctgcacctggaacacctcaagtaattcttctactacatgcaattgtactgcctttggacacttatgttttggtccccactttctcaccacatttgaaacattcacctctagcctttctagctgccttgagggattcaaatctatcttcccatttagatttctcctcagtttgcttcccatcttctaaattagtacccaatatacccttgcccatatgagttgatttcattgcaggcttaaaagagtctctgaaactgccccctagagtagcttttcttaccagcttcttcaagcaattcctcctgtgtttgagccagagaaagagcagcatcaactgttctaggtttatgcaacttaatagcaagcttaatgtcagctttcaaaccacctacaaacctagtaacaaagaaggtttcatcataacccctattgtacaccaacactaaatgcatcaactcctcaaacttatt

SEQ ID NO: 25694 - DNA, 549 bp, Oryza sativa
attggtcgtgtcatttctgcgttcttgatccattcattgataagtctgattctcgacatcgtctaattgaatgatcgtttgtttttatgtcgattcttctccagtttgtgttcattctctgcaagaggttagtaatcctagtgctagtgaaatatttattattttgacataattatgcattgcaagcataactagttctcctttatttaggtagtattgacgggcgaaactgatcgctaacgaccatcagcacccgtcacactgagcaatcacagaaccacaatctagaataactagctttatacctgccaaagttggatgcgaccaagtggtgaaggtgagaacgatccgaagccttctagactccgacctgtcaaaccgtgcaatcacagaaccacaatccgggactaatccacacaagaggcccgatagccaaaagcacaaactaggggcaccagaggagccttctcataagtccaaaaggactcacaagaacaaaggggtaagacacttatgcagtcttcagcaatctctcatacataaggtttt

SEQ ID NO: 25695 - DNA, 1808 bp, Oryza sativa
aatgggttcattaatgttcaagttgcttaggcaaataaaataagacgggctccgacatagttacaccacacaccggtgtaaccatgccccacacaactcaaaaagacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacgaacaagctcgggcctggaggtgctcttgcgggcggtgatcttctggctgcggcagacgcggcgacgcttggggcggctgtcctctccctgggcgatcttgagctgatgcagctgcgcctccaacgcgtcgaggtccttcttgagctgcagattctcctgacgcagctccaggatcttcaggttgttctccaccatgccacggcgcaccatctgatggaagtcgatacgagccgcgtcgtacgcctccaccatgcgtgccaggtgcacgacggtggcgtcatcctccgagctggcgtctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggaatctccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgccccgcagctccaagacgaagccagtcatgctcaaaccacgacgggtgacgctgccggccatctacaaacaaaaacaaaaaggaaaacaacatttaaaagatcagattttgacgataaatgaagcagcaagacagagagagactagacaattttcacaagtaacaaaggatttttatttttgaaaatattgctaaggcttgggatctacggctcgtcctagggtcaagggaggctctgataccaacttgtcacgaccggaaatcacccaacaggcgttcctgacgtgcgtgcattattccttgtcccaggaggcaaggtacaccaaaagttgatacaattcagagtttatcaagcggaagcgtatataaaattattacacgggcagcgaaggcccaacacacaaagacaaacgagaaacagcggaagactagggcgacgaccacaggcgcttgacggcaggcacgagctagacaccaaagccttcatcttccaggaactcctcatctgggcttggggaaaattgagcaagactgagtacaaccaccgtactcaacaagacacacccacaaatgcagaataaatgcaagggagtacaagggaattataccataaaggggttagggttgcagtaaacagcatttaaagacatttagttgctcaaggccattttgtaaacacgatcctagaactatccaatattattaatcaaggccgtgaacccacacgaacctgccttaacccaaggcctatgatgattcagaccgaactggcaacccgaccctgggtcccagctagtcccaagccaacccaggccaaccattccacattttagttgttaagcaggttttaagaattaaaacactaacttgggtacattggtcggcttgcccataaccgaagggttcggctat

SEQ ID NO: 25696 - DNA, 2794 bp, Oryza sativa
tgacggccgggcccacctggcagccgcgagggcgcgcctgaaggcggcctcgccggcacgccttacgggaccggcgcgcccgcgccccgatggtcaccgccggcgaccatcggcgcgccggagcggcgcccgagagagcggagagaagggggaaagcgaacggcggtcttcggctcaccccgggacaacgacgacgacgagaacggcggccggagcggaggaaagcggcggcgcggttcgggatgacgatgacgacggtgctccggcggtcggcgggcgaagcggagcggcggacggggtcggcggcaacacggcgaagcggatggaggtgtcgccgagtcgggaggaggaccggagcgacgacggcggcgaaacggagctcggcggcgacggcggagagagaggagcacggcgcgagcacggatccgacggcgagagcgagcggcgagcggcggaaacggaagagcggagctcggggagcaattatatagcaccgagagggggagaacgcggccggagaggaaggaaacgggcgcggggatctcgggctccatagatgtcgccggcgaggattacgggatgaatccggacggatccgagggagagagagaggggaaatcgggggaaacgggagagggaatcacggggagtgattcccctctctttaatgccccccgggaccgccggatgccgcccaatccgcggcggccgccgcgctagggcacgggcccgcggcggaccccgcgggaggaaggcgatgacaagtgggccccacccgtcagcgagagtggcgggcgggcccgcctgtcaacggcgcgcgcgcgcgcggggagccgatgggccgcgggagaggagagagagagggagagggaagtgggccgagccggcccaagagggaagggggggaaaaaagaacttcttttagggttttctttttataaaacctttttaactttgttcatttcttttcaattattatttgtgctctgaaaattccactaaaatttatttacgcattttaggcttttagaaaatatacaaaaatcctccaagcctcatttgacttttatctttgcacattttaattgttggaggctttctcatgaattttaattattctttgcacaatttcgaggatgaattttagagtcgatttgggacgcgacaataacctagggtcaagggagctctgataccaacttgtcacgcccggaatttctagccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggggcagacggctccactccacaagcagcttgaccagggctacacctaatcctccacaccatcagcaccactgtagaactcttcctctgatgaatgattgcaaggtgagtatatgacatactcagtaagccacgcagcaaatatgcaagtgcacaggataacaaaggatgggatagtatagggctcatttgcaaaagcagcatttagcaaacatttgagaattataaaacagttaagtgataattaaacaatattaattcaacgctatacaacataccctgttgcataggcccaaccattctgaacaaccatacccggctgtacagatctatctgcaaaccaggaatgtaccattccaaaccaggagctaatcaaattattaccagttatagcatcatttattatggtgagaagtgtgagactaatcacgaaagacattgttagacccgcccataaccgcgggcacggctattcgaatagttttactctgatcagaggtgtaccactgtacccacaagacacagccccacatcatgtcaccatgtgccgcaataccaccacggtacctcggaaaggagctgtgacaatacccctcgtacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaagttttagtgggcaagtaattaattaacaaatcacgattgaccatcgtgaactatcattaagccatcattaaataatagtgagtcatatgttatcctaatagtgtgctaatgtttctaagcatggttaagcaatcacatctaatatctagctgaaccaatatatagagctcaactagtcaagttataataacccaaggtatcaaggaataaagtaatcaagtacaaaagggccataacaaaaaataggttaattccacccaatgacattcgaaaatagatgcaatagttgaatagaaacaatagctttaaataggatcaacatgctcaaagggttgtttgggatctgtgtgacttgccttgctggccttggaactcttcaaaatcttctcctgcgaaaacggactctccggaaacgtcggaatctaaacagaaaagagcaaaaacaccaaaacagcacataaacaagcatgaccagtacatgtggatatttttaatatgtagatctcaattttagaaaaatt

SEQ ID NO: 25697 - DNA, 21413 bp, Oryza sativa
gcaatatatcatagcagctggtatgatttgaacaaatttgctaacaaaccctgaactgtaaaaagtcttatgttgtctgacttccttgaaatgtcttcagggaagtttttgttcagtcgattattatttggtggctaaagcagatttcaaaaacctaatggcctattggattgaatagatctccactgttttctttgatgatgtttcagattgctgtgctggcagatgatatcttgaaaaatgttgagtatgatgctctaagggttgtttttaacaagttccactcggtcatatcattcaagcccacaatgacaaccatactttccccagaggtaaatatcggtgctgaggacatgaatttgtgctcctataaagtaatatgaatgatgtgacgttaatactagtggtttgaattgttttataggttatggagaaagaatcggaatctggtaaggttggtgacctggattcatatgaaattgaaggaggtgaaactaaatcagaaattcttcagaatcttaccgagttccagttttcttgtgtaagtttgtcttcattaatcatatatacctctcaatagatgaattagctacaactattacagccacaaaatcaagtcgcatccataagggtaaacgttccctttgtagagagcgcaatcattcttttttcaaggtatcctagtggtatcttatgtttttgctttgtggcaggttatgtataatgctgctctagagaatgcatgcagtgagcttggagcacgtatgtctgccatggacagctccagcagaaacgctggtgaaatgcttgatcgactcaccctcacatacaacaggtatggtcgtcttaccttctccatctgtttatgtgtgtcgactgcataacggtcggaaatggtcggaaacggtatcattattttattattttctcgaaacgaacggaaacggtcgggaaatttccatatttatgaatttatctatttagtgtcaacttcaatgccacgccgacataaattaaaaaaactaaattttgaatacggtaaccatcggttaaaatattattattatattagttttgcggaaatggtatcggtacggtcgggaaatttccataccgttttcacccctattcacatgaaagaactgatacattcgatttcatccccgcaggacacgtcaagcatctatcactacagagctcattgagattatctctggcgcttctgcccttgagggataatgatgaaacttttgcccatctttttttgttttgctgttcgaaaaaagttcacttgtcatatggagcagcctttccctcgagtggatcctcatgctaagttgcaataattagcccagttacgtgacggtgctatgcatatatcagaaatgcttgttccagtcatccttgtttatctgaatggcgacgtattttaaacaatcttttacagctgtgttcattttgcataaatgattgatcactgttctgcgttgaatttatctagagctttctcttttcttttttttttttgtgtccgcaaccattcatcggtatatcccgctcattacacaaattcacttatctatctgtttggtcagactgaatcgatttgtttagttggtcagactgaatcgatctgcttggttggtcagactgaatcgatctttttggttgggattcgtcatgtttgagatggtgggattcatctttggcgaatccctccccattgggagggataatgttaacggcgctgcttcctctctattcttcagcaattcgcccttcggctgcttgtgttggctgagagcctggactgcagttggcaggctttgggctctcaatcctccgtaattgctagttcgtgaccagtcgtgcgccagcccgcgcccgtgatcaccacttttatcattttgcctagatgagtttttgtcaatccatctatttcattctaggtatcttaatgtgtggctgaatctataatttatgcttgaaccacaatactaggtatgacttgtcccttaactcctaaagccagtgcaagtaagatcgcaaggtggtttagacggtgggttttactgacgtggtgcctacatgacgttgatgtgccaccaacatgatgacgttcacatggcacgttaaaagtaaaaaaaaaacatgggatccacatgtgagtgagtgtttgattaaaaataaaaaaattatagtagaaccctcatcttcacccctctccccttctctctcccttcgcttctctcttatctttgctctcttttgttggcaacattttgtgacaagtcgacaagtacgatcgcagcacctaaacgccttgcggtgatcctagagtcgtcaaccacttcgatctagccaaagggccaaattaagatgggttttggagaaaaacagctaaatcggttagcggagccgatttagagatcaaaatcagcctctaggccgatttagatcgatatgaggataactacccgtctcgtgggcgaaacggaaggtttccagtacaaacctacaaagaggtatcgcactctcgcagcggtggcggacggtttacggtgcaaaccgacaaagatggactaaactagggtaaatagaaaacatagtaaaagaacgattcaagtagattgtattcgggggttttacaatgaaccggccttgtcccttaaataggggttggtcttgccctctacaggcccttctccatgttcaactcgggatagaaactaaaggaaacacgaaacatgccttcccgagcaaggaaacccgagacccgacgaaaacagactcagactcggaccctgccggtctgaccgcccacatacctacggtcagaccggttctactagccggtcagaccgcccatatacgtgcggtttgaccggccctgtgaaggaaacccggtactttccaaactttggcaattttcccctatttcgtccataggtgccaaatttgggtgtaaacatctttctcctctcttctctctgctctctttctcttctctcagagcgtctattctctctcagagcgtaagcacggtggagctcgggggcagccatggatagtgttgatggaaaaaaacacactggcctgaaagagttgcttcactctagtgcatgtccaaatcttgctttcgagttcaatgcatgcagttggtttttatcctgcaaccaacaagaacagaataaaacagttaaatctgtaaatgatagtcgataagctagaaagcttatgacctatcgtctttaacctagccgatgctatcaggtatagtcacaaaagaatatgaacaaaccctaagtatgtcgtatcggctgtaaaggcaaacaatcatataatctctaaatcaatcttatctaaattatagacaaactgtatagatcggacctaaccgagacagtatggacttagagattagatatgtttatatctgttgtcgaatagacaactgcgtcacgtcgaaaggcgtggttctctcaacagtggttggaagtaagaacaattgtattacttagtgaaaatttttttggatcccccccattacatggtcttagggggctatttataatcctattacaggctccccttttagggtttaggttttacaggggaatttccatggttacccttatgataaggacattattaggggcacacaatgtcttttacatgtatagatattgggccataaatggcttggcccatctatttgctgaagtctcccgagggctcggcggtccgctgggcctcctggcgatgaggttcggtaccttggcgaaacccgtgcctctgtgccgaggcttttgcctcttcatctttgcccatgcggccctccgacatggtctccgcttggcgaagttgacgtattcctagctacggctttcgccatgcgcccttcgcccgttgtggttgtcttcctgaccttcgccatttgtctccggtccgggcttgtcgcctaagctcttggtttcggtggttccggccgaagggccccgtggtgtacctccaacaagcccctcacgggcaagggtgagtagggagtttcggccgagatcgtgcacaccatgttggtataccgcggggcgcctcatttcggccgatgttcctaccgaaacctgtcttctattctgcataaaataatatttcgatttggttgtcttggttttcatgcttgtgaacagtgttgggcttattgggccgaccgtttgcaatcttcggccattcactgtttcggcccgcactgatgggaaattactgttccatacactcctggcttacgtggcgggttttgattgggtggtaggcgaatcgccttgcgggtgagctatatataccccctcccattgctttcacttttactttcacccttagttatttttgccgttttccctgccgcccagaccgtctctctgcgcttaagagttttcgacttttaccccagcttgccaacccttaggttactctaggctcctgcgctatcctttcatggctcttcttcaaccaacggccctgacccgggaaaggtcggtgaagaccactccggatacctaggtgcctcgctcattgatgaggcggatttgacaaagcttgcctcggccagggttgtggcgagcggtcaggtcttcgcatctgccaaggctgttgtgccgaagcccggcaagaatcagaccgtggtctttgttgcctttttcgacgcagggcttcgttttccgtgcacctccctgttgccggaaatacttcatcttttcgacgtcgagtttccccaactcagcccttccgccctggttcggatcaatatcttcgactgggcatgccgaactgccggtttcgagccgaccgccgagctgtttggggcgattttctacgccattgtcaactcgaagacggtgactaccccagctggcactcagaaaaccgtcttcggaagtgcgaacttcaacattcgcccggagcgctctgacatatggccagtgaacgcgtccatgcccaagtgggatcggcactggatgtcgaaatggttctacctgttgatgcaaaaacacgaggcctagaagatctgcttaactttagtgcaggtccaaaaatcttgccttttaagttcgtgagcatgccagttgatttgatcctgcaatcaataagaaataaagacaaataaaccgcggttaaatccataaatgatagctgatcggctaattgccgatgacatatcatttatctctgagccaatgtcatatttgaatcgattggcagaggtaaataagtaagaaaggactaaatctattcgatcggctgtagatattaacaatatataatccttatgtcgatacatacttaaatcaagtgattgggatagatcggacgtcatgccgagacagtataaatcatttagatcgaaatatatattaacaatgagattatagatgctcatagcatagccgatcagatagatcagcatgtatcggctaatactccgataccactctatattaagatattaatgcaagtaaattatatcaagaaagaagtgtaatatacctagatgcaacaagatcttaacataaagggcggatctagcatgtcaattaagcacataaaatataaggctaaatcaggtaagaccggctgaaaccccgatactactctaatcggcaatctaatcggcaaccaagaagcaggctagagattaagattctaatcacgacttataaggtcaaactcatctgatgcagctataagtataaaaagaagaacaatatctagacaatcaagccatttgatgtttcatagagtggtggatatcctatataatctaagccaacgttgctacttaacctaatcggctgccttgcaatgatagatgttagccgattgaaggttaaataacgatattgtcgaagattatacagaatatatgataactcgatgaattacataaacaagattagagtatcatgaagatggaagcactaatcccgagaacgcaagccgccataacaagttttacctctagttgaagatcgaaaccaatgcagctcaacccgaaagcaagaactcgtcgaaacaaaacgaaagtaaaagggtggcgatgcgccaagattgtattgaacgtctgttgtttattacatggggctcggggtctatttatacccgagattaccatgtcggacacgactcttatctctaacaaactctaagataccataagtgtttgcgacagacttttgcccaaacatatctctaaggaaattacatgaaatatcctaattaatagatacaattgccttctcaggactcaatccgtgcatggcaatcctcatgaagcacattaactcaacccgacaacgtgtaccgcgtcacattttcggactcgggtcaatcggctaaccctatccaactcggattctgccaatcccggtcgcagccgattcagactttagccgatccttgctctgttttcggaacgatttccatcttggattccgcctcagttttatctccatctccgatattgaaattaccaagtttggttgttaacacatgccctcaagtccggaatatttggtaatgtttcggatttgccatatccgttcctccaagaatatctctcattgccgtttttccgaccgttatcgcctcgctttaaatactaaccgttgtccccgagaaatttcacaccgttagctccgttttcactgcttaagccaactttgtcttctctctctccggcgatcccctcggcgcaccaggcgatcccaaggcgatttcctctccggccaatcttccgcccgcagagatgtcgtcatccgccagtccgtccgtcgcgccatccgccgaatatgcagaggtaagtatccatcggctagatcctctcctccgccagtccgttcttccttgcctcatcttgtttccttcttctctattcttgtttacatctgtagcacttgtccaatctggtcgcgaccccaagtttgtcacatgagcatcactattttcttggttcgatcggcaatcttgatcccactgagttcatcatcgccgaaaccaataggatcccttttagattggccaacccaaatctaggtcactggaagaataccttcaaatcttggccttctcttgacaaaacttctcctgagaaaagttgggctatgtggtataagcgcgtatcggctagcaagcaagttcactgggacgaattaggaatcggccaagcgcttgctcttactctagcaaattcggccaaggatgaacccctgatggcctccgcagcatacttttggtccaacacccttaaagctttcttgttcaaccaaggccgatgaccccaactctgctcgacatcactatgattactggattagatgtgacttcatcggctaatcctatgagcctgaacaccaaaaaccaatttgacttcaggaccaagagcataggtggctggtctggctatgtagcagcatacatgggcaaaggatctgtcaccccccgagagcacactgcctttctcttgatgtggctcgagaagtttttgttctgtggatcaagttgcggccttaccaccaactggcagttcttagctgaagcccttgaaaccaagagacaattcccattgggcaaaatccttctcgactatctatatcagatgttgagcaacgcatcggctaagatagttacaggctcagtattaagtgcaggtggaccatggaggctgctgcaaacatggctcaaacttgtcatcatgaaggttgtgaatcggccacctttgatagacgcagaattcccaaggctggagctgatcacaggtgatgatggagaggaactcactcaccgccgatgcatgtcatatggagaagctgcatcgacaccagccgattttggagcaaagctatcggcctaactgctcaaagactggttctgcagtttctatgagggcttccaaagagatgctcgagtctggtttccatatgaggactcagtaaactttgatctcccagcagacttcaaatttgaagacatcaactctgaaaaatttcaaaaatctagagaagtcttctcggctgctattagtccatgcatccttcctgttggcatccaccaaggaagaaatatacaagtgtcctatgagttctatcatccaatgagctcagctaggaaatctggaatgggacagttaccaatcggcttgttctttaccgataagattcagtgcagtggagaaatctcatcaacattgatgatggatctgctgctcaacatcccaggacctcccttggccagtatcgagaacatagaactggcaaggttcaggagcaagaactttgatagatggtggggtgaatggaagcaacacatattccatcagtcggcctctatttacatgacagatttgtttccagatgttgtcccccaggtacattttactttgtcaattctgtttgaaccattgttagccaattcatattttgactaatctccttctttactttgcagacaacaaaatcttcccctcctcgcacaagcaacaggggcaaggacatagaatatgctccaggccttctaccaaatggaggtgaattagctccccctgtcatcagctaccatgcccccaggacctcaagtctgcttcaagggcagatgagataaccggccgatgtaggcaggaagaggaaaaccaaagcatcggctattgatccatcggctctggctcccaagaagaagaccaagaagaataaacccaagccagccgatgacttgcctaccttagatccatctatcgagcaagccttggatgaagaagaaatcggggaagatttcgatcaggcagcagccgaactgagtgatgcaggagaaaaaacaccatcggcttcgcccaaacaaactcctccaaatccagctgctccagctcacttttcaagggtaaaccacttgccttgattactttttgtaatcatttcatttatagcagatcactcataaatcttgcatttgtagaaaaagaagactgctgtgaagaagaaatcggcaacaacaacacttaaaccagctccaccagtaagattttcctatacaaatcctttaactcatctaatcatagctgatatttacttaacacttgtctttttgcagcctccttctcctccttcaccacctgtgtagcaaatgtcaagtgaccgtaccccatcggctacagcaagtcacaatatcgaggaagaagaacaaccaaccgctcctgctatcccagtaagtctctctttatcataagatcttagatcggttgaatttgtttaatatttaacaatcttcaaatttctcttttgcaggttttagccgatctattctcctttgacatcaaggattactttgatgaagaagcagaagaagaaaccacaagcaaggctctagcccctctagatgaaactttcaagaaaacacttgaagatatatcccttcggttagagtcatcattagataatctggtggccgactatggttcaattcgggctcgatttgcaaaaatccaagccctaatcccagatgatctggcaaacaccatcactccagcggtgtaccttgagcaacatcaattcaagctggagaaggctaagcaacggatagccgatcggcgggagcggaaggacattaaagccactatccaagccaatcggcagcttgtgcatgaagaaaaagccaaacttgattagctctctgttgggccgattcagtctaacatagattggcttgaagcccgcaagattgatctaatagctcaacttgaagaatgcaatgccgagctggatttggagaagcaaaagttagccaatcttccaaatgctgtcgaagaacaaaaatccagacttaaatcagctatcaagaatgtggctgatatgaccaagtcctttaaggccatctttgcaaccgatgcccaagacattcaagctattgaagaagtagatcaaattagacaacgggctgtatcagctatccagcgttacctatctgcatgattggtcttgtaataggtcttagaacaatttttgtaatcggctactgaaactttgatatccctcaatataatttctctgtaccgatcaacataacttttaaatttgctcaaaaatttgcaaatttgtatatatgtgcacgctaattttgcaatgacaaggcattgataaaattataatttggactaaggtcgatataaccatatcggccattgtatatcggcaaaacacaaccgattacaacaagaaaataactaaaggcgatataaccatatcggccattgtatatcggcaaaacacaactgattacaacaagaaaataactaagggcgatataaccatatcggccatctcaaggcgatgtaaatacatcggctatcatgtatcggcaacatccaaccgatcatgtatgaacccaaacacttgggtaacatttcttcaagtatttgccgtttagcgctcgtccataaacttctctataagctcccttggacacaaccttatggatttggaacggtccttcccaattcggtgaccacttgccgaatttgttatctcgagtccctattggcaaaatcaatttccaaacaagttcaccttctgaaaaagacttgggcactacttttttgttgtaatgtcgagcaatcctctccttatctttggtaacttttgcaagagctcttaatctcgattgaaccaaatcttctttttcatcggccataaggttataatactcatcggctgtcaactggtcatgcaaatccattcttcttgagccgattctaacttcccaaggtaacactgcctcatgcccataaacaagcttataaggaggaacctgaatcggtccatgacaagccatccgataggactacaatgcttcggccaacctattgtgccattgccgaggataatcagaaatctttttcttaatcaacttaatcaaactcttgttagatgcctcggcttgcccattagcttgtgcataatatggcgaataattcaacaatttgatacccatgctatcggcaaactgaacaaactcatcggacacgaagatcgagacttgatcggttgtaatggtctgaggaataccaaatcaataaataatatgctcttgaacaaattgtatagcatcccccgaatcaactttcttcaaaggaatcgcctctatccacttggtaaagtaatcggttgccaccaatataaacttgtgtcctttgctcgatggtggattaatcataccgatcatatcaattccccaagctctgaatggccacggtttgatgatagggttcatagctgatgctggtgctctctgaattgctccaaacttctgacaatcttgacatcctttgtaatatttgaaacaatcttccaacattatcggccaaaaatatcctgcccgcctaagagaccacttcatattatgagccgattgatttgtgccacaaattccttcatgtacctctcctatcgcaaccttggcttgatcggcactcaaacatttaagcaacaccccatcaatcgtccgataatacaattcatcatccaacaaggtgtatttcaaagctttatagcgcaattttcgtgaagccgattgagatggattctgcaaatattgaaaaacatcatatctccaatcatcggcggttatcgtagcaacttctactttgacatccttcatcatcggcttgaaccccaatgctccttgagccaagtccattagcttcaacgttttgctctcgagacacatgctgcaaagtcaccagccgaaatccattcatcaattcttggcacttctcattgtaaaccattaatgtatcattcttgcactcatattccccggccaattgacagatcaccaacaaggaatcacccataatctcgatagcatcagcttcaacttccttgagcaattgcaaccctttgagaactgcttcatactcagcttgattgttagttgcatcaggcttaatagtataggcaaactcgaaacttgcccccagaggagaaattataaccaagccgataccacaaccatgagtacacactgatccatcaaaaaacaaagaccaaggtacaatttcaaccgagccgattgagtcatcacgatgatcaacaataaaatcggctatagcctgccctttaatcgccttcggtgattcataccgaagatcaaattctgtcaaagcaaatatccactttccaacccttcatttcagaatcggagccgatagcatatacttaactacatcggctttacatatcacagtgcattcattggacaatagataatgccttaaccttgtgcaggagaaatataagcacaaacacaaattttcaataggagaataccttgtctctgcatccaaaagccgacggctcaaataaaacacaactctctctttctcttcaagctcccgaatcaagactgagccgattgacttctcaccagccgatagatataatctaaaagccatccccttttgtggaggaatcgaaactggaggagagctaagatattccttaatactatcgaaagccttctgctgctctgctccccaagtatattcttgatcggccttcaatctcaacaatggtgtaaaaggttctaatcttccagacaaattagatataaaccttctaacaaaatttatcttgccgatcaactcctgcaactctgttttgtcctccggtggttgaatcttcttaattgcattaacactcatctgagttatctcaatccccctttcatgaacaagaaatcccaaaaactgaccagctgatacgccaaaagcacactttatcgggttcatcttcaggccatactttctagttttctcaaaaacttttctcaaatcggctatgtgattctcaatttcttttgacttaaccaccacgtcatctatataaacttcaaccaaccagccgatcagatcatggaatatataattcatggccctttgatatgtagccccagcactcttcaagccaaaagtcattacaacccactcaaacaagccgattgcaccaggacatctaaaagctgtcatatgaatatcttcctctgccataaagatttgattgtaaccagcattaccatccataaaactcaatatctcatgtcctgaggcagcattaaccaactgatcggcaaccggcattgggtactcatcctttcgagtagccttgtttaagtctcggaaatcaatgcacactctgactttgccatttttcttgataaccggaactatgttggaaacccactcagcatatcggtatggatgaataaacccagcatcatacaaacgtttaacctctgccttgacaggttcgagcatataggctttgcatctcctcggcggctgctgatatggtctaacccccggtttgacagggagccgacattcaacaatcgatcggctgagtcctggcatctcgtaatactcctaagcgaagcaatctccaaattcttttaacaactctaacatggttctaaattccggagataaattcttactgatgaatgtcggtcttggtctatcgcctggacctatatcaatttcttccaaatcatcaatcgacataaaaccttgtccttgtttgtcatcgagatcatctaccgtgtccttggtgtagacatttgaaccctccatgatgccctaaaaacaataatttgggctctccatcttcaattggttgtatatcacaaccggacacttttagaaaatctcaatcccaaacctttccagacaagcaatcaataccgtccatatcccaaagagctaaatcggcactggcaacgttaactgacctgtctactggcacgatctcaatcttgttgccttgccattgaatcaagcattgatgcatggttgtcacgtcctgataaatgcatcccaaaataaaaatcatcttctaaaaggaataatagaattaattaaaattcgaaaagaaattggcaaacactaaaatacgtacaagaaaaattcaaatgtggcccggagaatttttgttaaattctccttggtccaaaaggagccctcaaattttagtggaattttcaagagcacaaataataattattaagaaataaacaaagttgaaaagattttataaaaagaaaaaccctaaaagaagtcttctttcccccccttcccttcttgggccggctcggcccaactctccctccctctctctcctctcccccgcggcccatcggcctcccccgcgcgagcgccgctgacaggcgggcccgcccgccaccctcgctgacgggtgggacccacctgtcatcgcctacctcccgccgcgcccgccgcccgcccgtgccctagcgccgccgccgccgcgaatctcgccgtttcccgccgtccccgcgcgcaataaagagggggaaatcacccccgtgattccctctcccgtttccccctcttttccctctctccctccctcggattcgtccgatttgaaacccgcaatcgtcgccggcgtcttcaatggagccgagatctccgcggccgattcctctctctccggccgcgctttccccctcccggtgctatataatcgtcccccgcgcttcgctcttccgtttccgccgctcgccgctcgctctcgccgtcggattcgtgctcgcgccgtcctcctctctctccgacgtcgccgccgagctccggttcaccgccgtcgccgctccggacttcctcccgactcggcgtcacctccatcggcttcgccgcgtcgtcgtcgacctcgcccgctccttcgtttcgcccgccgaccgccggagcaccgtcgccctcgtcatcccgaaccgcgccgccgcgttcctccgctccgttcgtcgtctccgccgtcctcgtgtctcggggtgagctgtggaccgtccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgtcctcgcggctgccaagtgggcccggccgttagccgcccgcgcccgcgggtgcggctgacgcgtgggacccacggcgccgaccgccgccagctgcgtgctcccggtccaccgtggaccgagaggctgacgcgtgggccccactcccgtggacccggtccgcgcgccctctccctcggctgacgcaataaatgggtttttaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctctttgtggaagttgaagccggcgtttgggaaagcgagcaaggcaagtcacatcatccttgaacatattgaatcccagtttgtaaaattatgttgatttaaattattgcattatcgctttatttaaattcccgcgttatcactgttttatctagccatacctatttacctttgttatgaccttattattattgctattgttattattaccttgtccaccctagaataaacaaaaccctaactagtggacattatattcatggttccactagtataaatctaggtagatgcttcgctgattaattaggcaacattaggtggttttataactttagactttgggaattctcataacatttggacactgtggaatggttggcttgtgatggaattgaacacacacctcccccctctattcaaaactcccaaaatggttttaggctgggctcgaggtgcagggttttgctagtagcacctcggccactataaggaccggtcttcgggcctctgttgcaaagcactaccgtactaaccacatgtctaatgggtaaggcttaactcggtgctcagtctagtcctgaacaaaatgacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatgtttacaacgggttccaaggccatggaatgcggagtaaagatgtgtcttgtgggtaaagatgtacacctctgatcagagtaaatctattcgaatagccgagccctcggatatgggcaagccgagcaatgtacccaagttagtggtttaattcttaaaatttgcttaacaactaaaatgtggaaaggttggcctgggttggcttgggacgagctgggacccaggtcgggttgccagttcggtctgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggccgctagtccgctgctgtttatttttgattgtcaggccttaagcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatatatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccgcatgttgacccaaaagaagcaagtatcatctgttttatgtgtgatgagcaagggcactacgcaaggaactgtcctcagcagaaaagaaaagcaccaatgcgaaccgaggatgaagtccgtaagatgatcattaccagcacagaatggcctccaccaggaatgacaaaacatcagagaagaaattccttccgaggtgcacaacagttgacagagcatcttttagctaatggaggtagagtgtctggtagtgaagattcagatcaagtctcctcagatgatgaagatgagaagtctccccaaggttttaaccagaataaaatagaacttaaggcatgctctcgttgtggagaaatcggtcatgttgccagctcgtgtgcctctacatgcgttcattgtgaggaagaccatccgcccgacaggtgtccaacgaacaagatcacttatttcttttgtgaaggaactgatcatgtaccaaaagattgtcaattcagttttctgctgacgaagaagatggccaaccaacccgccagttccaacggagagaagcatcaaggcaacacaaatccccgccaagatcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagctgacaagacaggggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcatagcaaccactctctgcatcgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaatgccagctatatctctccagaatcaaaatgagcagccatgtttgtggttttcagttcgctacttatcatggtgtaatcgaaagtttgcagcaatcatgtaattcataaatataatcatgtctgtaaacagtgagcttgctatgtttagagatgattcatgttgaggatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatgtttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgaaccacatcaaggtttcaccgaaaggcagcaagccaaaggacctcatcgtccccagaagcgtccgcaatccacattaaagaataccacctgttagagataagccgaaagatgattgataaaagagattggcaaagatgttctctagcataaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaggaatgaaatcttcaactcggtatcagatgctacacgaagtgaaaagtgcaagcaccggttaccaggtaatgccaagtcttgggagatgatccaatgggaaagaacacatcaaggttaaaggtgtaaaggaatacgttgaatgctaactgaggacaacctgaagacaataatgggaagtaaactgaatgtaaagaaagtgaatccgagctgcttgttcgtgagagccattcccagttatagaaccagtgatatgttcgaagatagtctatagaggtcagattaaaatcacctctcacaacgaagcctcagatttgacagggtaatgattagacaataacaaatccagcaataaagccatgggagaagacgtcaaagtatgtcaagtgggataaattggttctcttgggaagcataacttatagttagagtggttgacccttgcatcgaatagccgaagtacctagcaccggagaccaggaaagctaatatgagacagttgatggcaagttagaagtgaatgacaagcatgatattcttatgatgacaaacatagtatcctagtaatgacaagctagtgttgacgcatgacgtgaagtggtaacttgtctgaggttgactccgaagatatgaatcatgagaagttctggaacggaagcatcactgcactaccgcaacctagtctgagtcagccaaaaggtgcaccctggtccaagtcaggtgaagaggagattccacccgcaacaggaggtcaagccaagcagttccgagtggtgaagttttgctggaagtttgtcaagacgcaacggaagaagtcaaacaagaagagaagaccgcccaacctatcttcttggtagcctcctcgaatctcggggacgagatttttgtaaggggggtggatttgtcacgtcctgataaa

SEQ ID NO: 25698 - DNA, 3939 bp, Oryza sativa
tatgtcacatgtatacaacgggttccaaggccatggaatgcggagtaaagatgtgtcttgtgggtaaagatgtacacctctgatcagagtaaatctattcgaatagccgagccctcggatatgggcaagccgagcaatgtacccaagttagtggtttaattcttaaaatttgcttaacaactaaaatgtggaaaggttggcctgggttggcttgggacgagctgggacccaggtcgggttgccagttcggtctgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggccgctagtccgctgctgtttatttttgattgtcaggccttaagcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaatggtcgaaggaatacaacaattaacatgaatccaatctcttccaagcaacaagctataggaacccttcccatcgatgacaaaaaatgttgtagggacggttttgctgccgactgtcagctccacattcaaaaccccttttgtttccgatggattgccaccaaaatctttgagcaccatgtttgtcttgatgagatcatccgaatttctgcctagcttcctgaatgtagcatatggcatcaagttcacagcagccccacatcaaccatcatcttagacatcggcttcccaatgacatagccgttaatgtacaatggtttgagatgccgattgtctgtcccttttggcttctcaaaaactgcttgctctagtgacaaaaccaacctagccgaagcttcctcgacttcatcaacatcggcttgttcagctccaaattccgcagtcaatgtaaaaaccaagtttaccgatgcagtcacgacactcttccctttagcaaacctttttgcttcatcggctttgacctcatcggctgtggcagcttggttcttaacacgccactcttgcctcggctttgttttcttcagccgattgttagtctcctgttctacctcatgaaagcgcactctgttccttaacctttgaacccttctcttctgattcttcgtgaaaataccagaagggcaccattgagcttttctgtcctcatcatcttcttgatcacagtcttggtttaccggcccaatctttgatgaacaggaactcttgtttgcctcagccgattgcttctattataagatcgacttgagctccctgcagcctcgctgcatccagggcaatcttcaatagacggcagcctcatacctttgttccagcagaatctgaaaaactcgtagtcccaatgaggatcaaaatcaccatcaattttttcataatacctttcctgctactgcttgtcatatgtcctctaatacttgttgataattctagccgaattcatctaaaagtttctatttttgcctccatcggctgtcctcccagatatatgcaccatgttcaccgggaaaggattaccatcaaccttcatcggcttctttgagtcatcaaatttaatctttcccccttcaatggccacctggatttgctgcctgaaaactttgcagtcattagtagaataggaaccagagttatgccatttgcaatacctcctcttgcctagttccaaagccgatgatatcaaagtcaaatctctcctcttttccagaactcttccccatgggcaaggtacaacctatttactcctgacccattcggctgccgctacttcggaatcatcctcttcatcagaaccatacatgtaaggatacacatgattgattttcttgaaattcttcttggcctctgcaaacctttgctcatgcagagttaccttccgtgcatggtgagataagctttcaaactactgggatgagaatttctctttaatcggagctatcaaaccctgaaaagctaaatcggctagctgagaatctgttagagccaagctgtagcacctattccttgtttccctaaatctctgaatgtagtcctgcacagattcaacatgcctttgccgaattgctgtcaagtcagaaagtttcatctcatgaattccactgtaaaaatagctgtgaaattatttctccaaatcggcccaaccattgacagaattgtatggcaaagaagaaaaccaagtaaaagccgatccggatgaggacaaaggaaacaacctaactctcagggcgtcaacagccgatgcttcaccacattgagctaagaatcggctcgcatgctcataagtcgaaacattatcttgccctgaaaattttgagaagtttggaaccttgtatcgagcaggcaatggaaccctctcaaaccactcaggatatggatgccgatataagtttccagtatccttcggcttaagcccaaattgctccctcattacatctgcgatcatatcagcccattgtctctgctgaggtgccccttgcgtctgctgctgtatcggctcaaactgattaaactgggagcaaactgaggctggggtgaccccccttggtggacctgaggtgaaggaggctgataatgataattcaagtgacccccgttgtaattctgagtatttcgttggatgttactgtcacaccctaaaaatcccaaatatataaattgttgtttaattggaattattagaattgattttaaaagtctagaaaagaagatctaattttaaataataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaagtcttcttttggctttgggccgaaagtcggcccaaaaccctctctctctgtccctcggcccaagtccgcccagtccagcagcgcctgcccgcgcgcgtgcgtttccgtcgctgacaggtggggcccgcctgtcggggtcgtcgtcaacctccagccgccgccgcccgaaaccctagccgagccgcgccgccgtctccttccaaattcggccgatcctttccgtttccggtgaaatcaattgagggaaaatgatcttcgggatctcctctaccttttctcttttggaatcatcggctaaaatcgcttggaaagtgtttgattcgaggtcgattcggatcggtctctctctctccgagcccgagctttccatctcgccgccggttgccgtgggcctttgccgccgcctcctagcccctttaaaaggatccccggtgtctcctctacccgccgccaccctcgccatcgcctctcgtcgccggtagcgccctagcgccgtgtaacctagcgccgccgtcgtcgccgccgctccagccgtgcgccgccgccgttccagtcgtcgccgtcgctcgggaaggtcgccatcgtggtcgccaagtcgtcgccatcctcgtccgctccttcgccgtcgctgaagactgccggaggaccgtcgccgccgtcgacccgatcttctccgccccttcgacctcaacgccgtcaccgggtgagttcgccgggtcgtcctctacccg

SEQ ID NO: 25699 - DNA, 618 bp, Oryza sativa
tcatccatttcgttcttttttttttctaaaaaatatattttctcttgtttggaggggtatttgtctgatattttgccattaaactgctttttgttcctgcaggaatctcttatggtactgatgaccagagtctgaaggaagcgtttgctaactacggtgaagtcattgaaggtatgtctcttgtttttttgttttttggtttttgtttttttttgttcatattgatgataagcatgttcctatacgtatgaacaatcagtagtggtgatatttttcagctagggtgattgtggaccgtaccactggacggtcgaggggatttggttttgtaacctacacatccacggatgaggctgcagctgccattactggcatggacgggaaggtgtgttgtgcaaactttgttatatctattggtttgcaattcaacttctacttgaggtttaatgcataggtgttttatgtctaaattaatctggcatccttatttggtaaatatttaaatcaatttgacttatgaatgcaatgcatatggtgtatcagtatgtggtatggttgcttcaaaggcactctagttggtactgaagatctttactttgatgtactgccttgcaaagt

SEQ ID NO: 25700 - DNA, 1249 bp, Oryza sativa
actgtgatgcttcgcgccaaggattggggtgcgtgctcatgcaggacggtcatgtggtagcctatgcctcacgccaactacgacctcatgaaggcaactaccctacacatgacttggagttagcagcggtggttcatgctctaaaaatctggcggcactatctcattgggaaccgctgtgaaatatatactgatcataagagtttgaaatacatcttcactcagtcagatctgaaccttcggcaaaggagatggttagaactcatcaaggattatgatgtgggaattcactatcatcctggtaaggctaacgtggttgccgacgctctaagtcggaagagccattgcaatactcttaacgtccgtagcattccgcccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgcaggtttcacagaggatgaacacggacctctatggaacggaaagcgggtgtgcgttcccgataacagggaacttaaacagctgatacttcaggaagctcacgaaagtccttattccattcacccgggcagtaccaagatgtacttagacctgaaggagaaatactggtgggttagcatgaagcgggaaattgcagagtttgtggctctatgtgatgtgtgccagcgtgtcaaggcagaacaccaacgaccggccggacttctccaacctctccaagtgccagaatggaagtgggatgaaattgggatggatttcatcaccggacttccaaaaacccaaggtggatatgattctatatgggtaattgtggatcgactaacaaaggtagctcgatttattcctgtgaagaccacttacggagggaacaaactagcggagctctacttcgctaggatcgtgagtctccatggtattcccaagaaaaatcgtatctgataggggaagccaattcacctctcacttttggaagaagctccaaaagagctgggtactcgattgaatttcaacaccgtctatcacccgcatacagatggacagaccgagcgtctaaatcatatcctagaagatatgctccgcgcatgtgtcctagatttcgggaaaacttgggataagagtctcccctatgccgagttctcctaaaataacagcta

SEQ ID NO: 25701 - DNA, 747 bp, Oryza sativa
catgatttggagttagcagcggtgattcatgatctaaaaatctggccgcactatctcattggggatcgctgggaaatattttccgatccataagagttggaattactttttcccccagtcagatctgattcttcggcaaaggagatggttagaactcatcaaggattatgatgtgggaattcactatcatcctggtaaggccaacgtggttgccgacgctttaagtcgaaagagccattgcaacactcttaacgtccgtggcatcccacccgaacttaatcaacagatggaagccctgaacctaagcatagttagtcgtggatttttggccgcgttagaagccaagcccaccttgctcgatcaaatccgcgaggctcagaagaacgacccggacatgcatggactcctcaagaatatgaaacagggtaaagccgctggtttcacagaagaggaacacggaaccctatggaacggaaaccgggtatgcgttccagataacagagaacttaaacagctgatacttcaggaagctcacgagagcccttactccattcaccctggcagtacaaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggattt

SEQ ID NO: 25702 - DNA, 12196 bp, Oryza sativa
agagaaacaaaacaatatagttcatcccactggtggaatttgggtattgcggggtaatattaattcctctaatgttcttcagtgtagctctgaataattcgtgttcctaggttgttacaattggagaagtttcgaattttctcaacatgtagaacatcggatcttgattaattacttctgaatggaatacttggccccttttggttcagttgttctgaatggaaatcagattctatcaacctaatcagttgtttaagagcaacagagccaagcgtgagcaccatcagaatgaccgaagctgctcaccttgattaggctaaacctggttcatctaatttggcaccttggtcaatataggtcgcctgaagtaaattttactcttattttatttatttgtaccatatgtacattaaattactacttgtatatatgatttacggtgtttgaaaattttttatgtgtgatgaacttgtgaagtaggactacccagtgaaaaatttctggctgcgccaccggctctagtagctttcctttcctcttttgtaagctttgtacttttattagaatactcttttttatatatttatggtattgaaatactttccgagtatataaatgccaactttactttatgttcatgttatactaattatactgctagcttatctggtagatgcataggtacgggtataatgtttgcttatgcaattactctatgtcatgacgatgatattagagtagtatatggtagtttaggtgtggtgtctagattacgggatattattatttggggttatatgctgcggatgagaggtggcccactgatggtgacagctcagtacgggtatttctccgcgcgtgtatatagtcctaagttaatttcctggggagggtactcctccgcatttagccccggttgtatggtcataacggactgtcgtaaggaacttggcagtcaagggtggcttctcgaagtaccaggagggcataggatagagggtattagctagttaatcatataactagaatgtatatatactatgtatactagaagtataagaatagattctcttttattctcttttcacttagcttagatattttagggctcctttgaaacaaaggaaaaacggaggatgtgaattcctatggattcattcactgtagcagcctttgatttgtaggaattggtcatagaaaaactgaaggaaatattccttcgttgctgattctacgggagaaacacaggaaaatttccatccagtctgagctcgtttttcacttgctttgcgtaggatcgaggcaatcaagctcctaatctctttcttcactgcaggagaacaagcaatgaatggatataatttgtgttagctgcagtatatttattagaaatagaaagtgggcccaagttcttaagtaaatattcttgtgtttttcctataccccattcaaacgcatactcctatacatttcctatggttttacattcctctgttttacacgtgaattcctatcatattcccgtgtgtttcctattcctgtattttttcaatcctatgtttcaaaggggcccttagtatgagaatgagtagttccctgcttgtgtgtcactctatcctttgatttatcttaacccccgcttagactatggtttattacaagtaacatataaattattagttcggttatctctactatgatcttcccacgagattaaataaatatgatacccttggaatactctcgagtgaaatgctacaatggtttatccgtgcgcttgcggatgaactctgtaaccataatataccaggagtatttctacaccattgctgggaattatatttctagtaatgtcgttaagaaataccaacaattatcttatatgatagaaagcgcaatttggatggggtgtctcttggatggggtgaaatttttagtaggggtgaaatttttagtaagtattgatcaccttgaaaggaaggtgttgcctagaggggaagggggggtgtgaataagtcttttatgaaaattattacaactttaaagcgggttaataagcaatcaaaactttgggttcaaatcagagtttctgatatgacattggagtttccgatatgaacctaaagttttaaatcggagtttctgatttgacatcggagtttttgatatgaagtggaatgttcaacaactatgagagaaacactatctatgaacttttagcttaaacaaatcatatgtatatgaatcaaaaggtgataaacaaaatatatacacaatatatatggtcaccaagtactaagcatacaaatagatcgggtaagaataaactaaagcacaatatgaataaggcaagaacatacaaaccaaaagaggagacacatgatttgtttactaaaaattcggatccactgatccaatgtctccattgaggagccacaaatgccatatcctcacaaaggtggtgtttgaatctcctgaagatgaagatgaagattaagtgtttcacgcaaacgatgtggtagtaacgtgtgattaattgaattttaattattacaaacttgaaaaatggattaatctgatattttagaacaattttcatatagaaagtttacgcacgaaatgtatcgtttagcagtttgaaaaatgtgccattttaatccaaaagtttatcctcaaacttcagaggaaacgaatagggccaaagtcttcacaaaccatagatgctcacaagtgactcttagctatctaggagacctcaatctccaagagcaacaaatgaccacgaaatttgttgggatatgaactctaatgatcaagaaacaagatttgttctcaccactagaaacccaactcaaatccacacccacaagattcaaatcacaaaaatcaaaggggatttaagagagagataaatcaataatcaaagcacttagcccaagcctcaaagccacaaagaatcagaatgaaaagggctaacctgacaaagggtttgattgggggtttaaatagatccccaaaatatgaccgttggggggaatatttcagcacacatcagatagtccaattttatcgccctccaaagacaaataagaacgagagatagagagtgaagttcaataatattttggactctctaagacatcgaacaatttgatttaacataggatagtctgatgtgtctaagcacatgtttctcgtccttaagcaaagacccaagtttggtgatatttcggattctctggatcatcgcatagtgtgatgtatttcgattagtctgatgctgctcaaataaaaaggcaagaacttttttactcctgagtctgatttcgatgattttgggctctatggaaagcttgttttgagagataaatcaaacccagcgtaaagatgattcaaaaacttcaagagatgtttaaaagaaaccaagtgtaagtgttgtgacatgtgaaataatccggagttggtatcttggtttaggttttttaactcacacaatgataaataattttgagcacttgagacataactaaggcttcgctataggaaagtttctttaaaaaatcatattgatccatttctcaagtttttgttagctatcactgaattaatcatgcactaataagttgattcgtttccgttctagagagaattgtttcgaacagaccggttcgaatgcaacctaaccaaacacgtttgcatctcttttgatagtatggcattcatatactcaatccggttttactataaacaccaagaccggtaaaaaggctaaaaaaacttttactataaacaccaagaccggtaaaaaggctaaaaaaacatacttagctttattatacctttgccttgtgcacatcctcgtggccttagtttgttgaaaatgaacatcactctctttagtcaatacttaattcatcatatgatgtccggtcactttcatttatttaagctacttgatgcccttcaacttatgccatctatcctttgcctttcatcaatctcttgatgtagatcaaggcatgatatccatcttttagatctttatcttgagtctttaggagtcttgatctgacttgagcctcaaacatcatttttaattcttgagatctatttcttttattcaactaaatgacattgttagtccaaatgattcgattgtcaacctccacttgttgaccaaccaatcgcatatacaccacgtgtcatatagtcaaaatgtaaagttcccaattaagtttaagggattagcttggctcaaagacatgcataactaaaatatagaatttgcttcccctaaatatatctatataaaatatttgtgtgaagcaagagtatacattgagatgaaacattgggagcttattctataccaggatagaggttcattatcaacaaaattaaatgtattgggggttcaaaattaattgtattggttttaatgtcatagagacgacgagcaaaagaaaaatagcaaaaaacctccatcaccggtggactccaccctatcctctgcagccagccatatggagcacgatgtgcaaatgtaggacctgtgcagcccatcaatttagataaggtaatattggagattatatgttaatttgatttgcaaaaataaattagggttcatgagtaaaggtaaaggagagtttttagattggtgccattttaagctattggtaaaattgacaaatatatagctacatttagttgttaccaaactttggtaatgcataggaaattttggcaacaacacattgatcacattctaccaaaatttaataatgttgttaacttgccaaaattttagcattaccaaaatttaccaagattaattttggcaataatatgaaaaacccttaaaccaaggaaaaagaaaaagtcgagggggtgatcatatggatttatccagtatgaaattttgctcctgagtcctaactagtttgctctgctgagccgatacaataaatatttgctgatacaatttacgaaaatgcccctgagaagaaaaatcctaaacctcaatcctccaacttctccccttcctgagcagcagtcgcctcaagggttttgccacccgaatcgccgccgcctccgttttctccaggtaagagacgcttccaaccctaatccccccaacaccatcaacggatccacccactggttgtccgcctgcttctccccgccccaatccaccttaggaatagcgcctggctggatcccaggccgtttgcttgtttgcgtccggagattggagcgccgattgggatgaaaccgatcggcccttaatgtttatttttccccatcacgcgattgtatttgttgcctccgagagattctgtgctgttgctgaatccaattttcgtgtgatttttggcaggggattctgagatatggccttcttgcggaaggttgggaacctcgtcaggcagtccgcaggctcgggctcgccgctgttccaggcggtccgatgcatgtcctcctcgaagctcttcatcggaggttgttgtcgttttctctgttcctcactgctcatccatttcgttcttttttttttctaaaaaatatattttctcttgtttggaggggtatttgtctgatattttgccattaaactgctttttgttcctgcaggaatctcttatggtactgatgaccagagtctgaaggaagcgtttgctaactacggtgaagtcattgaaggtatgtctcttgtttttttgttttttggtttttgtttttttttgttcatattgatgataagcatgttcctatacgtatgaacaatcagtagtggtgatatttttcagctagggtgattgtggaccgtaccactggacggtcgaggggatttggttttgtaacctacacatccacggatgaggctgcagctgccattactggcatggacgggaaggtgtgttgtgcaaactttgttatatctattggtttgcaattcaacttctacttgaggtttaatgcataggtgttttatgtctaaattaatctggcatccttatttggtaaatatttaaatcaatttgacttatgaatgcaatgcatatggtgtatcagtatgtggtatggttgcttcaaaggcactctagttggtactgaagatctttactttgatgtactgccttgcaaagttaaaattctgaattccgtcaactccatttttctcttgcattgcaaagatttgttggactgactaggtgatggatgaaagttaagtggttggaaagcgtttgcactgaggagcttggctctcgcactcgcatattaggctttctgcaaattgataaggtaaatgaatataaagtttctatagaagtggtgcagtgggaacacaatgtgaacattcagaattgcatatgcactgaaccttcatggctcgcactgatccaggagccatgtgcaatttgcattgggtgccgtgcaccttcatggttgtctgtgggtttcatcaaaccggttgtgtgtgtgtgtgtatgtcctttttgctgtgctgagcagtctgttgtcatggtccacacgcagagacatgaatggcctgttgtcgttggtgcctctttgcaagtgtgttagacaaagccttcgtagatagatatctgctctgagaccatggtactaaatattggtggtagtgtcacactattgtggccacaattgcaggtggggaatgacgtggacgatgtgaggtctaaacccgcaaacgctaaaccacgcccttgtcgttatcaaccgtggcacacccgactgacctattcacgaataatgtttcctgcaatgcaaacggagaacacaagaagaaatagattgaggcaactcaggtagctagataggtaaatgcgcacaaatatgaagaagcaaacttatatttgctagataatgaagtggtgaactgatagcaaagaggttctgaagacaaactatgatctaattgatcacgaccaatatctgggtgcatttaaagagcaaaacacaacctaaaaaaaatctatgaaaccctgaatgggtacctagctatttaaagaggtgggaggacgaccaaagggcacctagggtcgttctctaccaggttggtgcgcactcatgttgggccaatacttggaccggggtcccagacgaagttacaagcccaatggcccatgataggtggcgcaacaccttgttttttcaattgtggctggttcagatggaatttggagacgaggctagatccgttttaaaagatgacttcgagggctttccatcatactagttaggtgcccatgcgttgctatggggaaaatatagatcaaccttatcgaagctcaatatggttgtgctgtggaaaacaaaatcaaattatgcttctttaaatacaaaaattagttagtgcatcaggaagcagtcaaggacatcacagcatgaaaattatcaaggagcatgcacttgcaattagatatttatgtactgataatgtgtctagactatagagggtcctgatgtgtgacatttctctattttcgtctactgataatatccatcatcaaaacttcatgttatatgcctataataggctatatatatatataactgaatattatctcgagagattacaactgaatttacatgatcaaatccaattcattaagacataaacaaatacaagtaaatttctggataatgcactaatgctcatagccatctcttaagagattctcaatacaccgagttgtaagtttgcataaatatgctgatctttaagaaacatgaatgaatcaccgttaattaggtactgtagcaagctgacattgtctgtttgctgtgaatcagacgttaaaaaacttcaaaaatcacaacactgctcacctctgacattattgcaactaaaataagaggagccttgtcaaggtgattgtctccgtatggtagattgccattaatccgtccaattctcaattccattatactcgtatctgcatcaagccgaagagaacaatcaactttgcactcttcaattgttttgctagtagcctttctatcaacaagaggacggggaatcaaagatgcaaatgtcaacttttatgatttagtgtaaagcccaattgtattcaattatctagcgacaacaatgctgataagtcatcggaaggaaaaaaagaactccattattgactatagaacaaatgtcagcgtataatcacttgaattgcttatatagaaagtatgttgatgacaacaatatacagtaaaattagtgaccgctacatagttcatgcactacaacatatttattcttcccctacattaattttgattactcagaagtgttttagcaatggaattttctttgcagccacatgacacggtttacgttttttaatgtacatacaattgcttgatataagggagttcacagttaacacaaagccatgaagactcagatttttttttcattttttattttttaattttattaatagacctttccgaaaactgaaccttttggccacgctggctggcagcgttgttttgccacgccagccacggtggcgtgacaagaggctggcatggtaggacaacgctgccatgccagctgcgcatggtgtgacaaagtgatttggccacgccaggcagtctggcttggccaaacgtttcagatttggaaatacttttcggaaaggtctattaataaaattaaaaagtaaaaaagtctaaaaaataaaaaaatttcgaggactcacctgctgtgctaacttgcacctctatccacaaaaacatgcacctacagctgtaaaaataagatgggagacagaatgattagcttgttgcaagacatttggttggcatacatgagtgcctaatcctgagaaagggcactgcatggtagtagaggaattgtccatgcacttatgatgagtccccgcaatagttcaagaggtaaaaagggattataattgtgagtagcagaatccttcaagcaaaaccctgcataggcaaaggattagttggtgagatttacatgttatgtatcaaacagagaagattagtgccacaaaaagattataattgtgaaatgtaagttactaaaagattagcagcttatctttgagtagcacacatctttaggactacttatatactatcttttgctgcaaaacagcttggcaaattgataaaattggcacaattctgcttgactatattagaaaattaactaagcagaaatatcgatcagaaaactataacaagtacatctgttagtaaatatgttcctaaattatggaagtcactggaacattgataacatcactttgtatggcagaattcatcagaatctaaaatctacttgagatttattattcctgtggtttgttcagcacaatactgtagtgctgaaggaaatcattggcataatagtggtgaactcatgtgtgtcatgactcaatcaaaacaatattgtgttattgatctttgagcatctcaggaagaagcaattctgccatgatgtccatcttcgctttttactgaacatattaaaattaaagaccctaatgtcaatcaaactgtcattaacaatgcaaaagagaataatattttgtttttcaacccatacatagagatgaaacatttgcagtaatacatatacttagtagtaaagcctcacattttattaaattatcaatgctatgaaaaatgaagaaaatcgagcagttctttcaagttatcttttttacataaatgtatgaaaacactatgcaggcatattgtgccagttatattttgagttttactaacatccataataccgctaaaagaaaatatagatcaacgagtggatttaggagctacttattccatcaaacgttgatgtgtgcaagacagatctttcagatccaaccttttagtcaggcacaatgatctgaaaaagatacatgagataaatggtcaacaaacatcatggaagagaattagaatttttaagtccatcaaatatgataatttttattttcttaatccttcaacaaaatctacataggaaatggtaaacataacacatgaactacatccttttagtacatctagcacaaagacaggtgttaattcttttcctgtgtcgcatgccaaaaaatttagatcggttacagccgagacaatagcagtattcagattagttaactgaaaggcctggaaaacatctaatgcggagaaaatgaacttcggcctatgaatcattgacctcaccttcattgctgctggttcagcaaaaggttggctgcctgccgagctagggcaaggctgcagcccattctgctgtgggttcctctattcccctcttccacgcccattgccagactgcctgccctcatgccttgcaccatgtgggaatggggatggtgaccgaggatagactgatagaggaaggactgatgtgcagcggtggggaaaaggaaggcatgaggtttgaaattctcacgacatgtggtgggaagctgtgtgatgttggtcggatgagtgagcaagcgacagcagcctagtgccgtgcgggggttgctagggtcagggtgagcgtgcgatatggtggatttggcggtagaggtggtggctgagatagatggtcatggcggttcgacccttgctgttgataaattggcttcgcgtgaaactgagtggtgaggggagggatgaccaacgagcggaggctagagggaggggagtcagcttggtgcaccgaagaatgacaaccctgatctagcaggctgacggcaaaggagttgggtgaatgacgagggatgtagcggcatggcgagggttgtgtcagaccggcgggcgtgggcacggctacagcagcgtgttgatggtgaggaggggaggggcgaaccaagcgagagggccgtcggcgtgaatgggagggcaccggcagcacgacgatggatatgttgtatcgatggacatggagagtgggatgatggatgaggcgaagacgctgcgtgggtagaaggcgtgcgtggcataggtgaggagcgatgcggaggtgttacgagctattctatctagcgatccatgcgtctgccgtgtcaggaatcaagaccaccactacggattttaagtagtaagactcatggacccaaaacggagctagtttgcaaatttggcggctgtttgaagtcaatgctatcttgggaggccgaattggattttccacaatgtaggggacttggtctctatctcgtcttgcaccatgagtgatgtctccaactccattatatgttcccaaacatcgagatcacccctgaacaaataaatgtatatatttcaatcactagttagcatcatattcttaatacaagtaaattggccatgttaaggaacgagttcaccggttgatatatgatggaaacaatggtcggatccatactgttcttggtgacatcataccgctgccacaatgagctagcagttctaaatagcggcgtggaacacagtggctgccattgcagcccgagaagaaaataacggccactattgctgcctgacaagcgcaatagtgaccgctattttgcacaaaaatttgaaaatttaaatttgaagtttgaacttgttattttcaactgattattgttgcttccttgcctgaatatttatatgataatgaggatctaaatatttattatcttatcgattgatatcatgtttcatttatggagatgtagtgcatatatctatttgaaccttttatactgggtttagacttggtagtctttattttgttatgttaggagggtcatgaactcatgatacatacacaattaacatacaattttgagtctcttccatccgttattggaatatagtggccgccatctgcaatagcaaagccaatggatgtgcaggatggccatgctttggttgcagccagtgtggaactgaatgttgatagtcttgggatcttggcaggacagttgcacagggtgcataatggagcatgtagtgaagtagtgcacttggttgagctgcatgtcaccaccaaggggatcagcttccacgatcaaggggggaatgtggaaaattgttgaaggggtacccccaggaaaaagaaaagccgctaagattgagtgttgctgttggggttggcgagttcatgtgaagaaggggattggtgagttcatgtggtttgtcaactcatgattttggtgagaggagcata

SEQ ID NO: 25703 - DNA, 499 bp, Oryza sativa
ccgattttaaataggggggcaacattcaccggccccggccccttcggggccccgccacccgatcggggccccgcaataagagttaccattccatccaaccaaaaaaaaattgcaaaaccatccgttgattcaacaaaaaatcttgtacaccatcagcaattcaagacttcagcaagaccactccatccaaaaactaaatgcacaatcaaaatacttgatagcagtagtagttcatgcatcactaacttgtgcctgcctgctgcagtgctgcccctcgcagacagctgctcgtcccgcttgctgccccaatcactgcttgcatgccgcccggctcaccgcatcgcttgccgcctgcacaccgccctgcttgccgcctgcacaccgccctgctcaccactgcgccgcctcgtgccctagtccataacagcctgcctgcgcaccttgccgccagctgttgccggtttgccacgctgcccgatgcgtcaaaggaaaaaggcga

SEQ ID NO: 25704 - DNA, 1119 bp, Oryza sativa
cgtgtatttggccacctttccggccagagccaactcggcctgcggtttgttgccccagaggaggacaacagggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaat

SEQ ID NO: 25705 - DNA, 2294 bp, Oryza sativa
  unsure (1)..(2294): unsure at all n locations
catgtccaagtctacgatgccaaaacatcacatctttatcaaacttagcaaccaaacatgttatcacaggtgaaacaagattttcaaaatcagctttaaacactcttccatagcgagaaatattcaacacagaatcaccacaagaatcaaaaactttacttctagttttcttaaagtgaacctcaaaatttttatcaacaatttgtgaaaccgaaagcaaattgtactttaagtcctcaaccaaagctacattcttcaattcaaaatttttatttacctttaccaaacctgtagcgagaacgacacttgtagaagcatcaccaaagataatcgattcagtcttggatgccttcttgatagaggagaaccaatttttatcaccggtcatgtgccgcgaacaaccggaatccacgatccacacgttctacttccttgccaccaaagcctacacacaagcagaagtcgaagcctcagtactggggttagataataataaaaatttaagaatccagtactgagacacacgaccagaagatctaataggcatatatccacgtgcaaaatcaattttagaattttcagaaaaattccaccgaggccggtctgaccgaggtacagtggccggtctgaccgggggcctttgtaccggtctgaccgcctttgtaccaccggtctgaccggtgctcagcagccggtctgaccggtcgccggtctgatcgcgggacccactgcggtctgaccggtttcctcgagggaaaacccgattnttgccactttgattttgcagaaccaatctctctctcctttttctgtttatgagctaatctgaaacaaaaaccaacaatatgtccatctttgccacaaaaagaacaagtatatttttcacgatgattagacacattggaagcattaggagatttagcaacacaagcaacaacaggagattttgaatgcacaacattggattttgaagaagatgcattcaaggtagacatgataccagcagatttaaacacagttttgttagtattaggtttaaccaaaatctcacttctagcaccaacacctaacacagcaggaggatgtctagaattatgagcataaggattaaaacctaaatcacggttatgtgtgctaacctttgattgatccaaaatcatgttgaggttctttttaccattagaaaatcttagcaaagaatttttcaaataagaaacctctttttccaaattagcacaattttcacaatctaccatgacacctttgcttttacgacatttagggcaagaaagcacttcattgtttttcacaacatcttccatgtactcaacacgacctaaagcatctttcaatttcatcttattcaaatcacatgttgagcaaaccaaaacatcatgaggttgttttaactttttagcagaaatcatattaaacatcaaactagcatgaaaagcaatttgatatttttgcaacaactttttagttaaaaacaactcatccaaagtgcgtgtgtgcaaagcaaaactacaggcaagagaagatttatttttcaaatcatgtgcagcattaacatctctaatttttgaaatctcattcattaaaacctcacaattttcgcaatcatcatcattaggaataagagattttaatctagcaatttcagatttaagagattcaatgataaattcctgttttctatatacatcttctcacacttcttattcttttcactcaaaatattaatagcttcctcaaaagcacttacctcattatcttcatactctgtgtcagattcaccacgcgccatgaagcaaacatcggagatattcattcccttatcatcatctccactttcaccatctacatcacttagtggctcgaaggcggcgcaaacttgttgaaaagccttcctgagattctccagcttcctctcttggtatgaacccttcggcttgttgttgttgttcttctcatcatctttgtcttctcttttgcctctcccaagcttaggacaatgcgaacgaagatgatcaattgaaccacattcaaagcaacgatttggaccacctcttttcctgttcctggcattattcatagctcgagcaattctatagcaaccaaagccaaatcctcctcctcaatttgttcgagttgatcatcggatgtggcattaaaaacagcaagaaaagaaggcttagatgaagaagcatcaatatccaaagaagaagaagaagaagaaaccaaagcactcaacttataatcaactttccgagaaagaacattcatctcatgtg

SEQ ID NO: 25706 - DNA, 89945 bp, Oryza sativa
  unsure (1)..(89945): unsure at all n locations
tgatgaaaattactcaaagcattccatatctcatgagcagttcgaagatgagcaacacgatcataatccgaacgagaaatcccactcaaaagaatattgcgagctttgcaattttgttcaaactcagtttttaaagcagcagtattaatctcttcaggaatcacataaggataagaaacttttctccaaatatcataatcttcagccataatataagattgcatcttactataccaatgagaaaaatccgttccgtcgaaaacattaggcttagttgaaaacctagtaggagtagccatggcaaaaaaaaactctagatcgataaaaatccaaagaagaaaacaaggctctgataccacctgtaggatcgaaacacaagaactaagccaaccagagggggggtgaatggttggtatacccgaaaaccgaaaactttttgcggaaataaaagttaccctcaatttcgatgagatcggtctaatcggagtagattagccggtctgaccgaagcgtagccgccggtctgaccggtgtggatctaccggtctaaccgccaaaattcgtcgctgcctcatgtcgccgaagccggtctgaccgctgtgtgcccgccggtcggaccaccgcgatgccgccggttagaccaccgaaacctggtgaaacacaaaacgaagaactcttaaactagatgacaactttattgattctctctgtgtttacaaagtgcaccaatagcactccttacaaaaatttcgactaaactcgaaaccctaactcaaaactcaactcaattgctgtcacaccccaatctggtaccgccgtacaacggcacctgactggagcatgtcgtaggaaaaacagcgcgaaccgcttcatacgaaaccgcaatctcagtaccagtcccaggacatagcgctggtacccacagtgacaaatttgaatcattgcaaatccttaacataaatagaggacttatttaccttaacttagcttgcagctcagaacagcccgagaatgcaaccgacgacgctgacgaggaaacaccaacaacagcagcagcagcggaaccaacgaacgaacacccaacaccacaggcgacggctgggaaccaggacgaaaccctaatcttcacttcactttatcttctcttcaggccggaggaactatatatatttatatagagcaagggtgagtactttggtactcagcaagtcacgggaacttaggtgtttaatgcaagcttggaagagaggcaaggttgttttgcaaatcttttgtttgaaatcattttgaaatcactaagtgatttatttctttttaagtttgggtcgaaaaaagacttgcgtctcaaatcgacttaagagatgcttttcaacagctcaattggaaatgtaccgacctcccgggtcagatcattacttctcggctcccagagccatttcacttgattaagcggctcccagagccatattcgtttttgcggactcccagagtccagctgcccagcagcaaagcaatccgtttccactcgggaaacctagtctatgatgcccgcaaacatcccgaatcacacagattcgtttctgaccactcagttcatccatctgccacataggctgattctggttacgattcccataccacaacaacttttcacaaagcacatgcaaacaaatctacgcaatgggaaccacctcacatccgcccatgaccgtgggcatggctgttcaaacagttagttaacctctgcagaggggtacactttacccacaagacacgaacttactccagacactggccggtgtcagaggttcgcgacaaagccttttccaagccgacccagggatacctcatgccacatagaaggatcaaatcctcacataaatataggccattttagacattcacaaatcaactccaaccaccttgatcggtaagtgagcaagcttctcgtccttgccttaccaggaacccggtttgtccgaccccgccccggcgttcccaactattggcatgcgaggtttccctgaacagactagttacttagccagcgtgtcccattccaccttgtggttgcactttgattatgttcgatgagtttcccacaggaatcggtccttatacgcgaatacgggacagtgccacataggcacaacccccgcatcgcgagttttcacaattcattttattttcaaacacaccgacaccacatgtcgggttttcaaggcttctcaaacccattttccaaatttttgacaaacaacggtgtatgtgggataattggtatacgcgcttagagagcacggataccgaagtaccacaatggtggagcgacaagggatcagggtatgtcagcctacaggaagtagtgcgactactgggtaggtccgtcggtttagcatgcaaaccgaggccaagcaagttaagtgtgtgattctaataatgcaagttgcaaacaaaataataatgatttttcaattataggagcaattggtcaaagggtgacttgcctagctcaaggtcttcacggagcttcacgaatcttcgagaaaacccgcgatcgacgaaaatccggtaaccgcaactatacacaaacaatcaaaaacctaaacaaaagaccacaagaaagatcctatttagactaaataatagtgccattaaatagatctcaattttacggaaatactggaagtggaatgaagtcaatcggacgaacggatcgagagatatgaattttggaatcttaactggaatttctggacaaggaaatgatttattggatttttctagaacacgagaaatggtttatggaataatattctcaagaatattattgatggtcactgacgtgcgggaccaaaggaaatgattcatggaatttttggaataaggaattgatttatgaaaaagggaaaaggatttattaatccctttggataagaaaaggaaggagggataggaatcagactttctcgagcgacttggcgcggcccgagaggatttgcgcggctaggccgatcttattaggccggcacgggctacggggaggcggcccaagagaggggcgcagggagagagagggggaaggggagccgggtggaccagccagtgtctggagtaagttcgtgtcttgtgggtaaagtgtacccctctgcagaggttaactaactgttcgaacagccgtgcccacggtcatgggcggatgtgaggtgattcccgttgcgtagatttgtttgcctgtgctttgtgaaaagttgttgtggtgtgggaatcgtaaccagaatcagcttatgtggcagatggatgacctaagtggttagaaacgaatctgtgtgattcgggatgtctgtgggcatcatagactaggcttcccgagtggaagcggattgctttgctgctgggcagctggactctgggagtccgcaaaaacgaataaggctctgggagccgcttaatcaagtgaaatggctctgggagccgagaagtaatgatctgactcgggaggtcggtacattaccaattgagctgttgaaaagcatctcttaagtcgatttgagacgcaagtctcttttcgacccaaacttaaaaagaaataaatcacttagtgatttcaaaatgatttcaaacaaaagatttgcaaaacaaccttgcctctcttccaagcttgcattaaacacctaagttcccgtgacttgctgagtacgaaagtactcacccttgctctatataaatatatatatatagttcctccgccctgaagagaagataaagtgaagtgaagattagggtttcgtcctggttcccagccgtcgcctgtggtgttgggtgttcgttcgttggttccgctgctgctgctgctgttggtgtttcctcgtcagcgtcgtcggttgcattctcgggttgttctgagctgcaacctaagttaaggtaaataagtcctctatttatgttaaggatttgcaatgattcaaatttgtcaccgtgggtaccagcgctatgtcctgggactggtactgagatcgcggtttcgttggaagcggttcgcgctgtttttcctacgacacgctccagtcaggtgccattgtacggcggtaccagattggggtgtgacaattgctctctaaagcgataacgggaagcctcacgctccccctctatttatacatgaggtaggcagcctaaagccatgaaccaaactcatactaagagtcctaaacaccttaggaaaccctctagtacaagaaacaaactttacataaccaatcgtaccaaatttggactccttccaaattcgactccgcgtcccacacgcacacaatacctccatcgtatgccatatggaatctccatcaaccacgtgcatcaactctatcctaagtatcccgcatgatctctgaccaccacggacgtcgtcttatccccaagccgactcccggtccatcaccgcaaatactctcctgaggcatcgagtcacctacacatgaaataaacaaagaaaccatattccaagaccaagctatctccaacttgactcattagtagcaaacaacagtattacatacgtatagtatccatctagaagccataatcatgaaacaatcacggatatccaaacaaacaacccgaaaccgaaaccgacacagcgtcggccggtcagaccgcgggcttgccggtctgaccgcgcatataccgccggtctgactggcaacacctgcccagtctgaccggtcacataaaataatagaacctgtgattcacctgtaaatccaatcatctccaaaaccacttcgtgaataaattccaaataacaaaaccaataatctccaatgcccaattattcatcacagagtaataatcaaaaacacctttgattttacataatcctgtaacaagtttgcaaaaaacatggctatccatttgttgctatctcgttctttcaagtaaatcctgtaacaaattaatctgtctttctaatccacctatcttgttgatgtacttttttttctctcatttttgttatccatttgggcctgcattcacaacacgaaatgggctacaacgaggtctaattacatcaacgtcatcaatgatattattcagaaaggaactaactgatggcccattggtccaagcccacgatcaggacatgattagaatttagaaaggcgccgaaacccaagatttcatttgaactaatcacaacagattgcaacaaaaagcaactgcagattagtacttctgaactgagtacaacagcaccaattaacctactcccaaaatggagatgaatcggactgttcatccaaattcatcaaatttgaaaggaaacgaaaaggggaaaatgggctgcaaattaatcctgcgggccaacagagacatacaaaaaacaacaaggtttctctgaagtttgcctcatcagttgttggagcgctcttaaaaataccgaaacactatcggctcgatcaactcgttgagaggagccagctctgccctgtcgatcaaatggaattcctgcaagtaaaaaattgtgaagcatagcagttagcctaagatgaaaagattcaattaattcaacactgagctacagcaagatttgatggacaaatgtgcatgccttgttttatgtgattcgaccctcattttacaactaaatgcaagtatttaaaaaggaggttgagatcaaactaaaaacatcatcatagcctcatagggaacaaataatgcagcaaatggaatgcttgtgtgtccccaacaactccttaatttttacaaagatggttcttaagaacaaaagttgactttgcatgcagaatgatggatcacaactgctaaagaactaaactgattcaaacaaattaggaaaggcatttgaatgattgcaccaaagacattcctttatttttgcattccaatattccattaaaaaaaacatgtggctcatatgtggtgttccttcaatcttaggcagacataatgcatttgttcccatctttgttccttttgaaaaaaaattgcacatataaggattatcattaatatcattccctcaagatctctgagagagagagagagaagaagaggaagaagaagaattaattacccaagtgaagagcacaaagtgcttgaagcaagtgctgagatgggcctcctccttgagcttgaggatcatctgaaaatgcgagtggtacatgtgggagtacaccctgaagagccgcttgaagatggtcctgatcacctcgcgaaagttttgagggaagggagcccctgcaatttagtcagttacattaattgattgacgatttctccatcaaaactcatcatcagcttaactaatctgctactgtagtgtggtgctgcaacgaacaaattaattaacgattgatcattctcagtcagagattagcttaattaccaatcttttgagggaaaatggcctcatcatcaagctggctctccacccaatccatcaggtactccacgtactttggagcagacacttgaactggcttcttcaccttcattccatcagcccacctgtactcgtacctgcatttgtcaacaaaaattgttttcgttccttagttctcagttatttcagagaatacatctgaaacagtacatgatcgatttctgattcagaaatattcttgtgtaatactccctccttccctaatggcccgtttggttggagggagtttttaggagggattgggagtttaaagggatgaggctattaagtgttttgtttggttgggagacatgggaatttaggtgggatggggatggggaactaaggaaggaactccctccttttcaatacctgggtaggagcaggtaattgggagggaattccttctttactttgtctaagcaaatctcagccatccgtttttattattgacctaatcttcaactaaactccctatcaatttccatcacctctaccaaacgagatattgggattaaaaattaaattctcatcttaatctcatcatcaattccctcatgtaaactcccaatccccttccctcgagttaacaaacaagccgtaaatgtttgacaccgttgacttttttaaacatgtttgaccgttcactttattcaaaaacttttgtgatatgtgtaaaactatatgtatacataaaagtatatttaacaataaatcaaatgatagaaaaagaattaacaattacttaaatttttttgaataagacgaacggtcaaacatttttaaaaaagtcaacggcgtcaaatattttggaatggagggagtatgttggttcgctggatttgtaggagtgaaaagattagaagtgatatctacatactttggtccggcagacatgatcgggcaggtagatgaagtgcagaactccatcagggttccgtacagaaagttcacttggttgaagaagtctacggctgcagatagaggacatcagaattcagagagtacatgttaaaacagcagtgcaattagggcatccacattgttggctttttagccggtaataagcaatacatgctctcttcctacccggtaggaagcattgtgagagtggcaaaaagttaaaatctggtcatacagctactaccgatgaacaagagataaacaatattatttgtacagtgtttctgacagaactcgcgggaaggagtcacgcagcagtcatgggaattttactatcggtgatttttttttagctgggcccaccttattcctctccaacacgcataaacaatgtgaagggtgcgatggtttaataccatctgaccccttggcccacaatattgctgaagtcggcaactaacattgcacttgcccttatatttctagtgcgtcaagtcacgactgattttactgttctttgataagatactaccatattttctaatgtaaaatttaatatctctatatactagtaattatcttaaaatataaaattttgtagtgaaaaatttaggtacctcaagataatatcgtaaaatatctcaaatcaccgactaaaaatgtcaaataagaacagtccagaaaagtgaactacacatgacaacttgactgcatgttgcttcacaatcagagactagcaagttcctgctacgtataggaagtgataaagctctcaatgatacgtgccatactgccagcctttcttccattcgatttaaatagctaaaataatctattatattattaaaggaatagaaaaaggagcctccacgtacgctctcatggcctagaaattctcacattaatcggagaaaaagaaaaagcagaatccatatagaaatacaatttaaaaatagctgaaattcggaattaaaaataaggaatattagaataggagactagagtccatatagaaatacaatttagaaatagttgaaattcggaattaaaaaataaggaatattagaagaggagactagagtccatatagaaatacaattaggaaataactgaaattcggaattaaattaaggaatattagaagtagagtatagagtccatatagaaatacaattaggaaataatagaaattcggaattaaaaataaggaatattagaagtagagtatagagtccatatagaaatacatttaagaaaaaaatagaaattcagaattaaaaaataaggaatattagaagtagagtatagagtccatatagaaatttaaaactaactataatttggaataaaaaggaacctccactttcgctctcatgatctagaaattctcacattaatcagagaaaaagaaaaaacagagtccatatagaaatacaatttagaaatagttgaaattcggaattaaaaaataaggaatattagaagaggagactagagtccatatagaaatacaattaggaaataactgaaattcggaattaaattaaggaatattagaagtagagtatagagtccatatagaaatacaattaggaaataatagaaattcggaattaaaaataaggaatattagaagtagagtatagagtccatatagaaatacatttaagaaaaaaatagaaattcagaattaaaaaataaggaatattagaagtagagtatagagtccatatagaaatttaaaactaactataatttggaataaaaaggaacctccactttcgctctcatgatctagaaattctcacattaatcagagaaaaagaaaaaacagagtccatatagaaatacaatttagaaatagctgaaatttggaattacaaaataaggaatattagaagaggagactagagtccatatagaaatacaattcagaaattgttaaaattcggaattaaaaaataaggaatattagaagagtagattagagtccatatagaaatacaattaggaaataactgaaattcggaattaaaaataaggaatattagaagaggagactagagtccatatagaaatacaattaggaaataatagaaattcagaattaaaaataaggaatatgagaagtagagtatagagtccatatagaaatacaattaagaaaaaaaagaaattcggaatctaaaaataaggaatattagaaatagagtatagagtccataatccatataggaatttaaaactaactaaaattcggaataaaaggagcctccacgttcgctctcatgacctagaagttctcacattaatcgaagaaaaagtaactaaaattcgaaattaagaaaaacatgggaagaaaagtttaaagtcaatatagaaatacaatttagaagtaactgaaatttgaaattaaaaattaaagaatattgaaagatgagtttagagtctacatagaaatacaattagaaataataaaaaatcagaattaaaaaaatattaaaagacaagtctagagtccatataggaatatatataatttacaaataactaaaatttgatattaaaaaaattaataactaacacgtatataaaatacaatatgaatattacacattagtagtttcgtaaagttattgcaaaatttaaaattatgttgtcattgtaatatattttaataatataatgagaaaacatatatgctattttatgagggaaaatataatgatgttaggcacgcaatctgcgcgggccaccatgctagttaaaagtatttaataaaatgcatcaatcttgttgtttcacctacatgcacggtcagattcgagccatagaagggcacacaagaacaacaaattcaattccgaatgtcacggcacctttcgtagtcttatttaatttgttgtttgtctgttctccttctgtagcttgaatttaattcttcatgtttatttaatattatgcattttttagattgttttcacaattatttagattggaatgaaactatgaaagaaacaaggacatattcttcagagctttatatactctctctcttactagataaaagaagtggactttaagccctctaaaacgtgccatcttttcttgcattcaatttaaatagttaaaaacattaaaaacattcagcaaaatagattgttggatcacttatcattgcacagtcatacaaggccaaattagagctacagaagggcacacagaaacaacaaattcaataagtatgaatatgattgcactattcacaatctggttttgttgttctcgtgtgttctctttgtgtaactctaatttaattttgcatgtttgtgccctattatatgacatcatgtttacttttctttacatggttttcatatttatttatttagatctgaatgaaagaagcaatgacccatattcttgagagactaacatatatactttctcctaccatatagaagtacaacagttagaagttagaacaggatccccagatcattacatcagaggttatgatgaaattggtactagttgagatggtagcttactgttgacagcgagccattcgttgagatcttctccaattggcagacggaccgcctctcgcaggtttccgctgcccagggtggcgtcgatgtgcttcttcagcggcaagccctgcaagcaagcatcgcgtttaatttgttggaaactgaaacacttaacagtttcagaactgagcacgcaaaaagctaaaccccggaccaaatacactttacacataatttaataagtactcttgagtggatcgaacctttcctagatgtgtccatttcagccattgtgcatgccaccatgcatgaacaactttggcgttacaaaaaagctagccaactacccacaagggaacaagagatttgttttggtttttaaaaacttttttaataaataaataaatatatagatttttttattaaaagatatatcgacattcttagctagttacatagtacctaacgacaacatgtcgccgcagtcagaattatgctacatgcaaatctatttatatgcatgggtggtgtgtgtttaaacataactctgtcacctatagagttttagcttaaaaacagatagaaaatcggtgcctctactttgatattttcataacatagttattgttttttaaaaaaaaagacgattttttttaaaaaagaagacggataaataaagggacaatatgaaactgagccatttggtaaaactaaaaccctttcatctcccatctcatctcatcccatctttttttttaaaaaaaaaaaaagaaaaaaacacggcttcaccctttacttggttagcctaagatcatggaaagctagcacctgatgtggatagctgtatcaacggtaaatcgtcgtatcatcccatcccctaattactcgttgatccctgatgctctatgtgacatatatatctcccatgcaagaactcggagaaattaattaagccgacgaaaaaacgaacaagaattggaaactatctcgtacacacgtaccttgctcccggaaggggagctcttcttgggcctgaacgtcagctggctcctgcaagcacaacaacaacaacaacaacatcgatatcccacagtcaatacatgtaggagcacagatcgatctactctactctacttccagaagagcaacaggaaaagcaggcaaattaaggtcgtctcctacctggagctccgcccaaacaagctcatcttcttcttcttcttccgctggtggagctggagtagtggcgagagagatggacggatggatggctgcctccacaggcgtggcttatataggcagccgcggatcagccgcctatgtgtaaagtacgtacgcggatgtggacaccacgccgaggaggagaaggaggccgcgggcgatcgatcgaacaggctggcgcggtgaccgttcaccaccgcgcgcgcgcgtgcctcgcgttggggttggggttgcagcgatcgatggcggctggtgcacactcgactcgactgatggatggatggatggatggatgatcacgctctccgctcgcctctgcctctgctcatgtatctcagcttctcaggcaggtcaggggccttttcatgtgtttcctcctttcctcgtcgttacttcgggcttttgatggtgggttttgatggatcatcgatccatcaacagctagcagctccaccccttttgcacttgatgatgatgatatatgatctgcatcctcccctgtccttgctgtcatccttctggatgccaaatcactcccatttttaaccttcatcccctctctctcttttcttttgctaattatttatccgctgtcaagattaatattccttttctctcctgttgttttgcaaacgttatgtttacaggttgtcaagggctcgctagttcataacttccgctaaaactttctataatcagcgatggaggatcatggaggtgggggagtgtcttgtgcgaattacggcgtgtggttatcgttacatttattttacggagggaaaaattacgaattacccccctttctctcgaactattgcggtcattcgaattacccccctgaaccataaaactagacattcttcaccccaaactatataaaccggacgaattaccccccccccatcgacctaaatccacggtgcttttggtctacgtgacatatacatggcagtccagtcagcgttctatttattaaaaaatgtggaacccacatatcatatcctcttccactattcctctctctcttctctctctcactctctgtctcttcccccctctctctcacgcgcacagcagcaggcggcagcggcgcgcacgcacgcggacagggccggaggcggcggcgaggacagcagcacgcacggcgccgcggtgcgcatggcggcacgcacgcggccgcaggctcaaggcctcgacctccctctggcccgcgcgctcgtcctcctcgacgcgccgccccatccacgccatcgccgctgccgcgcctcttcgcgccccgtgccgccgcatgccgtcacgtcgcctgtcgtcgtcgctcgcggcgggccgggcgtggcgttctcgtttgacggcctctgcgacctcatcctgctcatggccgtcgtcgtcgacatcagcaacggcggcgccaccgttgccgtcctgtacaggagggagagggagttcgccatagcccgcacgggcgagcgctcatggcgtctcatcaacaacaagctggacagaatcgtcgacatggcgaggcacggggatggcaagctctatacggtgcacctctccggcaaggtcgcgcgctggaagttcaactgcaatgtctgcaggtcgccgaagattcttgagtcggtgctggtcattgactcgccctaccactacgtcgtcaaggcggacggcaatggcaatgccatcatcatgtctcgggaatacgaacacgaccaccgcgaccgcgccagcgagtgctgctacctcgccggagcaccgcgcggcacgctctacctcctcaagcgggtgtacaagcacaagcagggcggcggcggcggcggcggcggcggcggcacctcgagccccgtccgcgcgccgtcaccccacgctcgcgtgcccgcgtgctgccgccgtcgcgtcgcctcctcgcgccacgccccgccgcgctgtgcatgccgccgtcctcgccgccgtgtgcgtctcggccacgccgccatcctcgccacaacctccggccccgtccgcgtgcatgcgctccgccgccgccccgcctgctgccgtgcgcgtgtgagagagagaggggaagagacagggtgagagagagaagagacaggaagagagaggaatagtggaagaggatacgacatgtgggtcccacattttttaataaatagaatgctgactgtactgccacgtgtacgccacgtagaccaaaaccaccgtggattgggtcgaggagggtaattcatccggtttacatagttggggtgaagaatgtctggttttgtgattcagggggtaattcggatgaccataatagttgggggggtaattcgtactttttttccttttacgagtgtctagtacgaggtaaggcgtgtggttgtcgttacaacaatccattcttttgcgatgccataggctaaaagaattgttcgctatttctgttggtcggtagttgagtaactctagtgaagtggggtaactaaaagggctatacatatggacataatagctatggcgatgacaaaaatactagatacagtaacagaagcacaggcatataacggtaccgttgcccaatgggttgaccggatgacaatcggaaaacgacatagttgataacggaaacaatcgtacaaggtacatttggcatctaattaagttgattacatacaacagcacaaatcaacatatctaccctatagttcaacaaatactttcactcatcactcattctttcattcatcactcaacggttcagattatccgtgtgaaatccaatgctcatgatcggttccacctcccacctcccctctcccttccgcacccctcacctcggttgcgccctccctgctcccctcattcacgcgctccctcgctaaccctaaccgcgctgcctcaaccagtcaccgccgccgccacctcgccctgtgcccttgccacatcgacgttgcgacaccctgcctcatcgccatagtcgccttggagcatcatgagtcggatcccctcctaggtgaatccgggcactcctccaccgcgcaaccaccggccatcgcgcttgccaccaatcgcccattgtgagttcatcgtcgatcctctgcggattgaccggatccctctccactatggtgccatcaggtcgtcatcgatccgtcgagccaccatgccaccatcaggtcatcgctaatccctcatctttccatcacgccgccaccagccaccgggacccctcgcacccgcaggtcactgatcccgcacgccaacaaggtaagcatccttccttcaaccgttacatatagatccgattccttcaaccattgcatagatttggtttgctattctatagttgaaaaaaaaatgcaattttctatatttagcgatggcggatcatggaggtggcggagtatctggtgcgagttacggcgtgtggttgtcgttacatttattttatggagtgtctggtgcaagttacggtgtgtggttgtcgttacaacaattcattcctctacgatgtcgtaggctaaaagaattgttcgctattttgaaataggttatcctgcaaacattatgttacatgttatcaaaggattcactagttcataactttcactaaaatttcctatattcggtaatggcggatcatggaggcgatggacccggagaaagtgtccggtgcgaggtacggtgcagggttgctacggacaaatgctgacaatagaataaaaatacaaagctgttgatgttacaaaaatccattcttctacactacagtagcttaaaaagtgttcagtatctaccctataattcaccaacggtgtgttacatcctcattcctcattgatcggtcaggattgccccaatcaaatccaacgcaccacgttactcccacctcccgcgtactctctctccagcgatacggatcgcccctctctctctctctcctctcacgcgcaatctccgctccgctccgctccttctctcccatcgctccctctctccccgccctctctccagccgtcgcctcaactcgtcgacgccgtcgactcacctcgccagaacagctgaacagcgacggccccattgctctcggcgccgcatcccgcccctccgccgtcgtcgtcacccgcgatccctcctcccttggtacgccgccggacggtttccgttgcgccgtcgccgacgatccctcaccgtcacctgcgatcaccacccccgccccctgccatccgctggtcctcacgccgaccgctgatggtcctcccctccagtaaaggtaaagaagatttctcctgtagtctcggatactgtaacatattgcagagtagattttgatgctatcaatttttttcatcagtttgattaatgaaccgttttcctgggtgaccaatgttgattgtgctattcacacttttctgctaatgtactgagacatatctgctaatcctcctttaccagatcagtctgaacagctgcttcccatacgcaaactgttgcgatgtgcttatggtcgaggcggttgtgaaccaaatcagcacatcaacctcggccttgacacattcagtcgttcagaggtgacccgacctgtgaaccctctactgcttgtgtgttattagtatgaagctttgcatacatgaaccatgtactgcttgtgatttatatatttagccaaagaaatatctgaatgccaaagcaatacatgatatatgcagatcaatcaacggaagcagtggcagatggcactgggcgtgcaatggcaggtgtgcacgaataagatcatggtacgatgtgcatattcgacagttaagtttgaacaccattgcaaattattagttttttcgaagtaacattttgattcctacactgataagctgactaaacaatttagtcatttgctggttatttatattcaaatattgaccatttcttattgtcaggtgatgcttccttttatcaatttattccattttcagtgcaattgtggatgttagaatgccagtggtttataatatagtaattttcaaaaagtttaatctgagataattcatcagatttacttttcatgggcttatcctaaaagagaaaatgttatgctgaccacaaattatatgcaggactgtgaagggctcactctggtgaatcagagttcaagtgaaggattgaggaagggttgaagggagaatttgatcaacttgctttggttcatttgctttggacccagaaattatggttcttttgctcatttaatataatttgttaatcatgcttgaccacttgcatattctgtattggttatttcttccagtttgatgaacaagcttgtgggcatttgttgttttatagaagttcagtgcgtctacatggaggatagggaaccactatacacctttcaacaacctgaattcatgttatatagtgctatgactatgcaaattcatgccatatgactcatctccaaactcatcttaatggtggtgaacagtggcacttcccttatcggttccatgacaatcgtgctgagttctggcaccatgtcaccatgaactctcttcagtggctcctgtggctgttgttgcgattggtgccattcttgtgcccggacgcagtgcataccaaggtatacactaattgctcttctattatattgcttgcaaatcaaaccaaagtatacactaattcctcttccattatgttgcttgcaaatcagcaaattagtttgaagatgtacacattgtatatttgtgtgattagtctcatgtgattaagaacaatattataatagaattaaccttttgtggaagggagttggcatccctcttcctgagatctcaaaacccatgaaaccaggctgcctgatgaaacgctttttaatgtaaataagttggtgatagatttctggagctttcaaatttttagatgtgttttgatatgcggttcaagaatttgtggcagtactgattttcattttgcccaatagtcctcgctggaattttgccgcatctgtctgttatcttgaactgaatcagctggtcttaaactagatcatgttttctgtagtccatctattaattattgatgtctaaatggtagttcatgggccatttgatactattgaaaaaataaatggggcaactcctttgttgtatgcccatgtgtccatttcttatgcttttatatgataaaatttgccgctgacactttggcagaatttcatggagggaactcttttgcagtacgggggacatgaggaacttcaaatggttcatgagatggagctgctgactccctactgctgaactatttttgatctagacctgttgtttctctgaaaatgtgttgttttcttttgtagtatgaggggttgccatgtttgcttgttataacaatgtgcacaagcacaggaattcttcgtttatatatagagcacaattaaaacatttttctacatttatagatgcatcagcaggatcgattaatgagaacaaacatcctaatatctatgtgatttggtgtttttgtgttggaaagcaatgcaaatgcttttcaatgttctcatattattttgagttaaatgcctttacagctgtaaatattgtcaatgaaaaaagaaggatatgagacatctatatcatcttttgggagtgatatgtatttcagtaaaattatatactagaataacatattcactttttattatgtgattaccataaacatttaccatcaccgtagcgttagcacgggcatggtactagtttctgatggttggacaactaaaaggttacgcatatggatatgatagctatagtgacaacaaaataatagatgttgtaacggaagcatgcatgcgtgcatgtaatggtaccgttggctaatggattgacctgataacaatcagaaagtaacatagttgataatcgaatcaatcataggaaatactgctgatatctaagttgattagagacaacatcacatgttctagcggaactaaattgatcactacaacaccgataaagggacacacagtaacacaagccactaatagggcaacatcacgcattcaaagatggcaactcaaggcaccaatagggtagcggtttcacgggtttcaccgtatgcaccacaatgatgagttggatcaactaaaagacaaatacatatgggcatgacagctatagtgacaacaagaaagtatatgtaacagggtacgacggttcaattgaccaatagataaaaggaaaaatatatcattttttctaaaattaataaatcatatttttcgtgaaatgtgttatgcacattttccctataatatgttatccgcattttccctataggaaaatgtccacattaattttatatgttgctatccatccaaatttaatttttatgtaatattaagaagtttttaaggggtaatatgtaaaaattgtaatgagagtatgtggggtggtagattcattgccaccatcatttatatagcatttttttctaaaattaataaatcatattttccgtgaaaagtgttatgcacattttccctataatatgttatccgcattttccctataggaaaatgtccacattaattttatatgttgctatccatccaaatttaatttttatgtaatattaagaagtttttaaggggtaatatgtaaaaattgtaatgagagtatgtggggtggtagattcattgccaccatcatttatatagcatttttttctaaaattaataaatcatattttccgtgaaaagtgttatgcacattttccctataatatgttatccgcattttccctataggaaaatgtccacattaattttatatgttgctatccatccaaatttaatttttatgtaatattaagaagtttaaggggtaatatgtaaaaattgtaatgagagtatgtggggtggcagattcactgccaccatcatttgagtctttttaaaggagtacagatataatctgtaattcagtttgtcgacactttggtgatgctatataggagttcgatgaatgtacatacgatgcaataaaggaagaaaagtaattaacttttgtactactaaattttttatgcaggtggcgtgcaaggaagataaaagattactagcttccaggttacggagtacacctggatggcgacagctatgtatgatttggatttgttgggcagttcgatcggattagtcccggaaaaatctctcaatccctgcaggtgacagccagcatatatatgcgaccgtgttctaaggaaattttcagacgacaaatctgatcatgcactgtggataattaattaaacaccttaatttcataagaaattttataagaatatggcatagatttcacaggaagtatctttctttgccctgagcgattcctttcaagaaaaaaagaaacattgccctgaaagcaaagtactttgctctctagttttcagagaaaaaagaatgacacttttatctagtgaaaaggaagatagtttcatatgatgggattcatgcaatggctaataaagactgcaattatatataagagcaagtttaatagtatagcccactactagtttcaaaccatctatagccaatgtaatagccaattcatacaatagttgcttactatactattaatacctagtttcacctattatacacacgttacgtcttgaaatctgtgttgcagctggctacagatctgtagcccgctgctcttctctctcttcctttatctctttaaaatatgttggcttctagcctgctattgtacatgctctaagttctcctccgtccacaaacgcaatcttctcaaattatatacaatgaaatcattactctagctactttggaagaattaacaatgttcaatatggagtacctcctctgtccctaaatatttgacgccgttgacttttttacatatgtataaccgtttgcctttttcaaaaaatttaagtaattataattcttttcctatcatttgattcattgttaaatatacttttatgtatacgtatagttttacatatttcataaaaaaaattaaataaaacgaacggtcaaacatgtttacaaaagtcaacagcgtcaaatatttagaaacggagagaatagatgacaaagtcatctcaaggctaggaaggctgtgatgatattgcgctttctttgctaattaagcagtcatataaacaaatgagtcccaaatatataattaaccaccaatattaacttattttctgtttgcagcagcagcagcagctccaacacttgacagtcctaaatattcagatctgcgctttttctgatgattgtaacaccaggctgttcgatgatctcatgttctcatgctttcttttccctgcagatatcaaatgattagaactggattattggaaggggaacgtagtgacttagatttttttagctccaagttgttaataaaccagaatctaattatgatcatgattgtattgtccggctagctagaattgcataaaacttcacgggttgcagagaacctgaaactagctaacatcgtagactctagacaccaagtccacgacactatttgcatcagaagccatacacgtgtaaagatgatttttttctttttttttcggggatgatgattttagttaagtataaggccccattgtttggctttttccctaataagccaagggaataaaaataaatttataggtaaaacttttatatatatatgttcttagtgacttaaaagccaatactgaaaaaaaaaactacgttgaaaatatctcaaaatcattcttaaaattaagtttgaaaatttaaaatttggctttttctttggcttattagaccatccgatggagccatagtcaggaagctagctcacaagtcacaactagctaggcccttgtttagttcccaaccttttcttcgaacttccaacttctccatcacatcaaaagttttctacacacataaactttcaacttttttttaaacttttaattttagtcaaacttctaattttagtgtggaactaaacacaccctaaatcattatttggatggctaacaaatggatcaaaggccgctaattcagcgagttaagctagcggagagtcagtgccttcttcttcttgatttcagacacatctttaattagtttgagcatttctttgttctctcttgatgatgggtggtcaaatcaaagctcaaaataaatgagcaataattatataacattatatatttgcatattcttcgtgggttcatgatggtatataatgttagctcgctggatggaccagagcaaatcagcctagctggatggcagttgtgactttgttattttggtctgcggcctttttgttgcactgtgctaactattggaagattttgctccctttttgttttcttccccctcagaaggtggtggtttaaggcccggtttagatggcgaaatcttttgggatgggccaaaaaattttggcatagggccactttttgcgttttgtgaactaaacgaggggcaaaattttttggcagatgtgcagtaactgttcacccatggacgagtagtacccctcaccctgctcctcgtcgctccaccaaaatccccaacgtagccgcttgccccttcgttcgtcccactgccgccgcatgccatccctgacaccgccccctcccaaatcgaccccctcctcccctacgctcgccctccctctctcagccgcctctcgccctccctaaaacagccagccgccgctcgccgtccgtgagacccctgccgcccagatccagcaggttctgctgcttcggcgttcgtcgctcatagcggagccacccgtcgtctctcacaccgctgccgcccagctccaattcttccaccgcttgtgtggtcgtccctcccccgccgacacacgtcatccctccaaccgccgccgcccacccttccgattcaccgttggcacccagatccgccttcattcccgcaatggccagctacgggggtggctacaatggcgacgaaggcggcaacggccacgacgacgacgtgtacggccacgacggctgcaccaaggacttccttgcgtccgggccttggtgcgcacgccaagggggcgcggtcggcgctgacgcggcgcatcccccgcctgattcctctagcggcaacacctcccgggtgcggttcgagtcgctcgacctcaacgacagcgacagatggccggaaatggctatgtacgcgggcatgctgcaggccgacgacgacaacatcgaaattcctccaccgcccgttcgagttcctccccggtgaatatctcgcaacctcggaatccggcccactcacagcgtggggggaggaggagtacaaggcgcggccgccggaggaggacgagcaggggccgcaagcgctggaggaggagtcgcaggcgcggtcgtcggaggaggaggcgcggccgtcggtggaggcggcgcggccgtgagcgcacggcctgcatcacgcgcatcagtgcgccgcaatgtctcagaccttgcggccgagcactccgatgctaacgacggtattccggtacgtacaacaattccaattacaattgattgcctgcttccaactagtttaaaattttgttaaatgcaaacttagttcacatgttcggtgttgttttccataactattgatgcatttaggttaggaaagataaggcaaattggtcagcgagaaatactcgcaccttctgttccatctggtgccatcaaatggacataggaaactatgttcgcggtattatgcaaaaaaatggctggagggacatcattaagaggtacttccaagccactggtttagttcacgacagggagcaattcatggggagacacaggcaacttaggaagcaatgggcattctgtaataagctccgctccagctctggcttagggaggaaccctgatgggacttttgtcgccgaggatgattggtgggctgccaacaccaaggtaaattggtcatgtctctctaatgttgtgaacacatgttaagtttagcaggccatgacatgtgctttcgttggacagggacatcctgattggaagaagtttaggaaaggcttgcctgaatatttgcctgaaatggacagaatgtttgagggtgttgcagtggatggttctatatcctttgttgcgactgctgaccagcctgtagagtgcgacagctctgatgaagcggatgatgatgaggacgacgatgagctgactcctcttagtgtcggcaacaaaaggacaagcagcacgagcaccacagcctcgagtccaagtaagaagtctaggagtccagcggtgagggtaatggacagaaacatgagtgagtacaacgaaatttcagggaacaaactcagtgtcctggagaccatgttgcaagtaaagtaggatgctatgcaggaagaacgcaaagctattgagcggaaggtggcaaaggttaacgagctggcaaaggagtgtggggtaactccctctgagaccccaacattgttcatgggcgtcctcgaaatcatcaagtatcaaagtgtgatggacttgttcattgtcactgagcctgaaggaaggatgctcatcatcaagaaatatgcaggggtcgacaactagtccagctaatgttttgtcatggctatatttcctactttatgtactaatggccgtatgttcactcggatgtatggtgcatgtatttgtgtgtttggactatgttcctgatgtgtgttatttaaacatcagcatggtactactattaatgaactctatgtatgctgctgatttgaactatgtaatgcatggctgagaaagaaatgcatattaatcatgtctatgtatttttcattgttaatattttgcattgcttgttttgacaggatgatgaccaatcaggttatgtggaggatgatgaccaatcaggttatgaggagtcgcaccgtcgacttaagcgttgggaggatgagatagacgagttaatcattgcattgatggatgatgatgacgacggttatgtgtacggtatgtaccggtatgccattcacattgacaagcatttgactagagctgagtacacaacctgccatgactggtttggaatgggtacatagaaaacttggggacagaaaggcctgttataacatgtttagaatgagtccaactatgttccttcgcctgcatgatctattggtacagtcgtatgagcttaaatctagtagcaagtcaacctcggttgaggcacttgcgatgtttctttggatggttggtgccccgcaatctattagacaagctgaggacagatttgagaggtcaatggggactgtaagtagactgtttaacaaagttttgcaatctatcatcaagcttgccgttgatgtcataaagctggttgacccacaattcacaacaatgcatacaagactgaggaaccgtaggttctttccctacttcaaggattgcataggggctatagatgggactcatgtaccttgcgtggtgccaagtaacaagttggtgcagcacttgtgctgcaagggcatgacaacacaaaatgtgatggttgtctgtgactttgacatgaggtttacatttgtactagctggatggccaggttcggtacatgacatgagagtatttgatgatgcccacacaacatacacccatgtgtttccacattcacctacaggtatatgctttaatggtacttgttccttctttgttatttgaaatatgtcatactaactcatgtttgatgctgtagggaaatattacctagtcgactctgggtaccctaaccggccaggttaccttgctccttacaagggaaccaagtatcatcttcaggagtatcgcgacgcccctgaaccacaaggtaaggaagagaacttcaactatgcacactcatctcttaggaatgtcattgaaaggtcatttggagttttgaaaatgaagtggaggatgttggagaagatccctagttatgatcctcgtaaacagacacaaattataattgcatgttgtgcgctacataacttcattaggaaaagtggcatacgtgacaagcacttcgatcgttgtgaccgtgatgagaactatgtgccgccacaagctagtgccgatcaacctaagaccgaagaagtgtttgatgattgtgatctgatgaatgcatttcgtgattccattgcacttgctttggtacacggttcttgaattttgtttgtcatttggaacatgcgtatggactgtcatgtatgcggctgatgtgtatgtttgacaacttatttgtggatttctattgcttgcataattgttgactgcatttgtaatgtgctactgttatggaggatgtaagccaagagatttatgttgtatgtcagtatgtgtgtgacgtcgcatggcagctgtgtttgctgtaccatgcatgtatgccaaattcattatttgtttgcagcaacagcatcgcccatgaagcaagtttgaaagtcagccatgcatgcatggcattaaatatgggcaattcaggaattctgtgtcaggggcccaaaacttcttgccaaaactttctgcatgtttagttcccaaaatctaaaaactgtgcagttcccgaaaatttttgccttgccccaaaaattttgggcaactaaacacggcgtaagtggcagtggttgtgctatctctctaatattcctggactgtcagtttcccaccattttgggcccaaatgggactcagattatgtgctggcccagcacatcactagtgtttagcacaagtggatacaggggtaatctgctgcattataatctgtacctcgctagtgttaaaagctgtgttcgggaggcatatggttcccaaccttgcctcccgacacggaaaacaaagcatactattatagtgagattaattagtattagtataaaaaaacatgaaaaatggattaatatgattttttaaagcaactttccaataaaaaaacttttgcacaaaatacaccgtttagcagtttgaaaagcgtgtgcgcggaaaacgaaggaagtgagttaggaaagagggggaaagaacacagccagttccaataggaaccgtgcgcacggaaaatagagcgatccattagcgtgtgattaattaagtattagctatttttttcaaaaatgaatcaatatgattttttaagcaactttcgtgtagaaactttttgcaaaaaacgcaccgtttagcagattgaaaagcgtgcgcacggaaaacgagatgagagagttgggaaaacagagtaggatcccaacaagaacattgcccagtgcccatagaaaacagaaaacagagcagcatattagcacgtgattaattaagtaatagctattttttaaaaaaaatagattaatttgattttttaagcaactttcgtatagaaactttttgcaaaaaaaatacatcgtttagtggtttgaaaagcgtgcgcgcagaaaacgaggaatagaggtttggaataaggggtgccgagaacaacctaagttgctacttttgtaactctaaagagtcgatacattgactgtctcatggcaaggtacatttgaagtgcatgtttctttactttcagaattagccaaccccataacatggctcatatgtttggaaattggttgaatggttttgaacctagacttaaaagataaatttatatgggcattgcggcaattttgtgggttttatggcttaataggaatgatgtagtctttaatggctccaatccaatttctttcatgcaggtaatcttcagagggactcattgtgcaagactttggtcttgctttttaaagaggacgatggagatgccatccaagttcattgtagaattttggagacacgagtaatggagttttatgcaacttatggctgaaattttagaagaaggattgaagcttagctttctatgattcttaatatgggttatatctttatgtgatattgcccatgtatcgggatgagtcttatgcaaactttcgtagctcgtgttgtccctcatataacttgatgagtcttatgtactcttggaaacttgtttggttgtgtacaccctctcacaggtgtagaggctaggtttaatataaatccattatcttaaaaaaaaattggaaacaggggtggttttgaggctaatcaaatcagatacattctacgacaaataaggataaatggaatttaaatcaacaagcccgtctagctcagtcggtagagcgcaaggctcttaaccttgtggtcgtgggttcgagccccacggtgggcgccttctttttttaatttcttttcacacccgtttcatattttgatcaatacattttgttccacacatttttcttaccatttcatcttcttctcacttaacattttgttccacacattttttttcttaccatttcaccttcttctcgcttaataaaacatttcgtatttttcttctcacttaatataaacatttcttgatcaatgcattccttttccacacctttttcttacttaatagaccatttcgccttcttctcacttaataaaacatttcatattttgatcaatgcttttctttcacacacatttttcttagtactacatcccctccaaaatagaacaatctaggatcggatgggactaatcctaatactacgaccatttcatattttgatcaaatgcggtgtgtttagatttatttaatctgctccattataatctgtacaatatataaggaaatggtcatctgactacgtcagtaattcttcagcagctaagcttcaacgtacgccttctgcgcctacttaatcgatgagatctctcttcgtgccgatgatccgactcgcaggaacacacgaccagcaaagcaatcatcgatctttctcaactctcaactctcagctcgactgattcgattccacaatgatccatggatggatgccgctatcagaggagccatggcgcgaactccaagtagtcgtcgtcttcgtccccaagcgaagaaggcacctcctcctcctactggtggtggtggtggtggtggtggtggtggtggtcaccgtcgtcgtcttcctctgcttccagctgccccagcaacgcctccaggtcaacagctccagcctcgccaccgccaccggcgccgccgagctcatagccaatcggcatcggcagattcggcaccgctccggcggcggcgttaccgtcgtcgtggccgccgccgcgccacgggctgatcaggaagccgtcgagtcctcccagctcgatgtcgtccaagtcaaggtcgatacagacggccggcaccggcaggtcgtcgtcatcctccgctccggccagctcttgctgctgctgctgctgcaccgcctgcggcgtggccaccttatcagccgccgcgtctcccggcgcgccgctctccggcggacggccgccgtggctgcaggcgcctgcctgctgcaccaccactatcccgctgctgctgttgttgttgcaccgcagcgccttggtccggattgggctgacgacgaccgtgcggggctccggcgatcgccggcgtcgtgcagcagcgccggcggcgtcggcattgctgctggtggtggccgccgccggcatgctggtggcggcggcggtccgttgcatggcgacccgcttgctgagggtgctgttccagtagttcttgatttcattgtctgttcgccccggcagcctcccggctatcagcgaccatctgcatccatagttccatacaagtcttaccaagttttcaaaattgaagcaatttcgaccaaatttgaaaaagaaaagaacaacacaaaagttttggttcgctacgtattgcagatctacagcagtaaacaagttttaagtatagatggccatatggcccgaggcccatggcccggcccaaggcacgccattttggcccagcccaaacatggcatgacccgactggggtcgtgcccgtactagccagatccaacaaccgggccatgcctgggctgcaccctaggcacggtgggttggcccggcacaacaactatagggatgcaaatagacttaattaccgtataaggcaaggccaaaaagaagaagaatacaaaatagacttattttccagccatatgaacacagtcaacagagttgagggataaaaaatatactttttttttagaagcacaatgggccgtcgtgtctttcggactgctgtgtatgcagcccgtgggctggcacggcacggcccggcgtgtcggtcgggccatgccgacctgattaacctcggcctaggcacggccgtgccgtgccgcccatttgaccaactatagttttataagttccctcgcttcgtactccatgtgtcgtaaagtttcaggcctattattatttttaatatacggtcttcaatatttgaccatctatttatttcataatacgtaccaataactataaaattagcataagcttttaaaaatacgaatataattatatgataggcatcacattagatatagaaatggataatataaacatagatatttgaccatatatttatttctcattttatcccctttttgtttttaagagtccaattgtcttcatactaatttatgttagcaggtcgtagttgtaaaatctcctctctttttttctatgatacgtaaggcttttacgtgttcgtaaaataattattagttaaaagttgtctagattgatttttctaaaaacaaggacgtctcgttaaattgagacggagggggtattaagttgcaatgcacaatgtgagctgcacttttccatatgtgaaagcacaatgcttgccacgtctgagagaagtggttgtgcattcatcatgtgctcttccgatcctaggcaaaaactttgctcttctttcttgtgtgagtttgtggctttaggtgtatatatagaagcagccttgtatgattccatctgtcatcatcaactttgctgacctaattactcttttcagattaccctaatctggagagcagagactgcactgacaacaaaaggtttgttcttctagagagacagctgatctggaaaattgtgcaggtggtgactgatttgggtaaaagtgtgcttaggtggttctgttaattggaggcaattagttgttggcttagtcatggctgtgttggcctactttgtctgtttctcatctcatggagcagacagatgtgtgatatctgtcatcaaaccaagagaaacgaatagaaagcttcattccatcatgtgctaaagagagcaagctagttactagggagatgatcatgatgagtccataaccctaatatactgatgtgcaatcttttaaaggaccctctctacatacgtctagcaataaaattctcggtgatattctcagaattcttgatctcattttggggaaaaaaatgattccttgtcagagtattttaaagaaaaacatttgaattttgaaaggaaaacccaattttgaacaattcagatctaaagaaattgaggggctgtttggttcgcgtcttgatgcttgcatgcctggccggagcgctgcctaagctccaacaactacgtgtttggtttgtgccctggtgtatcctgagctagcctgacctgactcttcattagcctgctaaatcctcaggcaactttattagcctgagccaggccatcgaatttggatgcctgagcttcaggcagctactcttaatgatgcatgtgtcatttattctatgctttgctctagtaaaagttgctttttgatattttattattcttcaggtatgtgcatgaaccaaacacacaaagcttcaggctgcctatgaggcaagtgttgcatctcccaatgctgcctgtccggcgtgagtttttctcaggcgtggccctcaggacacgaaccaaacaacccctgagtaactgcagcatttttgtgggagcagaaaaaaaatctcggcgagattcatcagaactatggtcatccgccagtagtgatcatgtccttgtacgctctagctaaaattcattcatttggctcgcaagaaaagaaaataaaatcattcatttggcttgaacactagtgtcaggctgtctgcaatctgcatgttactgttcccctagagtttagcatcggagtttggctgatttagaacggacttagaaacagggcgccaaaaaaaagagagagagagagagagagaggagagaaacaggattttactgaacaagaatgcatcatggctgcatcgtcaatttcttcagcaacgcaggaatgcagatatgcaggcatgcagagcaaagcagtcctatcaagtatgcaaatcaatcactaactactccagtacatacactgaattggcgagttaaattactgataagcaagcaggaaatgaaagtggtaggccgggctggattaatttgcaggagaggaggagaggagaggatcagagacaggcctgttgccgaggagagtgtggagcctgaggatgagctcctcctcgtcgccggagatgttgcccctcttgatccccggccgcaggtagttgagccaccgcagccggcagctcttcccgcaccgcttcagccctgcattgcattcatccatggcgatctcatctcatcacttcatcagctgttcaccaccgatcgaaggcaaagctagagagtagagaggaggaggaagaagacgacgaccgaccggctctcttggggagggctccccatttgccctccccgtgcttggcgatgtaggacaccaggatgtcgtcctccattgccgtccatgcccccctgttcagcccctccttggagcagcacggcttcctccccatccacgattgctcgatcgatcgcctacaaacaatgccaatggcggcagcgtctctcttgctctctctctctctctctcttgttgatctcaagcagagagcaggagacacgtctggctatgtcatatgtagtgactccaatttgcacaaggcattccgttcttagatgatgtggttatctcaaggggatggatttggtcgtctcaattactccactaaccagatacaatcattggtgccgtggttaggggcggatctacagtataagtgtcggtgtcaggcgacagactttcggcaaaacctattgcaaaacttcttatccatatactataacactataatctaggcataattaacatattatgacatcgatagacatgccaacgaatcgattttctggatccgtagtagctttgatttgcagagtgaccacatacagattctgaggttggcattcaccatcagcggttaataccaaccaatttaactctttaacccaactgttcgtgccttacgcaaccgaccactttaaccaaacggcgcctggaattttttagggaatcttctttaacaaaactgggaaggtgacctgtatgcgcgggtatttgtacggttgaacttaaaattatactccacccgttccaaaatataagtatttttaaaatagtgtcaattcaaacatttttaactttgactattaatagaaaaaaaataaaaagatcaatcagttaaaattaatgttactagtagatttatcattgaataaactatcataaaatgcaactccctttatttaaaacatcttacttttatatatattgttaaccaaagtagcatctaaaaattatgtcgaaatccaaaaatacttatattataggacgaagagagtagtttgtttctatgatcatatgatttgtataatggctatttgagggtataaacaaatcaattaacttttacaaagttgagaatttgttatagaaaagtataccaaaataattatatagtatttttcacgaaaagtatcatagcttgggaagcgtgcaaataaaaatccaaaatctagaataaaaaaaataacagggtcttagctaggctcccctataacactcttgttttgataataggtctagtgatattggttaatattttttttcacttacgtgaataagtagtactaaatataaatacaccctagtacattataattaggtaattgaccatctgttttagctcacacgggtttacatgttgtgaaaaatcaaaccacgctggttaattcttctctctgtgcattacccttcaatttgttttgacgttattaacaaactaaacgttatactttgatgaatttgatacatcttcaccttggcaaagtggtagcgtgcagctgttgtgatcgctttggtttaatatatttcaatgcagaaaaaatatatacacacatacacaaagtttgtatacgcactaaaaataaaaaaaataaaaaatacatcacgtatagaaagtttgtatacgcgtatataaagtttgtatacgcgtatataaagtttgtatacgcgtatataaagtttgtatacgcgtatacaaacttcgtatacgcgtttgtatacgtgtatagaaagtttatatacgcatatataatttgtatatatacgcgtatataaaatttctatacgtatgaatataaatttggtatacatacgaatataaacttggtacttatacatctttagaaaaactgtaaaaaaccgaacagaagagaaaccggaaaaaaaaccgaataaacgaaaaaaccagaggaaaaaaaccaaacgaacagaaatgaaaaaaaaaagagaaagagaaaaaaaatggaaaattcgctcctctccctcgcggcgtgtccgccgctccctctccgcgtgcgacacatgtccagtcgcgtagagaggggggcgcgcgactgatcgcgcaatgtagaggaccggagagagatgtcttcagaggctttcgttttaacaacagatagatctaaagatctaaacaattggtccattgtttaaatggaaattgatgggcaactatttcttttacaaaataggtttgaacttagtataaattagtcaatatgtgaagagtaaattgcatattgggccacctttctttaccattctgtcaatttagacggggatagaacaattttttcactttggaccacctaaatttacatgtttgtttccttttgggcctcttcttccacatccagctccctctctcttatctctatttcttctctctttcttgactgcaaagggctagaggaaccaccatgagcaggccaacaagtgatcatcagtgctcgtaccgaagctccgtcggcgtcacctcctcgtgcttggaaaggagatcgatctccctggctgttgggaggtcaagctccagctcgaggtagagtatggcaaacaacgggactcgagatagtgaggcatcagcagagcttgagaatgagtgcggcatataattcagggaggccagagagaagatcgatggagttgaaggtggaagagtgccccaaaataaaacaatatgtaaatataggtggtttaaagtgaaaatgttactctatccctggtccaagttgaaacaatggtaaaaaaaggtggcccaatatgcaatttactcgtgaagagtaaatagatcatatggcggtgtaaattttattttcaaaccccacgttatttaaaaatgtttaatgatgtaaatggataaaaattaactatatgattcaaatgtttatagttctttaacatttattatcgttgtcacctcggcagatcaccttagttgtctcatgtatgaagcttcatcatacatgcgaaagcaaagatgtacatgtgcattgtgcagagggtcagataaatgttcttagaggctttgttttcatcaaaagatagatctcatattctaaataataggtccactggcttaagcaaaagatttttaggcaaatatttttaattaaaaaaatagtttaaaataacagattcacttgtttaaatataaattggttaatatagatcatataatagtgcaaactttttttttctcaaacggtgcactatttgtaaatatttaacgatgtaagtggataaaagttagctatcaatttattatacttttttcaaattaaatatcactttattttcaaattaactatcactttattttaaaattattgtaagtggataaaattttgtacatgtagaggaggtcggtttagactaatgtttttataagtttttcttttaataagtgagattgatttcctgtggtgcatcttgtaggcccatggtgactgaaccatgcatatggttggcacgtctaatagaaaatgtctaatagtgttctttaggaaaaaggaaaacgaaaacatactctaccgtacttgatcggtgtttatagttgtttaaaattgagtgaagtgtatgggcagtacttaaacttgtataaatgtgtcatctagatctctaaactctcaaaatgtatttttgggtttctgaacttgtcatgagtgtcatgtaggtccaaacgggctccaacccgctcgatgagatgacgtgacatgccacggtgacgcttacatgtcagtggtatccacatgtcattcgcataaaaaaataaaatttaaaaagagaggagagagagagaggagaaaaaggatgttttcaattttgaaaaaataaatgaaaaaagagaggagaaaagcaatattcttaattttttctatatatgactgacatatggattctattaacacataagcgccaccatagcatgccacatcagcacacggagtgagttggagcccatttggatctatatgacacccaagacaagttgaggggctcaaaatgcatttgagagttcagggacctaggtgacttgacacacctacacaagtttagggaccgcctgtgcactttactctttaaattttattgtcacaaaatgaatttccatctaactaatatagcataaaaagagaagagataggaaatagaaggggaggtcatataggggaacgcgagtaggtacatacacatgatggtacgggaggtaggcatagcacagcaaaccgggctagaggttgacccgctctggttgttagttcaccggttgaaccaccggatcactggtcgaactgccggtttttttatttattaatattatatttgatttgcattatttgaaatatagaatcatcataaattggtgaaaatatgcataaataaactagtatatctattattatatggccacaacatcaaaaaaaaatgtagtgtggtaacataataaattcataatgctatactggtaggacaaattaaaaccggttcgattcttcaaaaaccactcccaattcaccggttcccataaaaccgcccggttcacaggttttttaccggttcgattgcagggacggtctttttgttgaactgagccatcaaggtcgccggttccggtttttcttgattcaaccgccagctcagtccccccccccttttttactatgcaggtagggcatagtgtctatttttctttaatataaatctaatctaatggtttataatattggacctaccgatttaattgaaaaatcaaatgatgtgttttgtttttcttatcatcttctctaattaattaaaacgccacgtatcagcttgagagtgtttttgaacgctacatgtcaacttaagagcgcttttataaagtttaatggacttttagtatgtaatatgaatatgatatgatacctaaaataactttataatatgatacagaaagagtaacaaacatggcatcaaattcactgtgatgcatcgtagcaacaatggagtgagttttttccccttgtctacggacaacaaacatgtgacttgagtttcctttcggcctaataccagcccaacattgtgcttacacgggccgtaacccactaaattcacctccgagcccattccactcgaaaaagaccttcgggaagcctctttgcctcccgctcctcgccgcccccgccccgccgcctcccccccacttcaagtctccattcctccatcgccgcctcgatctactcgccgatggcgctctcccctcccgcggccgcgcgctcttagcatccgccgccgcctccgccgccgtccacgccttcgatccactcccatgtcggagccgccggcctcatcctgcctgcttcagtaggctaaccgacaggggggaattccggccgggagccaggctgggcgcccatgtccccctccgccacctcgccgccgaatcgcccacaccgcaagcgccgcgccggtgccggtggcggtggcgctgacgacggctcgacccgccgccgcggccgcagcgctgtcctcctcggccccacccacttccccgccgttcgctccttcggcctccgcctcgccctcgtcgtcgccccagccccacgtcaccgccgcaagcagcgcccgctccactacgcctgccgccccacctcccttccctgtcgccgccgccgtcgcctccgcagtatcatctccctcctccacctccccatcctccgcccgttctacctccgctacatcctcgcggcagccgcatcaggcccctgccgctgccgccggaaggaatccctggtaggcatgggaaactacatctcgcgggtgctccggaagagctctagtgaccgtggtaaggcgccgccagccgacgatacagccaagcaggtacccaatttttaatctaattgagtacatctggcatgtaatttgcttgaaccgtcagtttgcacagtaaaattgacaatgcaacatagtttcaaaagatggtaatacgtttgagtcaatccaaattgcttttagtgaaataagtggataagtaggaatttatattagctatattgtatcaagtattttaatccacaagtgagagtaaaaagttaagtacttgcatttccagcctgttcatttttttttcttttgaagtcaaatactgttaactaaattaatttgagcactgcaaattgacctttgttgtcatattttatccttgactattccaggatctatgtgaagtttttacacctctgacaaatgaagaagaaagtgaagtaaacaacattttgtatggcagtgatcaaaggtattgtaggcaaccatgaatttaattggctgattacttctcctatatctttagcacaatcaggaattgattttccctttctttttttgcagtaagaaaataatagtgatgcatggaccttccaatattgatattactaaagagaaaatctggtgcttgagaacttgtaattggttaaatgatgaggtgaatacggcctgtccatggaaggaatcctgaagaatatgttaaacaaatgtcccattctttctgatcttgacattagtggttccattttccatgcttcacagaaccaagactgcatcagcattctacttttgttccttgcaggtcattaatttgtaccttgaattgttaaaggagagggcgcaaagagaaccaaaaagatttttgaaatgccacttcttcaatacattcttttataagaaggttagataatttgcatatttttctttccggtgctgtatgatggaatgttcttttcaatatttctgtagttctgttacacacaccattttatgatcttcagcttatcagttgtctctttgaagcactatcaagtgatatttatgcaattattacttgactcttttccctttttttgaggggaatttattattttccttccatagtaggaattatctgccagttagcaggaaaacctgtgattcttttccttcgatagtggaaattgttggctagtttgcacaaaaaacctgtgtttcaacactcaagcatacggtaccatacatttgtttgagaacacgcaattcctaccttatccttaatatatgttgatgtgtgccttgtatttacttaattgatgacccttttcttgagttacaaattttgtgtggttgttattctcttacttttttttttgctaattttccttgtaggttgtaacatcccttactatcccttactatttattaataaccttgcttagatatcaaatgaattctagcagtagtttgcaccttcatgattttctgaattctcttcagcttgcttgtggaaaaactggttatgactatcaatctgtaagaagatggacaaccctcaatagattgggctatgggcttgttgagtgtgagaaagtaatgttactgttattattttttcaatgtttttcatgtctgtttgtctttcaaacaaatcatgagatttattgtgcagatctttattccaatacatagaaatgtgcattggtgccttgcgataataaacatgaaggataaaacttttcaataccttgattcttttggcggcatggaccatgctgtgctgagaatactggtaagcttagctgattacaagtatattactggattagagagccagttacttccaattagttcagttacaagtccgacttatgagacgttagtttggtaagatggcacattgatgacttaacagttgattcagtcatagcatttggacttaattgctccaaattaattttgctaagtatgttatggtgctctctatttggatgccataaatctccagctcccacaatagttaaagggtggacaaaattttacccctgatgcattcatggacttattttttggtgctatagaaatgagaaaggtcttacgttatcacaaatatttgtgatatcttaaaatctgacatgattcagagttattctttgaaatttaaattgtgacttacgaagcagtaatccatgttaattagaatttacccatcaggtgctatttcaagctttcagttattttcaagtgaagttctgttttctattcctctcaggctagatatatcagggatgaattgaatgacaagagtaacatacaggtagacaccagttcatggctgaaaatatcatcagattcttgtcctttgcagcagaatgggtacgttctctttacatgctacatatgacctaccagaattacgtatggaatgaataatggtttaccttcggttctgcaatgaacacagatgaaggtctaaattttatcactcagtgcattaatacattatcgacatttgtgttgtgcatatcaatgaccaagcatggtccgcatggatatgtctgacactgaatttctcttttaataggtgggattgtggtatgtttatgcttaagttcattgatttccacagtagaggtattggcctatgctttactcaggtgagtatagtacaaaatactggattcaagttattatatatgcttaatctgttcactcattgatttgctgtttgcactattaagtcaatctcaaatgaagagtcttaacctgctaagatgaagcacaatctctctctttcatacatctaaagtggagtaacatgtaccttgtacttaattgtgtttggtgtcatctaaatcaatcactatttgcaggaacatatggattactttaggaaacgaacagcgaaggagatactgagattgagagctgactgaaaagatgtcctttcttgttcacacactcttgggcattttgtcaaggtaggtattcttgcgacctattggaaaagacataatgatgtatttattttctactagggtgttttgttgattacaagtggctggaacaattttgcataattctttaccccttcattttctaggatcttattttgatagaatagggagagattgaaatgagaccccaagggaacaagacagagctaacagaagtcggaatgtaagagcttagatgattagaacaagaatgcttaacccataccatgtatagccgccaattagaactataaagagataaaagggggtatgaatccacattttgttattctttaaaatattcaagtgaactgttatgaaatagatatgaggtgatttacatcaattatattttgtgaaaagggcgtcacccatcaaatttttttccttatagcatctcctttgcctctggcagtattagccattggctaacttgaaaaataattgtcgaaggtgatcgtctttctggaactcatattgcccagcaccacaggatatgaaatatggtaactcacaacccgcaaatcgctgcctgctggtgtaattaagtaatcgacatacttcctgtaagcacatacgaagttatcatctctaccccaacattcagttggatgagatcataataggcaactgtaagctgaagtgttttcatcaaggatttggaaaattgcagtatttactagcaaaagatattgacatcatatattgctgtttacagaaaagaacctgtataggcggttctagcaataaactacaaataactagcttggtacgtgtaggacaggcaattgtaaagttggatacgatctatgaatggcttggcaatcagcatgtttggattcgtttgctccagtgcttaaaatgatttcaaattttccctgcataaacaaagcacaacgatcgagagagaagaatcatatggatacatgcagacaaagcgatggatttttttaaatctctttcctttgtccttccttgagtcaatatctgatcacctgccaatcaacatacacacgaatcagatggccttggatctgtgtctcgtactcatattcatcaaacattcccgaatatatgacggcttacgatatcaatatcatttctcaagagctgacaaaagagaacaggatttaaaacctatcaaatactccctcctttctaaaatataatgtcacacattttagttatatcaatctagatagggacatatctagattcatggtattatgatacatcccatttgatcctaggtttctatattctgggacgaaaggagtatacatggtaataggtatacatctgcatgcaaaacagcttaagggtgtgtttgattgagctgtggcttttgaaaaagtagctgttggctgtggatttttgaaaagtagctatagaatataggctgtggcttttggaaaagctcgtttggttcagcagccgtagcttttgaaataactagtctcgcttacaagcgggtcccacatgtcataaacatattggatcttcttgttcgtctcaccaccataggatgcctgagatcactggagctgctcggttggggcagatgcggcggcgccgctggatcggtaagacggcggcgggggttccagctcctcggctccgcccgccacgcaagctgcgcctgtccgcctcctcggctccgctcgccgcctccgccgcgcccctgccccggcctgtgccggcctgtgcagccgcctgcaggacctcaccgcgggcgtccaggtcctctgacgccaggttaatttagtactagaataagttaatctagtaatagaatagaatatgatatcctagtactagattaacttattttcagacggagtagtatgaatttcatgttgtcaatttgtcatccatccaaatgacatatttcttcacaggcttgctcttggctgtcactatcatctatcagtacaatattgttccagcgaagacttagccaggaacagaagcatctgtgctttgatatatcatatgtttattcttgcgagcgcacatcgtaagaaagagcaaagtaatcacgacaaatagcatcgttaaaggtgaaatgcacgtcatcgtactataggtatgtcttgtaataattggtgggaactgggaaggtttctggagttaccgacttttggtcaatatcgtcgtatcaacacggataactttgaaaagaaaacaactccaagaaaacaaattgatcggtacttcaaaatcaacacgactattactcatataaaaatattacaccataaaatattttcagcggccaatatggggaaacagctttgacgtatatagttctgataatctggaacacatcaatttcaaaatttttaaacgttgactgcactgcacacactctaaaacaagaatggccagaaatgtgcaagaccttgctctagatcaagctgtcaagtttggtgaggatcttgctactgcaatctttgctgatgattatggggttgcaaattatcattaaacaagaagatcggacccggcccatgtggatgaaaagcttctcagattctcgtccttgggttcgattgcaataatcacatggagcttaagagtcaactatcctatcaaccactggatcagcaccagctttattcctcaaaagggaaaaaaaatcctgattgtactctcatctttattctgccccagcagcaatctcctctatctgaaaaatgctgtcgatctgtcatttgtgttaggctggccctggccctggtctggccaccagggctcagttttggtgcttttgtagctagcttggtcatgcaaagttgctttctcttcggaagatcccaatcggtcgagagttgattatatataaaaacgacttattattgataaaaaaataatttgagtaaaaaatttatatagaaatgttgttaatgacttaaaagccaatactttaaaattatgttaagaatactctaaaatttaagttttaaaatttaaattttggtagtgaatgatatgttgtggggcaaacgatgaggcctttgttaaagtggaactacatggcatattcagaaacaaggttaaaaaaaagggaatatacaatagtggacatattgtggaaaatgctaataatattccctgcaaaaaagaaaagaaaaaggctaaaatattaaagagctagtgattcatacttgtaatagccaactattctgcaagtaaaggagatagatattgtttcccatcaaatcaagagatggaatagggtgcgagcaagtgacatcttgcatgaaaaggaagggatcactcagacacactaactcactaatttaaccataacaaagtgtaggctaatttgtgttttctttcttgaaaactattgaggtgtctttgttttaaagcttccaataacgtctctaaaaatttcagcccttttgccaacatgcattagttagacaagttgaaatcttgacagggataggagaaaaaaaaaaggagaaaggggcaggtacattcccaactttccattggccattacacaacactttcacaatcaaggcaggttctagctctagctcaatctcttctagagctggagtctaaccaaacgatttcagctccataaaaaagaaagcggaacaagctaaagtgatatgagaaaaagaactagacaggtggagcggagtttgggctgctccgtggctctattgctaaagttagatttagtagttggtgccctaccaaacagatcattgataactctacaaataaggagacattttgttcactttgttaaggaaagattcatttattagggcaaaatttcactttgcaccaaatttcctttgtgtagttgtggtaactaaactgtgtatacaaagaaatacgcattgttttcattggctggtccaaattgtagggaaatgcagacgatagtgatcacatcaacattgtaaatgcatacaaatatagactatatgtgtgattttgacacaaatgtatttcaaagcatgcatatgcaaatatcaaggaaatatgtttttgttatgcgccggatgggggcccaaacgcctaagagcgtagttgtgcttgatgggagggtgagggcgcacgcctcgcctccccggagccatgccggcgaacggaatagaaggagaagggaagagattgaactggggataattgcttgctttattccctgaatgatctgccatatataagcttacaactaaaccgaattgctaatttaaaggactcaacaaactaacaaactttagataaaattgagaaacaacaagaactgtagcaatccgaaaacgatgttgacgctcccctgtgcgcgcgatgcctcatctgcccacttacgtcacaccaccctcatccgttcccgcttgtaggcttcgctttatcgcacgacggtggtatgaaaatccccacataacagtttttatcatttttatgaattaagactttgagatcctcattgccatcggtctctgcagctgttcttaaaatgttaaaggcatggacagcatggtgcaagaatagaaagaaatcaagaatttggttatatgttctatgaaggtcctgttattttctgattaagcgtcgaaacaaattttcggcaatatgaaaagggggtagcgcacgagacctaaaagtggatggatgcggagacaaagatttagacaggttcaggccctctcaatgagaggtaataccctactcctgtttggggatttgaatctgccgagtgaattatagatctgacgatctagttgtctcatgccccctagagggcctcctgcccaccttatataggatggggggcaggattacaagatagaaaccttaaccaatatggtatcggtttcctaaatctactttacaatcttatcaaaccagaactttaggccgttccataatatacagggaaacataatacccaagtcatgatccgttacatattccatagatataagttatcccctataactagtcggataatcatgccgtgtgggtatgtggtacccataatctccacagtagcccctgagaccttcacagtcgaaaagataatcttctctcgaaccagattactccaaagccaagtacttcaatcatctttgccatgatctcccgagaacttttaccaaatctaaagactgtggagggctgaaaaataaagttggtgcatcgactagatgcaccttataggtgtagcccccgactatgtggttagcttgaacaaactaagcatatagtcaaggaataaataatccaaccaacagagtggtcttgataattgtaatcaaccaagtgacttgatatcaatgtatagcatatgcggtgtaaatcctagaataatatgattcaagtgatataccgtctgctttgtaaaatatgatgcgtgcaacctaaagttgactacatcattgaaaattcacacgcaaaacagctataaagaagcttttatgttgtgaataaagaaatttccaaagtattgggcatacaccatgcgcacactgctttaacagatgtgcttaagtctctaaaagacacatggtttcaccacacctggaaatatacggtatatgtggtgtaaaatccgagtaaataaactcataaaggatttaccaactgcctggaaaatgaccaagatatataattagcctaagccataatattggtcaataaaaatgcacacttacgtggcaaaaagcaacgatattgtatccaatcaattgcttaaaaatccaaacaacaccttgacttatataaaaaagtcagcggggcagctatataaagctttactgtttgacaccttttaagatgcattgtaccaactcctaaaaagttgagtaactgcggtataaaaggattttaaggtattgggcacttgatcacgtgcactttggcctaagcaaaaagtgcctaagtccctaaaaaaacgtaataggccatacctgaaaatatgggctacagacatattaggccaaagccaaaaaatatgccttcgacaccctttaaaggatgacgcatgtaacatgctcccgagtaataaatctttcgggtgatatagaccaagtgtagctcatatgaatagcttcttatctgagtgattatcccttatgtgatactccaaaatagatataataattgaatcccgactagcacaagtattcggttgataacccttacggggaataataaatagtccagtcttcgagcatagaaaataatctcagaacaaaatccaacttgaaggtatgatccttgtgtttgagttgataagcccctgagcatataacttatccttctattgtagtcacatttgtccattgatagtaactgacgcagtcggcatggagacgaaatgaccaacatgaagatgatatcacccatcaaagcagtcggcggcggcggaggcaggccggcaataaagacgtagacgcgcatcaacagcgatgatgaaatccactaatcatgaggatgaagaaaatagtcggcgacagcaaacgcaaccgacatgatgaagatgacgatgtcaatgatccagtcaatagtagtattgcggccgatgataatgacgaagacactcatcagtgtttgcatagtaggtcaaccatgacggtgaaataacaagctggcaatgacgaaagcaactggaggcgaagacgtagtcactcattagcaacggcagagatgtcagggccgatgaagtagaggtgctggtgatgatgtcagtgacaataatccatcaaactgttgagaagatatcaaagcttgagtagtttccttgatgcgagtgtgtgcataaagaagattgatgcaacgctccttgatttatgaagatggcagtagaacttggtattatagctgttgcagatgcttcatttggaggaaaataaatgatgttgtccaactcgttgaatctgagttaattggttgataactccaaactcccgaacatgtagattaaatcttgaacttgatacttgagaattttggagtagattgtggcggcgtggagaagccaaaattgccggtgtaataattagagtcgctgaaattaaatgttggctctaaagcgaagacgaagataataactcctagagttgactcgttgattgattgattgcttcatcttgccataaagcttgtcgaattttgagagtcttgtatttgtgtagccctcgactctttggttagttgggaaacaactgaacatagagtcgagatctgtagcttcttgtcgtcgagtactcattgcttgagtaaagatgcatgttgaagatgtccgggtagaaatattgaagattgtaacacctcttgttgtaataaaataacacggcatcatatttggtgacgcatgccgagatgtcgaagctcttgtagacgtcgtggttggtgaagtagcaaaacttgcgaagcagcggcaatagagtttgtcggtgccgaagataatgaagatgaagtcgctccaccatgatgacaaagttgcatagccgtgatgaagtgaatacaagtcggtggcaacataaacaaaccggtagcgaaaacgcgtagttgtgaagataaaaacaccagtcggcggtggcataaccagtcggcgatggaagaagtagaatgatgacgaaaacgaagacgtccatcagtagtggtagtagtataaaccagccatagaggtgagggcactagtcaacagcagacgagatgaccggcggtgaagacgataaggccaatcaacactggcagactcatgcagccatggaagtgaagaaaccagtcagcagcagacgtagatagcttgtgttgaaggtggtgacgcctatttgcagtggcggcgtcgtggccagccatgaagacaaaagcaccagttggcgtcatacgaggcagccggtcggtgaagatgtagacgcccagcaacggcgacctaataggccaaccatgcaggcgaggacaccagtcggtagcgacgaaggcgagccggtcggtgaagacgtagacgcccagcaacggcgacataataggccagccgtgcaggtgaggacaccagttggcggcgacgaaggcgagccggtcggtgaagacgtggacgcccaacaacggtgtcacaataagccagccgtgtaggcggaaacaccagtgggcggcagacgaggtggccagtcggtgaagacgtagacgcccaacaacggcggcataataggccagtcgtgcaggcgaggacaccagtcggcaacgacgaaggcaagccggtcggtgaagacgtagacgcccagcaacggcggcataataggctagtcgtgcagacgaggacaccagtcggcggcgacgaaggcaagccggtcggtgaagatgtggacgcccatcaacggcgacataataggccagccgtgcagacggaaacaccagtcagcggcggacgaggcggccagtcggtgaagacgtagacgcccaacaacagcggcataataggccagccgtgcaggcggaaacaccagtcagcggtggacgcggcggctggtcggtgaagacgtagacgcctaacaacggcggcgtaataggccaaccgtgtaggcgaagacaccagttggcggcacaagaggcgccgatggtgatgttctgactgatccattcctgaagcgtaagagataagattaaagccatgaatcgctatcatgcatatctggatctagatcctgcagaacaaacatataggatgagtagtatctgatgtaaatacagtacttaagaaaaattcaagtattttaaaatatttgtaaatatgtatttctcctcttgtcaattttgatttccccgagcagatgactccatacgtttaaacactatgtccgactagtcatagcccccaagcatcgggagtcggcctaggcacttcccaaacatgcatatgagtgacatgagttcgtcattaatggaacaaagtttcacgaatcagaatttactactcgggtacttttgcaattgtaaagagcagaaaataaatttatcttatctctatgcttttgatttattctgaataatacttagcaccttgcgttactcggtccatccaacgagccctcgggtgctaggaatcggcccaaaggcaactatccatcaacaaaccaaatggaaagcataggaagatgaaactctataacccgataggcacttttgtactcagattatgtcgcgagcaatcaagataaatgttatgaaaattgttaaaaaatatgatataacatctgtagcccccgactcactagtcaacggcgaaccagttgatatagtgaggcagaggaaaagaaaaatatcatataaagaaaaataatgatgacttagctttgtaatattcccttggtgatggcagaagtagctgatgtgggaacaaagccgtccatcaatggcaatgaaaacaccggtcggcggcgttgactgcagccagtagtgaagacatggttgccatcagcaacggcggcgtagtacaccaaccgtgaaggcgaggacaccagtcggcggcggccaagtccagctggtcggtgaagacgtggacgcccaagaacggtggtgtgaccaaccaaccgtataggcgaggacaccagtcggcggtgacggaggcaggccggtggtgaagtcgtagacgcccaacaacggcggcataataggccagccgtgcaggcgaaaacaccagtcggcggtggcgaaggctagccgatcggtgaagacgtggacgcccatgaacggtggtgtgaccaaccaaccgtataggcgaggacaccagtcggcggcgacggaggcaagccggcggtgaagtcgtagacgcccaacaacggcggcataataggccagccgtgcaggcgaaaacaccagtcggcggcggcgaaggccagccggtcagtgatgacgtggacgcccatgaacggtggtgtgaccaaccaaacgtataggcaaggacaccagtcggcggcgatggaggcaggccggcggtgaagtcgttgttgctatcagcaatggcggtggtgaggacaagccggcggagtagactcacggccgatcgaccgaaaagctgagacgcctcgagtccatgaccagcattgatcgcctcaatagtgccgcgtaattatatgcgaacaacaacaaaaaaaaaatagcaagagattaatttgagattagaaatcaatctaaatatggaaaattacgaaacggtcaagagatgtgcactcaggccaatgttcggcacgaatcccggcgagaacaatcaacaggtgacatgcaaaaggcaacgtgcacgcgtgtgctttctcactcggcatgcagcatggccaaatctcctgtgtactgagttgcaggtagcagcaagccagtgaccgatccaggcctatgagcttcagcatgtcacgtggtcgctgagtggttcccggtgtaggcgtggatccgaactcgcaccgtgtgggctcggatttgcactgggaggaggctgatattgttgctcggcaacatcgacgacacggaaaaattgattccatcacacttttcgacgggaaactcgacgcacccctacctggcgcgccaactgtcgaaacaaattttaggcaatatgaaaagggggtagcgcacgagacctaaaagtggatgaatgcggagacaaggatttagacaggttcaggccctctcaatgagaggtaataccctactcctgtttggggatttgaatccgccgagtgaattatagatctgacgatctagttgtctcatgccccctagagggcctcctgcccactttatataggatggggggcaggattacaagatagaaaccttaaccaatatggtatcggtttcctaaatctactttacaatcttatcaaaccagaactttaggccgctccataatatacaggaaaacataatacccaagtcatgatccgttacatattccatagatataagttatcccctataactagtcggataatcatgccgtgtgggtatgtggtacgcataatctccacattaagatacaatttttaactcaattttcattaacatgctttttaaatgaattgccaaatggtacatttcatgataaaactttctatatagaacttgttttaaaatattagataaatcaatttttcaagtttaaaaaaattaaaacttaactaatcatttattaatggctttcttgttttgcgtgcccgtacataatcttcatctatcgctttctcgaattgggggccaaagtcctacaaaatttacaaattgtcaaaacttttgaaaggttacatattagaataaaagcatcaacttaaagacacaggaaagaaataattttttttcctccacttatattgaatagtctattcgataagaatcttgaaaaaattgttgtagagattatggataccccatatctatatggcggttatattccagctaggtacagggtaccgaataaagatagaatatcttcatgagggctcgggttagattctaaacttgtatgtcaaggaaatacccgggatcctagtcggttacgattgtattttatctgtaattccatgttcctttgggatatggactgtattttgtaaagcggaccccttcccctatataaggaggggtccggatgcctctcggggcgcggttttttcctagatcatacaatcaataatacactcggcggaatcatcccaggacaggagtagggtattacttcttgaataagaaggcctgaacctgtataaaattctttgtctccaaacccatccactttcctagcttgatagccacccccttttagtattgccgaaaccttgtttcgacagttggcgcgccaagaaggggcagcgtcaagtttttgccgactaagtgcgatgggttccgtctccagcatcgacgacttcgccttccccccgggcaggcgttccggttcggcagcctcaacttcatcaccaataacttcggcaagctctctctccttgactcggattcgaaccagtcagggagaaaccaggtcctctcgccgttcggtattccgaactcggccgatgtctactccaagatcgtctctcccgagttagtttcaaaccactcggacgagatccaatctacccctcagcgaccagatcaagatgacgggtcctatccttcaatcctgatgagacttcctgatgatttggccactgtcttcacagccaaggcatcccccgttcgaagatctagacgagcttcggcttcggccccaatccaatctagatccagggaggttggcgttatactccaatctcttgggacagtctcaacggaagagttggatggctacctcagctcccctgacgtcagttctcgaccaaccgagatcctcgactacggcgacttcgacaacttcgacgacagctatgaggataattacacgcctctcttctgcggcgtattcatggctgacaacgaaacggaggaacaacgccgagcccgagaagcggacgaagagcgcacacgacaagaaactgaacgtcgtcgactggaggaagaacgacagcgacaagagcgagaacgactacagcgtgagcaataagatcgcaagcgagttgcaaaggaggctgaagatcgacggcagcgcgccttggaatccgggcgacgagcgagagagctgatcgggcaacaagacgtcgatggaacagtggttttttgcacccccccagcagaacgcggttgcagcaatcactctcctcgacaccctcctcaaggaagaagcactcaatcaagctgatcatgttgtcaacatcttgaaccagacgaagaccatgatcgctgcctcgcttccagccaactccgcaagcacccgcaccccgactggtagccgagtccctcaccttcgatctcaggactatcaccagccaagcctcagcattgccggcgccggatctagtcgcaggagcaggggacatgatgaacgatctgttcgttcgcctcccgaatgatatagggagcgtcgagttgaacgtccacactccccacatcgaaggcgccccgtcgatcttcgtgacaccatcaaccagctccgcgcagcaagaggcaatcattcaccggatcgctacgatgacgatatggacggagttgctgccttcacaagtgaactgcgtcgagtagattggccagccgactttaagccgactggaatcgagaaatatgatggcaccaccaaccccgagtcttggctcaccgtctatggtctcgcagtccgcgcagtaggaggagacagcaaagccatggcgaattatctacctgtggccctagcagattctgcccggtcatggcttcacgggctaccccgcggcacgattggatcatgggcagagctacgcgaccacttcatcgccaacttccaaggcacttttgaacggcctggtacacacttcgatctctacaacattgttcagaagtctggagaatcccttcgagattacatccgacgcttctctaagcaacgcaacaagatctccgacatcaccgacgacgtcatcattgccgcctttactaaaggcattcgccacgaggacctagtcggaaagttcggacgcaaacctcccaagacggtcaagcagatgtttgaaaaagccaatgagtatgccaaagccgaagatgctattacggcgtccaagcagtcgggcaccacttggaagccaaagaaggatacgccgaccgcaggagggagtggaagtaacaaccacagtaacaaccacaaggatcgcaagcgtaagcccgaagaacttgtggcaataacctctccatcttcccgacaacgttcccgcgtcaacaccttcaacaagataatgaactcccaatgtctgcatcatcccaactccaaccacgtggccaaagattgcttcgtctacaaacaatttgcggagcaatatgtcaagaacgcacgtaagccctcagacggagatcaaggcacatcaaacaagaaagatgacgaagacgatgccccgactggttttcaagatcatcgcaaagaactcaatcacatcttcggcggacccctgtcttatgaatctaagagaaagcagaagctaacagaacgggagatcaatgcggttcagcctaacacgccccaagaccttcggtggtcagagatagcaattaagttcgaccgctcggatcatcccgaccgagtggtccacccggggcggtaccccctggtactagacccagtggttcgcaatgtcaagctccgacgaactctcatcgatgtggcagtgcactcaacatccttttcgctaagaccctggacgatatgcagattcctcggacggaattaaagccgagtacgcaccattccacggtgttatcccaggattatcagctacaccactcggccagatcactcttccggttacctttggcactcgggaaaattttcgtacagaaaacgtttgtctcgaagttgccgatttcgagacagcataccatgctatacttggacgaccagctctagccaaattcatggccgtcccacactacacctacatgatgatgaagatgcctggtcctcgaggagttatatcactacggagcgacatcaagcaggccgtcacaagtgacaaagaaagttgcgagatggcccaaacccacgagatcactctcgctcgcgaagagatctgactggctgcgaccacggcaagcgaaggagaagtgcctgcgaccaagctgtcaaagaccgaagaaggcgacgacaaaactaagaagattccactagatccctccgatcctaccaaaactgctgtaataggcgctgagttagattgtaaataggaaagcgcgctcatcacctttcttcagaataataaagatatttttgcatggaaaccatccgatatgcctggtattcctagagaggtgattgagcactctttacatgtcaaggaagacaccaaacccatcaaacaacgactccgccgctttgcacaagatatgaaggatgcaatcaaagaagaattaaccaagctgttagcagcaggcttcatcaaagaagtcctccatcccgactggctggctaacccagtcctggttcggaagaagaccgggcaatggcgcatgtgtgtcgattacaccgacctcaacaagtcttgccctaaagatcctttcgggttacctcgcattgaccaggtgattgactcaacggccggctgcgagctactcagtttcttggactgctattctggatatcatcagatccgactaaaagaatccgactgcttgaagacctcgtttattacgccctttggggcctactgctacatcaccatgccctttggattgaagaacgcgggagcaacctatcaacgcatgattcaaagatgtttttcaactcagatcggccgcaatgttgaggcttatgttgatgatgtggtcatcaagaccaagcagaaggatgacctgattgcggatttagaagaaacctttgcaagcattcgtgctttcaggatgaaattaaaccctgaaaagtgcatcttcagagtaccgtcaggcaagctgctcagatttatggtatctcaaagaggcatacaggccaacccggagaaaatcaacgccatcctcaacatgaaaccgccgagctcctagaaagatgtccaaaagctgactggttgcatggcggcgctcagccggttcgtttcgtgactcggcgaatgggggatgccctttttcaagttgctgaagaaaactgacaatttccagtggggacccgaagcagaaaaagcctttccagacttcaagaaacttctcactactccaccagttttggcctcgccacgtccgcaagagccgctattattatatgtgtcggggacctcccaggttgtgagcatggtcctagttgtcgagcgtgaagaggaaggccatattcaaaaagttcaacgaccaatttatttcgttagcgatgttttggccaactccaagacaagatatcctcaggttcaaaagttattatatggtgtgttaattacagtcaggaaattatctcactattttcaaagtcactcggtcacggtggtcacgtcgtttccactcggggatatacttcataaccgcgaagcaaacggacggattgcgaagtgggccttagaattgatgcctttggacatatctttcaagccacgaactttgatcaagtcacaagctttagctgattacctcaccgagtggaccgagtaccaagaagacatgccagaggagaagatggaatattggactatgcattttgatgggtcaaagaggcttacgggtgctggagctggggttgtcctaatttccccgactggagaaagattgagctacgtattgtggatacatttttctgcgtcccataacatggcggaatacgaggcgctgctccatggattaaggattgccatctctttaggcattcgccggctaatcgtccgaggagattctcagttggttgttaatcaagtcatgaaagaatggtcctgtcaagatgataatatgaccgcttatcgacaagaggtacgcaagttggaagataaattcgatggacttgagctcacccatgtccttcgacacaataatgaggcagcagatagattggccaattttggttcaaaacgggaagcaatcccttctgatgtgttcgttgagcatctttatgaaccaaccgtgcctagaaaagaaaaaattgaagccatgaatactcaaggcgtaagcatgattgaagccgactggagagaacctctcataagatttttaaccaaacaagaactccctcaagacaaaaatgaagccgagcagatttccaggcgcagcagactctatgtcattcacaagaccgagttgtacaagaaaagtccatcaggaatcctgcaacgctgcgtatctttggaagagggaagacaattgcaaaaagacattcattcaggcatctgtggtaaccacgctgctgcacgaaccattgttggcaaggcttatcggcagggttttttctggcccaaagctgtttccgacgccgacaaaattgtgcgaacatgtgagggttgtcaattctttgcccgacaaactcacttgccagctcaggagttgcaaaccatcccgttgtcttggccgttcgcggtttgggggcttgatatggtcggtccattcaaaaaggcagtcgggggttatactcatctctttgtagctgtggaaaaagttttccaagtggattgaagccaaaccggtcgtcacaatcaccgcaaacaaagctagagatttcttcatcaatattgtacatcggtttggagtaccgaatcgtatcattactgataacggcactcaatttacaggcggaatatttaaagatttttgtgaagactttggcattaaaatttgttacgcctctgtgtcacaccccatgagtaacggacaagtcaagcgcgccaatggcatggtacttcaagggatcaaagcacgagttttcgaccgactgcatccctatactggcaagtgggtagaacagctgccgtctgtactttggtctttacgcaccacccccagtcgggctactggccagtcgccgttcttcttggtttatggcgcagaagctatgctgccaagtgaggtagagtttgaatccctccgattttgtaacttccgggaggagcgatatgaagaagatcgagtggatgatatcaaccgactggaagaagcccgtgaagcagtcctaatccagtcggctcggtatttacaagggttacgccattatcataatcgaaatgttcgatcgcgagcctttttagtcggcgacctggttctgaggagaattcaaactacacaggatcggcataagttatctcccttatgggaaggaccgttcataatcgctgaagtcactcggccaggttcttaccgactcaagcgtgaagatggtactcttgtcaacaattcttggaatattgaacaccttcgtcgattttatgcttaggcatttcatttgtatttttcctcttcgactgctaacttcaagtttttccttgaagttttcagtcggggggctactataataataatggaacatgatttttatcaattcaatttgctaacttgatttatcattgccctgcttgattttttggcttagacaatgaggactgaaagtttttaataacttttgcgagttttaggctcaataagtttgacaaaagcttttaagaaatcagaggctaagtttgaaatatctagcacagcataaattcatcagtattgtacaaattgatcttccatcatcatcagaatcactgctactaatcagtgtcggttttttcattgtcagaattatcagacccagtcggccgaaggtcgacatcctggaatctctcaactacgtcagcaacaatcttgtcagcggctttttgcgcatcattgatgaggttgagggctgtttcttcgcttgtcccgtctgcaaacccatcaacagcgtcaatatcgattttggggtataaagatttggtcatagctaatgccatgcttgctcccatacttccagcctccctgatattcttgaagtaagtatccggagcgactctcagcttgtcgaagatctcggaagcgtcaagtgtactcgaaccggcgttattgaagaacatggcttggatgagtggggcagcggcattagcgactttgtccctggccccttcaagcctattgatcttgttgactaagatatcaaactgtgcctgggacttgattttgcgatctgcacgaataaattcatatcaacaagtggctataagaacatggggaatcagttatcattaccttcaacatcttttaaggctaagtccctctgctttgcaagttctgccttgtccttctccagggcttcgacctgcttctctaggtcggaaatcctggaggcttgcattgtaatgctttttggttaatcgatatgacaaggaaggttttacgaatacgtcagacggatatggtatttacctttggatgaaccactcaattcatagttggattcttgaagctcggagattctattcctcagatcatgctcagttttcctcgcaagttctctgacttcatgtaactggcttctggtggcttcaagagttccaagatggggaactaatttctcaagagttgtggtctttgcctcattcctgaggtggattctctgcgataagaatttactagcgtttcagcaaaatatgaaaggggataattaaagctatgcataaatggacttacattcacaatgcgagtggcctggatgagtgcctttttcagcaagcatacttcctcatcttctttttgtttgtttattacgattccttgaggttgcctatcatcgtcccaccacttgactaggatgggagggcgtgagtcctcagttgcttgtatacggggaatttcttcttcatcaccaatcattggtcctaatgtatccactgacaaaggttagacaattgatcagagtcatttggatcaacatggtttcaggcaaggtgtttacctgtgatgatttccggacggggatgagtcgactcttgcgtcttaactggggaccctggcatcgggtcgttactggcgtcttgtctacgagggctgtctgcccgagctccaacttctggaatctcttggcttggcctagtgtccgactggttttcagtcgggggctcctgattaattccagctccagctttggccgactcatttccggtcgggggttgatcaccagatcctacattatcggttgctggctggttgtcactcggctgatcctcggcaattggctcggtttcttttaagttcgtttccctgctggtcgggtcagagtcttttccagaaggatctatatcagatggtttcctgcaagtttgattatcagtattatttccgcactaggtgcgcatcaatcaaagggagatcgttatatgatttgtacctagaagacttcctgatctttggcacaggacgactggatgttttcttccttggagtagcctgcttcggcagtttcttggttgcctctcggtctccaggctttctagcagtatcgctttcgtcgtcacttgacaccaacttccttttgcatgaatctggctgaccggctggattggaggtatttggccgggcttcagaatggatcttgggacccccgctcccttgaccggtttggcggtggggtgatcggcgttgaacgactgggggatccgacttcatcaaagcaaattcctgggcgtaatatccttcattgttaattgattcaacaaaaagacaaggttatattttgtgaaaagttgaaatgtttgattacataccggtggaggaggattgaaagcattgaatggcacgactggcagcaagtgcgaatagctgacgacggtagcattcgagaagatcttgtacatcctctccttcataaccttaaagttaagagagtctggatcttcacgatttggatcatgtttgctgtcaaactcaaaagctgtgcgggacctctctttgattggagctaaccggctttttatgaagtgccgagtgatctgttctccttgcaaaccttgctctttcagctttatcatgcgctccatcagttccactgcttgggctgcctcatctcctgtaggcaatgaattccatgtatcttggtagactggagggagacaagagtactcgggaagggctggttcaggattttgaacatagaaccagttagcgtgccagcctttgtttgaggtcttgaagggcatggagaaatatttttggcttagtgttcccctgagttggaaaccagcgcccccgacaacgcacggtttgctcttgttggctggggtttaaggaagaagatgcggcggaacaaggcgaaatgaggcctaatgcctagaaaagcttcgcagacgtgaataaaattggcaatgtgcactatggagtttggattcagatgatgcaagctcattccatagaagttcagaattccccggaaaaatcttgaagtgggaagagaaaacccgccatagaaaaagtgagaaaataccacgacctcgtgtgtatcgggggttgggaatgcctcgccaaatgccggccgccacccgatgatctccttcgtaggaagaacgccgtgcgccaccatctctttcagattttcctcaatcaaatcagaaggcgcccactggctctcgaaactttctccctcctccgccatggatgcgagctaaatggtttgatttgaactgagatatagctcgaggggaatggggaatcggagcggtggatgcgtggagaagtttcgtgggattttgggaatggattgaagcggattgatgaaccctagcttcatcggcgcagttctgtactgtagcaaggagtggggaaatggtgaaagtctcggcggggaagacgaagtgacgcttggacttcggtgtttttagggtatcgggagtactaatgggcctgggcctatacagtacttcaacccaatattacaatcagcgtggcccgttgtgatccctagggatttaggcacgttttgctttggcaatttgtgctcacaatgatgtggcccgatgctattaaaatcctttttaacgcggttcaataattctttggaattattatgatgcaaataaaaaggtgcccggcagaaaggtgttatgctatttttgtaagctttattaggctgcaaaagctgtttgggtagatttgagatgactagtttgctaatagtcattctcttagcattttatatgcttattttggttgtggtgagggtcatagcttaggctattagactcattgattaccatgactttttatcatatttggtggagtgtctttggagtttttactcggattcctgtcaaataagtctatttgagggccttttgagcgtttatcacacgggtcttctcattttttttctcgatatattaaagctaagaagtagtcggctgggtattttactgacttctacgagtgttttgctgtataatgtttggttgtaaaaccactcagttcttgactttatgtttagtttttttaactaaccacatagtcggggggctacacctaattaggtgcatctactcgatgcaccatgctttattttcgcccttcacagtctttggttccagtactcggcaggctaaagcaggaagagttgaagcactcggattattgttttttgttctgagatggctatttcgtcgactgcgaaggtctcgagggctactgtagagattatggataccccatatctacatggcggttatattccagctgggtacagggtaccgaataaagatagaatatcttcatgagggctcgggttagattctaaacttgtatgtcaaggaaatacccgggatcctagtcggttacgattgtattttatctgtaattccatgttcctttgggatatggactgtattttgtaaagcggaccccttcccctacataaggaggggtccggatgcctctcggggcgcggttttttcctagatcatacaatcaataatacactcggcggaatcatccccggataggagtagggtattacttcttgaataagaaggcctgaacctgtataaaattctttgtctccaaacccatccactttcctagcttgatagccacccccttttagtattgccgaaaccttgtttcgacaattgtgtgctcgaattatttatttcaaatgattttggagattttttcctatacaaatcagatgctctaacttttttttgttccatagaggctattccaaatttatgtcagttcaaagttactcaaagaacagtatttttcaagacataacggaataataagttatgttaattaaatagtattatgctggtatataacatcaattactccatcccatccattctaaaatatagttatttcgagcgtttaaaaaaaatactctaaattaagtaatacttcctctacctaatcactagtcatttaatttttcttagtcttactataaccatctcccactctgcaaccatcccagaggcactcgatggttcatatcctctatcataatgacacgacactgacttgtgaggcaataaagttgcgtttggttaaagggttgggatgggtcgggttgggttgaacccatttttttaagtgtatttggtttggggacatgtgggataggatggtcaggaatattcccctaagatccgggttgacatggtcactcaaaaactgacatggtccctcaaaaactgacagaccattccaacccatttttttctcacgctgacatgtggcccattccttcaaaagtaggattattatatcccttatgccaaacaaatagatgtgatcatcccatcctaaaaacagggatgagtccaactcaatcacatcttgtctccaaaccaaacacatgctaagagagtgggactcacatactaatgattataataatagtgatattatggtagatgatgttcactcgacactcgcgtatatacctaaggtcaggaggacaacttatatcccttgtcccgtgagttgatcatgtgtcgtaaacagaaggataaccagatcaagtggtaaaatatgaccatttgataataggtagtgacaggagcagaggggattaaagaactaaacatatactatgttactgttagggcatttcgtcatggggcaatgccggatgtgggcacctttactctttattatatttttgccccagttttcgaaagaatcctcaaatcacagaaaattacaaataaaggctatcttttgtgaaatctgtttaatttcttctctttcatttaaaagcgtcacaaactggaaagggaaagagtatgattagaatatggtctcactgcacaaagtgataagatcaggattcctcttcatctgtctccatcctctatgaaaaagagtagatcaagattatcttcacgcaaacgattgaataaaccagagccatgcaaaaagaaaatactaatatatttttaaagataatccaattgacgagaggactcgtgctactcgtaaaatatttgtgaatataaatatcaattttagtagctagagtgtatttaggttcaaatggggaccgctactgatgattttcctttgtcttgaactatcgtcaactccaacccttcgcaaattaatgtcacaggtatatattgattatatatcttggtgacagtgacaaacattaaaacattggggcaaatgtattcttgcccctactttcatttgcaattatgattttacccttactttttaaactttatgattttgccctcactttttgacgttgaatggtctgtttgcccctggtttaaacgtctgttaggtggactcagattaaatgagtttaagaaaataagaaattgacttgcaaaatgtaaaaagacatctctatcccaaacctttcaacctaagccactgctgactcctccgtccccgattcctaaccctcgcgagcggtggcggcacacgcgggcaagcgagagcgaggagcgcgcggtcgtcgcggaggagctcggggtgaagcaggctgggccggcgccaaatggcgatgtcaagctgagctagcccgtcgccgtccgccgtggtggtcactgggctcgtcggcatcggcctcggctatagtacccgaaccgctgcacagcagatgatcgagtacatacgtactgctgcatatgcgtagctagctaggctgtcttgccaccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttgaactattggttggttcctaaactggacaggaccaacaaagctattctgttgttgaaagctattctgttgttgaaagaaagagatgagagtagtgtttcttgtttgcatattcataaatcccttgactgttaaaatgattaaacatgcagggcaagttcatacgtcaggcattgaggcattgaattcatacctcagtccatagtgtttcttaattaataaatcccttgattttttttaaacatatgctggagaatcgcatttcttgtgtagttacaagttggatttcgttgttaaaataattaagcatgcagggcaagttcatacctccgttttctactgtaatcgtgaaacacggccaaaacacaaagtcctcacaagccaaatctgcaagggcatagatgtccttttacctgtcagttaacaccattaaggctctgttcgtttcctggagttcccaactcccccatctcattttccgcgcgcacgcttttcaaactgctaaacggtgtgttttttgcaaaaagtttatatacgaaagttgcttaaaaaaattatattgatccatttttgaaaaaaaaaattagcaaataattaattaatcacgtgctaatggactgcttcgttttccgtaccggagggatgggttcccaactcaaccaaaagaacagagcctaagtcctcctgacggaacaggggcatacctgagcttcagttcaaaatagtgagggtaaaatcacaaagttaaaaatacaagggtaaaatcacaattgcagttgtaaatagggacaagaacacaattatccctaaaacacaagtacttctaaaatattctcttacaggacgagagatttggtgccgaaataataaatagataagaaatatttctctctttttttttggcaagaatcgagctgtctcgtgtaaaacctgtaaaattcatgtgctttgggatgcaaaggtgtccaaaggggaagtgtgggctatacagatgctcgggcctatatgtgaacagtatgtactatagaggatctcgattggtccaaacaaattttaccaccacaacatatttttagtactctctccgatcataaacattcaacgtttaaaacaagatgttgtcaaacttttacaattcaatggattgaacagtaaaagtttaacatcctaaattactctcccatttagaaatgcttatattttggcatggagctagttgatgtttgttacgggagggaatactccctccatcccaaaatataataacttttagccttttgaatttatcccaaaatataacaatttttctaccaatattcgcttctcaaccaatcacaatcttccacaatttaattctatgtgctttcctaataactgtgtctaactctaaaactccttagaacaggcacaatagtaggctataagccagctataaacatatatcgatatgataaaagaggagagataatagcaacggactacagatttgtagccagctgcagcacggactccaagacacaatgtgtatatgacatgtgggaccatatattaattgtgcagtatatatttataggtatatgaattgtctattaaattgactataaatgatttggagctattaattggctatattgttaaacttgttcttatattctgggacagatgaagtattaactaagcaagttcatggacttattagtgggatcccttttacttctgtgacatgatgcacacaaccgctgtgtgcttacggttagttctctctgttaataaaagtatatttcagtgtcctgaacctaattgcatatcccaagaatgtttcacaaagccatgcatgccattggcttagatagagatatgcaagccttttgagggaagaatgcacaggtagtacaggagatgaccctctgcaaaaccattcactggcagaagtgcagaacaaaagagtggtcaaaaaagctggccagcttccttcttttggttcatcagattctggtcaagtgctgcatgattggcaacttaagagtgcgtggaagtttgttaaagatttcgttccggctggttttggtgtatctctgttatttgtaaaacttaaattcacacaattttggatattctgaaactatattatggtgtctgtttatctgcatttggtccagtttttctttattgaaaaagaacacattcataacttcacatgaatcgaatgcctgtactgcaagaggaataaacacacatttacgagatggggtcaaatgcgctcatcaggggaatctcatgcacaacccagcatccactttatagcaaaaaaacatgctctcaccaaaaaggacctgatcccattggcaagaaaaaaaaagtactttccactactacaattttttcaggagcagagaaaacaagtgcaatcatccaatgctgaatgcccacacacactgcaacagatttctgcaaaaagtgatgctgttaaaaggaaggcttcattcattcatttttatttcttttttacaggaataggcttcattcattcatgtagagagaggagaaagagaggaggaaaaaaaaggaaaatggcaacagattctactactggtttctggtatgaccaaatagcagcagtacgaattcaaagaatataatagtattttgtttgaaaagggagagatttgttgggccccatcatggcatcatccatccatgacatttggtcatctatctatctatccctaacagcagcaagatagttttcagttcatctagcattttcagtggaagatccactactagtagtaaagagttaaaagaaaagtaggagtttaccaaaaaggttttcaactcaagtggagccttttttagtgcagccaaccaactgaacagaagctgatacactgttactgaacttcagattggaaagaaaaaaaaatgatgtttttgggaattcagagaagtgctcactctcttgtattggcattgttgcatcaaaatccatataatagctcatcatatcagctacaacaagatgaaacaacagctacaagaaagaaccgaagatgattgtactacctccgttttaggttataagactttctagcattacccacattcatacagatgttaatgaatctaggcacacatatatgtctagattcattaacatatatatgaatgtaggcaaatgttagaaagtcttataatatgaaacatcgggagtagttgtgagggggcgttaattgctcatatgtagatttatagattatagctagatatacaagcaagcaagagctcgatctttaagctaagctagccgaaattggaattggaattggagaattggaggtggttaattgagaaaatgagaatggttcttgttcagtcgaggtgggtggacctgacacgcttgtggccggcgtggcggacggcggtgccgacggaggcgccctcggaggcggcggggccgggggaggaggcggcgaagagggaggagaggtcggcgtagaggtcgacgacgcggcggatgttgttgttgagctcgcggatgaggccgacgttgcgggagaggtcgccggggaccttggactcgtggttctggttgatctcgttgatcagcacccggttctggtccagcaagctctgcacctgcacgaagctcgtctggaacgcgtgcagcaccttcccgtcctccgccgccgccgccgacagcgtgtcgccgtccatcgcctctttgcttctgcttctgcttgttcttgctctctgcttgttcttcttttgcctctctgcaattctgcaccccaaatggaaggaaatggtgaagagtgagacgacaagaacagaagctcgatgggcgatgaattgacgagttcttgagacaaaagaaaatactagtacattctttatctattcgattcaccgctgaaaatggtgagacgacagaacagatgcctgatgagttcttgacgcaaaagaaataattaattgttttttctttatctgttcggtacagcactgaagattttgcagttctttccatgaatgaaaagcaagatttttcagtttttatcgcgaaatctttgcaaattggagcagctgtagcgaggaaatgtaagattcactgtttggggggcatatgggacgacaaaagcactgttcaacaagatcagatgtacttgacgaatctttatttgcttggacccaataaaaacatgattaaaaccttggaacttttttccccatatgtaatctcgaaattaacgcaatggttggggataatatatatatatatatatatatatatatatatatatatatatatatatatatatatatatatatatatatatatatatatacacaagaaatcatgtaagtctaaattccaagaaacacaaagcgcgtcaaatttggaggggaaagaatcaaagaactcaagaagaaagaaacagtggtcgtgcgggaagggatgatgagttcggggaatagctgagatccattgaattcttcgcgagcaaccggagacgaaagattcccagcaaaaaatagaacgaaatcaagaacaagaacccaaaaaaacaaaatccgttactccgatgcgaatgagattggttttcgaccaaaattcgctcgaatcagtagaacaaaaggggaggggaggcgaccgaaccgagaaagaaattcaggcgagaatcgcaccgggggggggggggacacaagaaatccatgtgaaaactgtctcaacaggtcaaccttaggcacggccagagcacaagatacaagaacttggaggcgaattttggcccgccaagatcctaataatccgcacaagaaacgaaaagaacaactcgtcgctcgcaagaacacagcagcagcaagaacatatttcactacttctcccaacataattcccggactagagagagaaagcgaggaagggcgagcttgactcacctcaaggacgccgtagcatctgcgctcctgatgagatcatgcgaccacgagagagaagagaagtggaatgaagaagaagatgagattccacaggggaataggaggaaaaggaggatggatggggatggagagagagagagggagggaggagatcaggagatcctcagacacacgaaactactcaggctagcagcactagcagtgacccatcatcttctcctcctcatatatacggaggggaatagtatacttttctttctgtatttctctctgtagctttaaaagctctccttatttttcttttcttttcttatagatttagatttatagatggagggtattagtagtaggagtagaatcttttgctagagagagagagattgagatttgtggcatgttcggacacgtttctcctcctcgatctccttctgtatctccattctctctcctcgcatcgtctcactgtctgtgtgcttgcttgctgctgcagctgggttatcctttcctgcccggcacggtgcatttccgtctaccggtggtaaagtaattactcatgtacagtggtcatgtttctgaaaaaaaaaattctttttattggtgtactccctctatccaataaaaaaccaacgatttagttcttttcgcgcagggagtatatttgttcatgcggtacaaaccaacatcatctttactcgatttcggctagtcggcaaaacatagtgggacacacttatcaaatataaaccttgttaaaatgttcttatcattgttcgtaaagaagttagtagattgccttcttaacaaatgcaagggtgtggttaacattatcaaatcgccatcacactgaagtaagggttgttaaaattcaacaatactaaaaatggtagaataataatgcaaacatactataaccttactaacttctatcggtaatttcagaaaattttacttataacatttttaaattttataagtaccaaatcaaataacacctcgaccatcttaacattatcaaatcgccatcacactaaagtttagcatcaccaacttttgatcagattgatttttgcaacaaaacaaacaaaccataaaagcaatttaaacctttctataatggaacaggttatagtgataacaataaagacaaatgaagataacaaatggtagccattattcgggatgaaagctgactaggggcctatttgggttagctaagactttgagaagcagctgattggtatgcagcttctggtttctagtgcattttctaaattctacaactatagcttcttaggagagcttctgattctggaagaagctgcagcagctagaaactccctaaacaagccctaggattctaaagggaatgggtttagagacttatacatggcagtgtaccataggggcaagttatcggtgcacgttgtacaatgggatatttaggcttatgcatggcagtgtaccataggggcaagttatcttgtgataccgagcgaaagaagaacacatggtttgtaactcataatagatttaattgttacatcacattccgtgcaacaaaataaaagccagctgggcaaggtatataatgtgatattgttgaggcgtggttttttttggaggaaaagagagcttcattacttgaacgaaacagaggcgtggtttttgagattcaacaactcttcaaatggtaaatgaaagacaatgctaatttcgcccccgttgattggatcagacaacaatatcagcgttcattctgaaggtatatccttgaaatttggataaccttaccagagatctggttacaaatccttaatttcacctctctccttttttggttgaaactgataataaatgatgagcaagtcatgtaaatcttactcatacagtgagttgtacctctttctacaagtgtacctacaacaaccaagctacaattaatatctcttcaatgttcaattactatgctggtgtggacgcatagtttggttccattgtggtgttctacttgtctcacattgtctagctttggacagttttagaagtgtatttgcatctcacatagacactcattaattcagtccaaagattggaactttggaagttataatactccctccgtccaaaatataagaaccaaagatgggatgagacattttctagtgctacaaatctagacatgctatctaatattcaatcaagtcctagattcttatatttttggacggagggaatagctttgtttgaaaaggcaatttaagccggattggtaaattaggcagcctgtacctaccttcacgtggtgtacttggacatgcgtttcttgatattctttcctgcgtacattagagacaatcaaaccaacaaatcttcccgatccagccatcgtattttgcctgaaattcagttctgatgagaatattctaccagagaacatagtcactagtcactagagtaataagtttattagagcagaagcaatgcaagctacacatttgaggaccctaaaaaataccacatacactaaagacacggtccaaattttggttccccataccgcaaatggcctcgtgagaaacttcaatttttcatttcagccctcatatttttctcaaattacaaagaaatccaaattttatagcaaacaccttaaaatggagaaaataatataaatctcaaccccacccaccaccactaggtccacaaccatctccacttcccccacccacccacctagacgagttcaccggtgataccgcagcctccggcctctccccactctccccacctcggcaatgaactctggcaccgccgccagcctcttccttctccccatcgcggcacctctccactcctggacgccgctcgagcccaacccacacggagatgcggcggtggtcgaggaggccgaggcggcggcagagccactaagcaaatcgacgacaaggaggttggcacaagcagggggacgacgggctcatcggctcataagcggagcacgacgttgagctcggcagcacgcaagcgggggacgatgatgagctccgtggcacgtgaccggtgcccctccactcctactctccttagagggcgaggacctcaacgacggtggcacagatttggagtggcgtgggagctcgaccgccattgtcgtcgcctctcccctctcatgagagttgaggacgagccatggcacggcgacagaccccggctctcctctcccctctctggacatcagctccagcatcgcaaatcgggcggcggcgcgatatctcaacatcgggctcctccacttcaccttctccagtgggtgacggtcctctcctcccttctctagttgaggtggcgaggtcgcagggtggcagggcagcggcgcacaagtcggttgcagcatcggttctttctcctgctccacttttgcctagcaccattcctttttccaactgaggagctcggttctttgtttggagccgagaaacatcacaaagccatggccctccaccttctctatcttctaccacaacacctatcctatgtggcacaacgaatccacgcgacacggtggcgcgtggaggcccttctgctacctccaattttattcattttatctgctcattaaaaaaaatcatgtacacaataatatagtatctctgatatacaaatcctaaaactatagaatattttttattagtttgctttcatacaaccccacttctttttgtgcatttcttagagcttatgtagagtgactcgttctttttctccccatttatcttctacatcttatcattcaatcctataagtaaactaggtgattctcagcgctttgctacgaaaattactaagtaacttttaatattttttaataatcgagctaaaagtaaaaattatgttaagagaaaaaaataaatttagtagactctgtatgagattgtagatgaaatatgatatcccacactttgattatatggataaatatatgttaagtattataaaaatgatggatatatatatatatatatatatatatatatatatatatatatatatatatatatatgttaaaaatattgtgaaaaataatatgaaggtagatgattggatgttgatttgtagaatttaatgaattatagatgatgttgcatgattacataagttttgtatataattattgctagtgtatgatgaggtgacatgtttgtatgtagagatttagaattagtgggttataactttatagtaagataggatggctcggctaacgttttattacattaaacattaaatttagacacaagttcattacagtactgtaccagaagtttgttatctaatcaccgacattagaaatttgtaataattgaccgatacgagtgctaaatgcgtattgatggttggacctgttcatttgagatgtgctttatataggagtatactaggtgaaaccccgcgcattgctgcgaaaatttaatatgataacaataaaataaataacgtgtaagatagctagataacatcagattaagtaaattaatgtggtttataataattcaaatttaaatagtatgtaggatggtgactcaaacgtaaaaagtaaggtggtatgactttatggaagaaaataagtagggaaatagtttggaccgtagattaatcatctaaaggctaaaaacaattgttgtgatatgacttgattagagaaaaaaaggagaaagataatttagaccatagattaatcatttaagcactaagtgatgatgaactatataagtatatagcgtattataaaacataataataaagatatacattgaaacattatgtgaattatgttggatgataatttaatatgtttgtatttgaaaagctcttaaattataaaaactataaatatatagcatgtttgcatgatgtttaaatgtgatgattgctaatggatgataatgtggcatcttgttaattagtggatgatgatgtggcatctttgcatgttaagtttaaggagttagcgggggataactttatagtataggatatgagtataagtcataactaattttaaattaacttaaaggtacaagtatacaactattgccttaaaaatgatatctctgttttttttttggttctggatatgcgtctttggaagctgtataagcttatgcgtaggaccaacaatgatatctctcgtgattcatgctttaactttcggctaaatgcatggttggatcttgtcattttcatttggtcctctacttgacccactgggacacagagcttccaataaacgccgaaacactttgctgaacatccttggttgtatggtcaaaatctcatggagatgtcccttgtgccaggtaggccatcacaaaatcagctgatgatcactcatcactcgctctccttaaataccactaggttgctgccaaatcaaggagcagaaatgctgcggctaccaagaacatttacacaagagaaacaggcgagtgctttgctgacaattgctgggcttcccactcacagtgataaatccatgaaagcattaaacctatcaacaaaatcaaccaactatatagtttataattaattgcaaaaaaaacaaagtttcctaagtaaatttctctagaaatatagatttgtcatacatgaatttttcacaatttggtccttttcaaaaccttattttacaaatagacccatgaaaaaaacttattccaaaaatggtcctttttggacgccaaagtcgcttgcaccgtggtccaataggatggcaccaacaactctggtgccatcctcctgccaccgtggcgggtcggtgctgacatggcagaggagcgcgccaatgaggctagcaccgccctcccaacccacgccctttttttcctctcctctgtagaggagagatgtcttaggagcacataagaaccaaccatagaaaagttaaactcaaatggatgtaatatgtgacctgtagaattttccaaagctctaccgaaaagcttctcgcctcgaaaacataatcttgcaagcggaatttggaggtctaatttcaccaaacccgatgaagcgggggacaatcagatgtaactttttatgtacatgtccatgggtatagaatttgcctaattccgagtccgtataagaaagttatgcatgttttaaggaaggacactcgagtgtaaaagaaaaaactcaacaaaccctatttttttataggatactattttttttggttttttttactataggaaaaacaacgaaaaacaggaagtctcctaccgatataatcttgagtgaatttgaggagaaggggagagagcaagaacaagcagtcgaactcggacttgggaggggggggcgccananatgctggcgcgctccccctaccatgtaagtttctgacctccacggtgatagaagggtggcgccagcaactctggcgtcaaaaaaggactatttatgggttaagtttttctaggggtctatttgtgaaatcagtttttaaaaagaatcaaattgtgaaaaatccagtttgccatactcattccgttctgaaaagacgtttcgtgtttttctcaaattaaatttcttcaagtttaactaaatttgtagaaaaatataatattatttcaaacccaaaaatatatatgctataaaaatatattcaatgatgaatttaatggaacttcatatagtagatattgttacaattttttatataaatttttgacttattacaaacataaaatggcttatgggggaaattatatgttagggtaatactaactgttaatctaaatgttacatatggttttaagaaactgcaaattcatactttgttcaatataagagtaacctaatacaaatataacatatatatatatatatatattataactataaatctggatttagtcctaaaatatactagtatcatatctgtttgtatttgggacgaagatagtatatggttgttttgtgctgctttgagcgcgcctgacgtgtggtacaattgcctttgattgggacagttctgttttctaatgatgattcggataggttttcaagcgaaaacaaataagcatgtccacatgcttgtataagccaagtaagagttgcttcactttacatatcaccttcatgagttgactgacatatatgcaagtcaaagtcaatgcagccgtagattttagactttctgaaaagtggagtatttatgttggttgatgagaccccaatttttgttttgagtgagatttaattagggcctatttggttgaggactaatgctctacacattaactaagatgactaagttcagtcttgtcacattttgtggcaaacaaaatgataaactaaggggttgtttggttagcatctaatttagtagatagtgtttgttttctgccacaactttactttccttagctcttagccacctgacagacatgtcatatattttatttttcttacctaactttggttaagcttagtttgtcattttatttgccaaaaaaatgtggcaagatgaagctcagctattttagtaaaaaatatgtggcgtcattagtccccaaccaaacaggccttaagctagggctgtcaaaaaaagctcgaggctcatgagctattcgagctcgactcgtcctaggctcgattcgagctcgacttgtcctccaaacgagcaagcccgagcctgtcccaaagcttgtgagctttatcgagccgagctcgagcttctaacgagtctagtaatatatgattttttttgttgttatttaataaattgggagatcaaatatgttatttgtatgccttgtattggcatcatatatttattttattatttttcctcttctgctaatatgatgaaccctaaattaattattttttaaagattatcctttgaaatatacattgttctatttaaaaatcaagctcggtagttgactcgagctcgaaccgagcctgtttgaaagctcgaacattttataggcttggcttgagcttggctcgagtttgtatcgagctcgagcctaggcagacgagctcgctcgagctcggctcgttgacagccctaccttaagcttagataaagttagataagaaaatagagtgtatatgacatatggccaggtggctaaggttatgtaagatggatttgtggcatgaaccaaacattatcgactaaaactgtagcttacctaaggtaaggtgtggcaaatttaactgtagcttacctaaggtaaggtgtggcaaatttagttgccaaccaaacaactagtcgtttatctgatcatgaaaacatgtcactcttactccatattggtagtataatactgcaatctctccgacaaaactttgatcactgatatttatattgttgtatactagtacttccgttttatattacaagaatctttaacttttatctaactcaaccttttttaaagtttgaataaagtttataaaaaaacttagtaatatttttgacaccagataaatatattaccaaaatatattcaataatagatttaaatgcatttggtgttgtaagagttactatgtttttatataaatttgatcaaccttataaaagtttgattttagaaaagtcaaaatcattttataatacgaaatgggtggagtatttgtgaaatcaaacaaaactgaaatattgttaaaatatttttcaagacatgtcaatggtatgaatgtcaatggtactagagtaactttttccaagacactgccagatgccaatgctgtcgctgtgaatctcatgcaagctagggccatatgatgtagtactaagtccgtcctaaaataagtacagccgtagatatccgtctccaacgtttaaccgtacgtctgtcttatttaaaaattttgtgaaaaatttaaaaatatttagtcacacataaagtattattcatgttttatcatctaatagcaataaaaatactaatcataaaaaaagtttctacgtaaatagtacaaaactgcacttattttaggacagagggagtacgttctcctccatgatagattcatttatgcaagagcaaatgagtgaatgacactttctgttactgaagtttcgcttagagccaacctttacctaatatttttctttggactaaatattttggtctttgttattttaccaccttaatgctaagtgacggctctggaaatttttccttaacagtgcctacttcatgttcgaaattgccatatcactacaaacttaatataaatttacaaaaattgctcaaaatatagtacaaaatagtccctccgtcccaacatctaaggatttttaaaacttcacgacggttttcgaaatgctactttgactaatatcatttatatagataagtttttcaaaataaaaagatttacatactatgatactggtggagaaaccatctctggtcggtcgacccaaatccacaatagtcctggttccattaaaaaccgggactaaaaacgatttttagtcccagtttataagcataacaggactagatgatttttattcctggttggagttaccaaccaggactaaagatctaactttattcccggttggtgttactaaccgggaataaaaatcaacacgtactatataatccctattacttatcctctttttccgtccacacaacgaactctttctctatctcttttttcctctctaagtccttatcctttcttctttcttcttccttagttcttccttcttccttggcgccgcttggatcggagcgagagcggccagccgcttggagcgagagcgggccaggcggcagccggcggctggtgcggcagcgcggagggacgggtggcggtggccggccggcgcggaggggaagctggtgcgacggtgggcagcagcgcggagggccgcggcggcggcgcgggggccggtcggcgttgaggggaggcggtgcggcggcgggcagcggcgcggagggccgcgacggtggcgcggcgtcgggcagcgccgtgggggccggccggtgcggaggggaggcggcgccgcagcatggcggtggccgaccagccggcgtggaggctaggcggtagcggccggccgtctcctctgttgttttttttaagaatttgtgatttattgcaggatcatgtgatgaatttgatttgtgtgtgatgtgaacttgtgatgtatttgtgatgaattttgtagaaacttgttgtcgacgtttgatgtcgcgattccggtatttgcatagtatggggatcgttggtactagggtatatgcaagactgagataaaagagatggagactgggatttttatacaggttcggacccctgaattgtcaggtaataaccctacatcctgttggccgaagccgatattgctcttattcaccataatcacaccaatacaatatttggggcagcctatctaactgttgtcgatatggcggtctgaaggtctgactcgtagtcgacaacagggtagtcttcctcctcgagttcgtgcccgacgagatcagagacagcgctttcatctctcctgacagtatccggagacatcgtaggggactagccgtgcttatccctgaagtcgatatccggtgtcttgtcttggcgtatgttggcttgtatgttgtggcttctgttgttccgtagattgtggtgggtgtgtgcattgtctcttctatggtgggtcttgtatttatacccataggtgtctccttgtccaagtagaactagggaaaccaatatggatacaatccgagtagtccttgtcgtttccatgcagaactctagttgtctttccttatccggaactcctcctatatccgcaggttgtttccgtataggacatggtatgtggtggatcctgccgagatttagtcaactactattaggtatgtggtatccataaccctgacagtagcccccgatttcaatgcaaatgagcaagttcatattctcaaccgcagatcttggaggaactgttatcgagctctcatgaccattctcgatgagttcagagataacgttagacttcctttatcagcctcgtgcgggcacctaaagggtttgtctgagtcaatctccgacgtcaaccaagaaagtaaagagcatacgactaagtctcccgtcttactgtaatcgagaatttggattgaagtcaagaaattttatctcggcgggtacaccatttcttcattccgtattccttgtcgagatccaccaaccgttctcgagcgatcgagaaggtgtagaatctgcgacgaagccttatcaacacttgtcgtactcgccttagtcgatcttggtgtagaaccatagagacatgaagtcttcgataatgtcgaatagaattttcctgaaatcaatactcagaaaagaatattagatagaaatagcctccgagcgaacgctcaaagggtaacatgttatagaatgtatggaaaaccgaaaatgaattaaacttacagaccaatgttttgtatatgagcgtctactcttttaccgacttcgatcagtcagtttgtttagttatacactctccctagcccccagccttgtcgtcggagaatcgttctcggaggataaggctcttggacctttgacctaccttggttgaacaagcactgatcctagcccccagccgtgaagttggaaaatccaatttccgattacacggcttggttaatacgcacggcgagaactcttacacgaccagatcttacatggtctttcgtctctgaaggatccaacaaggccttatccgctctgggcgtccctagccgaagttcccttaggttcctcagaggccttgtcaagacggcgtaaagggacattaggataggtttcaacgctaggtgtcttttgtggtaagggatctttgggtaaaacacttggcgatattgtgcacctgatatcaactctgttggagtagagataatgggagaatcgctacacctctggtcaagaaccaggtagtagtcgtaactcaaccactataagtaaatgtacgagagatcgttacgattgactggttgagaaccagtgagtaggtgtctctcgatcatttgaagtcgtggtacgaggaccgctgcgttattgctgtagtcgtacctcgaccatctgaggttgcggtgcgagagattgctacgtactgcttcgaggaccaacgaacgtgtagaatcatctctcgaacaccaatggaggttgcggtgcgggagattgctacgtaccggttcgagaaccaacgagcgagtagaatcatctctcgaacaccaatggaagttgcggtgcgggagattgctacgtactggttcgagaaccaacgagcgagtagaatcatctctcgaacaccaatgagggtggcggtgcaggagattgctacgtactagttcgagaaccagcgagcgagtagaatcatctctcgaacaccaatgggagcgctagagttggtttattacatgtgcatctcatgtggccagtatgactcacacacccaacttgtagcatatctggatgtccgttcgcaatcatgttgggtgatcaagccgatagcgttcgcgaggaattatccgttaccaaccttttctcgagtagtccagccatggccggtgctatgagataggtcgtcggtcttcgttggtaggttgggcgtgacgactctacatctgtcgagatcgttctcgataatgcggtgtacttgaccacaacctactcgagtgctcaattgtccctgaaaaatattttctagaagacaagacatatagcagataatatcgagtatgtactcaaaaaactgcatggatcttctagcattatcaggatataacgagcagattaaatatcagggcattatgtaaaccgtagacaagcatgatttatacggaaggaaataaagcaagcccccagcgttagaccgtagtcgatttaacatcggggacactcgcgcaatagatagtgtataaaaaacatgctctaggtaaacataataaatcatatatatgataatatcgtatggtctgaaaaataggtacggtaatttgtatataaattattgcgtacctttgtagatacatgccggatgtatctacggaattagtagatcaacttaaaaaaccaatctaccaattaccttgttgcgtactcgttcaacatcatacgatctgacatctttcggtacgccgcgaagcttgaggcttggatgatctcgatagaccaagttgtcgatgacgatgatggttctgatctggttaggttggatctccccctcagctgaagtcatcgagtagctcattgtcggagaatccatcccttaaacccatcttgtcgaaaccttgaagcaccaaaagatcccctacctggcgcgccactgtcgacgtttgatgtcgcgattccagtatttgcatagtatggggatcgttggtactagggtatatgtgagactgagataaaagagatggagacagggatttttatacaggttcggacccctgaattgtcaggtaataaccctacatcctattggccgaagccgatattgctcttattcaccataatcacaccagtacaatatttggggtagcctatctaactgttgtcgatatggcggtctgaaggtctgactcgtagtcgacaacagggtagtcttcctcctcgagttcgtgcccgacgagatcagagacagcgctttcatctctcttgacagtatccggagacatcgtaggggactagccgtgcttatccctgaagtcgatatccggtgtcttgtcttggcgtatgttggcatgtatgttgtggcttctgttgctccgtagattgtggtgggtgtgtgcattgtctcttctatggtgggtcttgtatttatacccataggtgtccccttgtccaagtaaaactagggaaaccaatatggatacaatccgagtagtccttgtcgtttccatgtagaactttggttgtctttccttatccggaactcctcctatatccgcaggttgtttccgtataggacatcatatgtggtgggtcctaccgagatttagtcaactactattaggtatgtggtatccataaccctgacacttctgatgtaatttgatttgtgtgtaattttttttaggatttgtgatgtatttgatttgtgatgtaattttttagaactttaagatttgtgatgtggacttgggatcttacttcgatttgggatatgcataccacccatattcgggagaaaataaaaaagtatatgcataccacccagattcgggagaaaataaaaaaggaaaaaaaacctggctatcctctttagtcccggttggtgttggactaaagataccctatctttagtcccagttggtgttaccaaccgggactaaagatccatctttagtcccggttatttcaaccaggattgctactcccagttgaaaacccgggactaaagggggttcccaactgagagtaaaaatggtttctctaccagtgatagtttgtttagtgataaatctagtaacaccattctcatgtgatcaatctttttaattttttcgctattaataattaaatttaaaaatatttgacttagcaatattttaaaaatgtttatattttgggttgaggagagtagtaattatttttgcaaaaatataatatgaacatacaaatatgtcaaaatctagagtggtagaaggcctacatggaccatgccttggagccgccacaactaatgtttatgtcgagccacatccaatcttttctctggcaaagatgtaacttgcacataactagaggaggtcgtcactatgaggatgcatatgttgttaaggctgctaaatacgctcacaaggagatttggatggttcaaaatgtagtaaaaaaaaaagagagcaaaaactcaagttcgaagtgaaaagttacagaaaaagtgttccaaagtgaacaagatatatttatccaattgccatgtttctctgttttatagtaatattgttagaacacaatacatggattttgtcaaacacgaaacgtctggaaccagttgtacaaaacaatattccctccgtcccataatataagagattttaagtttttacttgtaatgtttgaccactcgttttattcaaaaaaatttgacattattatttattttatttgtgacttactttattatctatagtactttaagcacaacttttcattttttatatttgcaaaaaaaatttgaataagacgagtggtcaaacgttgcaaacaaaaactcaaaatacagagggagtactaaagttcggcacaccattttcccaacccatttactcacatctatcgttttccgcgggcatgcttttcaaactactaaacagtatttttttcaaaaattttctatacgaaagttgttttaaaaattcatattgatccattttttttaaagaaaattaactgatgcttaattaatcacgtgtcaagagaccactccgttttgtccttcagaaatacgcttcctgcaatttcaattcagtagcacaagttttcaatctctcatgaataaatgggcaagtacaagtaccatgatcgaccgtgtgcgatttacataatattcacaggttttgagaggtgagtctgtacatagcaccatttcagagttcagaatgcaaactcagagaaccacaaccaaaatgagcttcagattcagcgcaactgcgttgccacacgacttcgtggtggaaataccgcaatcctttctttcccaacaaaaaaattactgcatttcaatcatacttaacttgtcaccgttttcgtccgctcagcaaaccatgccttccagtcagtaaccttttcgtcaccattggccacctgaagtatacgcggaagataagaaacaggccctaaacttgtttgagctagtaattatctaaaaaataagaaccttgaagcatatgcttgagctaattacctcaaaaatgagtgttgtctggggaatggagtccagggcctccacacagattgtagcagcatcttctttgctcattcttcccttggctgctgcaccctacatagttcaagaatcatatgagagtttaccaaaaagcagaacatcagagcagcaaaccaaattgatgttcccaaaagaaaatattcttatcaatttgcctcttcaaactgctaggtggaaactacagcatgcttcgaatgaagggaactactaatggtctaatattacataacgaacattataatatttgaatgtctttgcctagctcattgtgcaaggttactaaagtaagataattgccatgctgatacctctgtaaaatcgaaacctctatcaccaccaggagtgctttgcatcgagccagtcctgattatcgtggatgggatcccagatgcaagaaccacttcttcatccctctcagcaagtttccgcagtttgctgttcataatagcttggagaccaccgctacctctgtagacagagagctgcattcttatcaagatctcatatggttggtgattgaatctaagctgaactggattagacaaagttacaaaagcactgaaacctgggatagcagaacaatgtgttgcacacccttgaggtccaagtcagagaagaaaccatcctattgaagcataaatgtttaaaggaagcaaaacttagaatgaggaaggaaagggaactctagaagcgatacgacgttttcgtgtaagtatggagcacagaaatggttcacaatctctcatgccataactcaaatctaataatcgttatctaagaaaaatactaaaccccaccaataccctaatcatcaattgcagtcaatgtaattaggtaatctgataaatcaataggccaagaaaacaaagtttgtaacatacatcagctggacaaattatagcacgaacaccccttagtgctttctttgtgaaggacttatcttccatattaccaaccatgcactacaaggcagcagagaaagtgattatgaggataatatttcactaaaattgttagtacaagcatgatgagaaaacatccaaaaacatctatggcctttttctaataactgatgcaccaaagaggtggtatacaagaacgaaaagcatgttaaagctatatgtgtgaattacaagctgtcacctccacgtaagttccaaatgcttcttcagtggatcgcctgtccttcactaatgcttttattctggcccttttcaggattaatgataatatcaccatctgaaaaaaaatatgggcagtttaatatgaagcaaccgagaaaagttaaaaggaacatgtaactcaagatgaaaacaaggaacttgcaaggttcactaagaaaactattaaaacaaagaacaggagtctttctgggccgacccaagctaggccaaccaaatttacttaagattaagggttacgtacaaatatacaagctttcttacttcaacaagaagctgtcaaagtagatggaagttgccacaaaagcgacctcccaaaagaaaaacaaattacggctcggttttactctcctaaattcctgatagtgaatttatccgtagactgtctcttgagcatttgttaagggggccactcatgtgtgtgtgcgggtatggtggtgtgcatgcacgtctgtgttccatgcagcaaaaaaaggagaaatgattgaatcataaaatggtttctccaataagaatatgcatagaaagaatattcagcggaaatccatataggatattatattatatggaaataattatatacaccaatcttaaatctcaaattactcgcctgacatgtggctgtggatctacattatctatatcctgaaacaataagttgatggtataagtttcaaattattgcccaatgatctgatcatgtggctgtgtacccacatatcaagattgtagtataatattctggtcactactcactagtgaatggcaagcaacttttaggctttgtgaacattggattcgttagcaaatctgcagcagaacaaaagagtaacttgaagaataatggcaacctgtccaatctcgctatcgccattggtgactagcacagcatctcgaggctcctcgatatctatttctcgtcccaaatttgcaataaataagaaacagtgtctaggaaagggtaaaaaaaaaaaagaacgcagcgtactgtttctacgcacctgaaggctcatcctccccatcctcagcactcccatccttgggaagcaaatcgggcgctccataccaccgcctcaactttggaccccctatacgacgaatatttcagaagaatgcaactaagtcacataatgctttagctagttaagctgtccaataaaataaaatcagcttaattttaaagacttcgtccactgacagacaaggcaatgtaatgacagcaattgcatgtcaaactaccaaagtacataaacaagtttgatatattttttttcttcatttttatagcatcactgcacggctacccgtgcccatgaatcctgcaccagcaactgaagaatcgagaatttattttgtgttgattcaggggaaaaaaaaa

SEQ ID NO: 25707 - DNA, 493 bp, Oryza sativa
tgcggcgcgtgacgtcacgtcgtcgtcgtcggccggatttcgcgtgcgcggcggaggtgatctctcgcggcgacgacgaggataaggcaacaagctcagtcatgggccgccaactctcacggcccagttcagccatgggccgctaactccgacggcatcccacgatggtacgggcccagttcagtcgtgggccgggagttttagggttttgaggcggcggcggcggcggctgctccgcctcctcgctttaaaactggacgcgtcggctcgggttcctcatcgcgagggttttttgctgctgccgagaggagtggaggcgcttccagatctcctcccctctctactcccgtcatgagccgatcggggcagcccccggatctcaagaagtaagcctccgtctcctctctctccctcacgtgtgtttccatcgatttttaactggtgttcggtttactgatttgagtttttctttggtgggtcgccaggtacatgg

SEQ ID NO: 25708 - DNA, 5237 bp, Oryza sativa
  unsure (1)..(5237): unsure at all n locations
aaaaggttttacaatgggaaaggttgacaaaacgttttttgttcttaagcatggtgataatcaactatgtcgttcagatttatgtggatgatatcatctttggttgttcgactcacgctttagttgtagattttgctgagactatgcgcagggaatttgagatgagcatgacgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctacagctgtgttggatcctgatgaagatggtgaagctgttgattaaaaggagtatagaagtatgattggatctttgttgtatctaactgcttctaggccagacatacagtttgctgtgtgtttgtgtgcacgctttcaagcttcacctcgtgcttcacatcgtcaagcggtcaagcgaataatgaggtatttgaatcatacacttgagtttggaatttggtattctacttcatcttctatatgcttaagtggatattccgatgctgattttggaagttgtagaattgataggaaaagtactagtggaacatgtcattttcttggtacatcattgattgcatggtcttctaggaaacaatctagtgttgctcaatcaactgctgaatctgaatatgttgctgctgctagttgttattcacagattctttggcttttatctactttgaaagattatggtcttacttttgagaaagtacctctgttttgtgataatactagtgctatcaatattgctaagaatcctgttcaacactcacgcacaaagcacattgatattcgttttcactttttgagggatcatgttgagaaaggagatgttgaattgcagtttttggatacaaagttgcaaattgctgatattttctctaaacctttggattctaatcgctttgcttttcttagtggtgaattgggcataattcatccttttggcatggtttgagggggagtttgtacctcatggttttatcaagcaataatatgataatgagaaaaaaattgagaaaagagagctttgtttatgcatatggtattttcttgtgcatgctagcaatattttgaaggtttatttgtctctagcatagcttgtatgtattctagtcttttcatgagatttagattttgcttttaagggagatgatgcatgacacttaaattctacttgaattaagcaaatatgctatgttgatgctagcatatggtttgatctataaatgctctatatatatgctttattgacttgttattcctcaaatagctttcattgctcattgtgaaaaagagaataaaaaatatgaaaaaaatgaataccgaatccttggaaacagtcttgacgataaggatgtattcgatgtgagcaaaataatgggtgccgaatccctggaaacagtcttgacggcagggacatacccggaataaaagagaaaaatatgagaaaaaggcttaagaaaagaaaaaaattgaagaaaattctcttggttattttgtgataatggttatttgagaaagagtgattaatgcaataggtaaatgtgtttagtgtttattcttaaacttatgtgcttgttaagatgttgcattataaatcgtatgaaatcatgaattttgattgttgatttaagcttaattataaaatccttggttcatggttatactttaatgcatgcttgttctgttatagatgggttcatcttctttttattgcaacacatgacttgatatgctatatgtaagataagctcttgaacattaatgaacataattcctatgcttgatgaaatcattgtcaaaaggaggagaagtaatgtgcaaatttttggatttttgggagaagcaaggtgaatttttggagagttgttgagaagagcatgttttttgttcaattgggaatttctttcttttaaaaagggggagaagttttcttttggtttttcgagcacgatgtgtacgtttgtacgaagtgtgctttttaccacttttgtttttatttttccaaacaccaaaacattttcgatgggtttgccaatgtgttcatcaagggggagattgtaaaaatcaaaggtgttttttattattattctgtgatgaacaattgggcattggagattattggttttgttatttggaatttattcacgaagtggttttggagatgattggatttacaagtgaatcacaggttctattattttatgtgaccggtcaaaccgggcaggtattcccggtcagcccggcggtatatgcgtggtcagaccggccagcccgcggtctgactggccgacgctgtgtcggtttcggtttcgggttgtttgtttggatatccgtgattgtttcatgattatggcttctagatggatactatacgtatgtaatactgttgtttgctactaatgagtcaagttagagatagcttggtctcagaatatggtttctttgtttatttcatgtgtaggtgactcgatgcctcgggagagtatttgcggtgatggaccgggagtcggcttggggataagacgacgtccgtggtggtcagagatcatgcgggatacttaggctagagttgatgcacgtggttgatggagattccatatggcatacgattgaggtattgtgtgcgtatgggatgcggaatcgaatttggaaggagtccaaatttggtacgattggttatgtaaagtttgtttcttgtactagagggtttcctaaggtgtttaggactcttagtatgagtttggttcgtggctttaggctgcctacctcatgtataaatagagagggagcgtgagacttctcggtatcgctttagagagcaattgagttgagttttgagttagggtttcgagtttagtcgaaatttttgtaaggaatgctgttggtgcactttgtaaacacagagagaatcaacaaagttgtcatctactttaagagttcttcgatttgtgtttcaccgggtttcggcggtctgaccggcggcgcaccagcggtcagactagtggcatcgcggcggtccaaccggcgggcacacagcggtcagaccgtcttcggtgacaggaggcagtgacgagttttggcggttagaccggtagatcaacaccggtcagaccggcggctacgcttcggtcagaccggctaatctactccggtcagatcgatctcatcaaaattgagggtaacttttatttccgctaaaagttttcggtttttgggtataccaaccattcaccccccatttgttggcttatttcttatatttcgatcctacatattagaatgacaataaagctggattacacataggaaattaattcttcagattctaagacaatctgaagaaagaggaaaatgtggtagaaaggacatcacgtcggtttgattgtcaatgaggttcgtccatattgctggaatgctggacgagactgacgacctcgcctctcgtcatgtatcgtcatctctacttgttggcagccatgcaagttatttttcaggttttttttcagttaaaaaaaaaaagtgaactttctgttgttgcacaattgtagtggcttgcgattagaaaatttagaggagtttgaggtcgaattgtcatctcaatgactcaatttcccccctagcgaagcggttgcatgagcggaagcaatcctccttgcttttgaagctcgacattgcgcaggcattcgattccatctcctggcaattcattatagaggttctggaacacaaagggttcagtagccgttggtgtgcttggattgccatgcttttccgaacagcaagcacgcgggtcctgatcaatggcataccagggaaccctatcttgcaccggcgagggctgcgccagggggatccaatctctcccatgctgttcgtcctcgctatggactcgttaagctctcttttctctaaagcagagaatgaagggctgttacagccgctgcacctgccctaccgaacttccctctacgtggacgacgcggtcgttttcattcagtcggatcctgaggaaatcagcacaacaaaggaaatcctacacatctttggggaagcaacagggcttagggcgaatttcgccaagtgtgcagctctcccaattcagtgcaacgacgacaacattgcactgatccaggatgaacttccatgtcaggtcacagcattcccttgcacttatctaggactgcccctttccatcttccgtcttcgcaaagaagacctgcagccgtttgtggacaaggtagcctgtcggttgccggtatggaaggcagagcagatggcgcccattggtcgggtcactatggtaaatgcggtattaagctctataccgatctatctgctgatggccatcaatgtgccaaagtgggtgataaagagaatcgataaggtccatcgcggcttcctctgggcctccggtgccgctgggcttggcaactgaggacatcgccggaaaagccatggcatggactcaacgttccgatctcgcaaaaggagaggaacctgctccaagtctctttgacatgtcgagtcagcaatggaaagaacgtgctcttctgggaagacaactggatccaagggtcgtcaatccgcacccttgcgccggctatgcatgcagcggtcgtagcaagaacgcggaatcgcaggacggttcgcgaagcactccaaggtagaacatggatccgggatatatctgggctttgggaatccaagctatcctagagtacctcagctggtggacatctttgcaatccttggatgccctattggaagagccggtttcaatcatctgcagatgggagtcgttaggagaatactcagctcgctcagcttatcagtccatgtttgtgggaagggtccaattccaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25709 - DNA, 1407 bp, Oryza sativa
cagtagttcatcaaagataagaagaacacattattgaaatctatttgtgaatctccaaccataattgataaaaagtgacatgattattgtctcaagcctatcgtatacagccttcataaactcgtcatcttcattataactttgtagctaagcccaatacaggagccgatacgttctgtagagaaacaaaactctcgtttgggtcgctaggagtagtatttggtaacgtgattcggaatttcggaccgtctcgttcgtttggttcctgatttttgtataaaaatgccccttcgtttgctagcgctctgacattacgtcaagtaaggagatgcgagttcgtgtgcaaaactgtttccatctttaatccgtgtgagttctgcaatacaaatatacaattacagctccaggaagccaagcaatggtcaaaaatcaaggtacaacttattgtacgcaacaaatgaagttagaaactaagtttccgaaaccctcttcaagtttccccttcctctagcatcatcggtcagaggggaacaaaattgtagaacaaaaacaattaattccacctataatcttcaaatgaagctgatagtggtccttgtcactctcgagcagcctcagctgacagccgcggcagcaggaactggtggcagatcaatgacaccgtggcaccgggcacaaagagtaggatggtcaaggaaagatccaacgtctcgggtataattccagcacctctcacatttttcgccatcggcgcgagtcacaccaatccagatgttgccggtgcgctcactgctaaaagttccagtgtaggatacaccagatgtagtttcggagcttacggaaggaaggatctccacctgcagaaacaaagaaagatggtgtaaaaaaaaaacttgaatgcagaagggcagcctctagttttgaatttacctcagatgtgataaacaggcggtgcagagcatcagcgtcattggttgccgaaaccagctcctttagtttggacactgtgttagcattttccgcgtggagataaacttttgcctctaagctagagcctatcagctttcctgttcgagcactctccaaattttgtcacctctgatctcaactgttgccaagtaatggaattttttaatcatgaaattaatcttaatacgaaatcataaatgcaagttcgctcatcaccatgaaatcaagaatagccgcaatgtcctataaactataggatcaggtaatttagcagaaatgatgctatttcagatcataagtagtagttactcgtgtatacaagaaatcttgtctgagttgcacgtctccaagttgaaggcagagccttatcttttaacgtaagtttgatattcgacctataggaaaaaaactgcaaagctatataacctatgatgatgg

SEQ ID NO: 25710 - DNA, 237 bp, Oryza sativa
tcaaggactccgaggcttgagttgactcttcacctctggtgccacataagcatcaagctcctcttgactgcaatcgtacggtggctccttgtttttggtggcatcaattttcgccttcttcattgcccttgtgcgggcaggtggtggagcttggcgagaccttgtcttgggaggccaggcggacacggtggaggcggaggagttggaggagccggaggagccggaggagatggtgca

SEQ ID NO: 25711 - DNA, 681 bp, Oryza sativa
taacgctgaccttgtgagacgtttagacctgacaatatgggaaacgatacaagtgtgaaagagcttgcatcatcatccataatttctgctgccattgcatatattatattcatgataaaaaatggatattgctggctgctgaaagtagagagagagagagagagagagagagagagagagagagagagaccaaagagttctgtaacttccagaagcttcaacacatatggtacttgaagtttaagagaagcgttacctgcatgcagaaatgtgacttccgcatagccatctcatgtgacaacaggcatttatattcttgccaccacagtccgatttttccataagctgatatatgtaaggtgtaacctcctacagttcaacattgatacaaggcccattaagaaagaggaaagggataatgcacagtttgaattctgtacctggaagcatatgaagtctgggttgtgaagttgaataagatctccaagagcgcccagccttctgtgcagttcaatatcctctctgatccagacattgtatgtcatgattttgaaggtcttcttgtttaaattattctcaaatttttctgcatgacaagatttgtattttagtgtggccatagcgaagaagaagaataaaagtacagctttgaaggaaaaataaacttctaattatctagat

SEQ ID NO: 25712 - DNA, 622 bp, Oryza sativa
tcggctccatcatggagaccagcgccatgaagaagagctcgcagtgctcctgctcgtgagcgacacacagagactggatgttcgctcgtgtaatgtttttgtttcgacatatcgattattacacattcacatcatttcacctcgcgttcttgtcaattatagagaaggattaggcatgtaaaacattgtaaatttggtgattgacaagaaatggtttagattcttcatctgtgactgtgattatctacgcgtgcgtgatgctatgattcgtcgcttagctaacagagcaagctagctcggtttttctaatgccacataagcgcaacgtggactttttcctatttcatatacaaaccattcaggcgcacctgtgagtgggccgcgtggcctcgtgatgccatatttgggccgtttcttcactgtatgggctagaaagctaggcccaacaccagaattcggcccagagaaagttggagatgaccaggttgtgcaggtcaaagggttcggagttactaatcaactccaaacgctggcgccggagttttcatttctgaccccgttggcctttttaaagatcgaactggtgattgagtgtctccgacgagcatagcaccgagcacgt

SEQ ID NO: 25713 - DNA, 64668 bp, Oryza sativa
  unsure (1)..(64668): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattatgtattgttagaggaaaagagagagcaatagtacactagtaccaatcagcagcccgatggatcggtagatagatttggggcattctcccttttttatggccttggccctacatatgtacattgttagaactacttgtgcaacagctattatgacttgcctctccctccaatgactcttactataaagttatagcctacatcatgattcactaacaattattacatttatattttttaaatagtacagatacatacatagtttccgtgtacgacagaaaactcgaatggcataagatatttcggcttaacccccaagcaatcccatgcgagtctaatcttgagaacagatccaaaccaaaattatatttatactgcaatggtatgaaaagaaacaaaaaataacttaccctctcaaggcagaaaaagtaaaaccaggtgaatcatacaaaaaaatttgaatcaaaactgccaaccaattctcctttttttttactgaatattgcaagttagtattgtgcaatgctttcgaaggtctgaaaagtaatgagatatttatcttctcaaaaattagaatagctatttttctttgacaaatacaattatgctagtactagatttaaagagtgtacaactagatagcataatacatggaatatatcttcgatcgctctcgttccgtctcaaagaatcagatatgttccaattcgcatgaactgtcgttgctaatttaatactctatctcttttattataagtcttagtcctatttctttaagtttaaccaaatttatagaaaaatatagtagtattttccaccaaaaaatatattatcaaaatatattcaatgttactaatttttttataaacttagtcaaacttaataaagtttaattagaaaaaaaaaccagacaacttataatatgaaacaaaagggaatataatccagcgtcttgaaagctatctgatcagaaatgcaaaaaaagcttcacctgattaacatgtacatctgacttaatttggaccaaactaattgtgacgactgtacagataggttcggtacggccaatgtctccaacaacatatattcccaatggctaatgtatatcacaagcaatgtctttattgttataaggtgtatcactagggattgatttgcctggatgattcacaatttctgctttgatctaattgcagagacgcattatgtggatttgtggtggataaactcctggagagtggagatctaaggaattgaattgtctttccatccaaaaaaaaaggtattgaattgcctgtttttctggagatcactaagcaattaaattgtctcgatgaaaagccctggttgtagatctttctatccctttgcacacatggccattaaacacaatacctcgccatgaaacacaataccatgcatttgattcttcttcccgaagccctacagtacaccaagcattccttcatgttttctcccacagttactaggtgattcgtagcaagataatgcccaaccccagccagcaataataatgaagggaaacatatgcagagactgtaatctctccacagagcacacttgatcaacttatcatcggaaattgcaggaaataagcaatgcaatccagtttatcttcagattaactgaatatataaccaaattaattaagtattctgtattgaactttccagattaacataattaaaaatgttttagttcaagaggcaattgaggatttaaaatacaaggctacaagttccttcctacatggaggtaacaataactgcaattgcccggccgggcatctagatcacgagaaacaagatgagatcttcataaatcaacccataattctgaacttgtcgagattgttaaaaagtgcatctaaagcactactctctcaactcacaaactaagattgaaaccttaaaacaaaccctaaaatttttctcccaaaaggtaaatgtacttttagcctcaatccctcttctattacccataacatggttgctcctagccacgaatccaagcaaaactaggacacctaatcacatagaaaacctaccaaatcagggaaacagcatcccatacaactccgcactccaaacttttcaaatttggactctaatccaaacttcacttatctttccatatgcacacaacaccatgtgtatgccataaaaaaaacttcacctccacatgcattgttttcaagcctgagcgcctcgcgtagacctcaacttctcctaagcccaatctctatccatcaccgactatactctcatggtctcaagcaacacctgcacatgaacaacaaagttggaacatcacacagatcaaaaccagattaactacaactactcaaaacctgattaactacaagtacttaatgatgatctaacatatatcaacatatgtcagcaccttaccatttgatgacaccgcaagatttgtaatcttattctggaacttgtttaacacgcatggtaggcatatcaggcctttattgagagaaaatcccttgcagcagcctgaattttgaaccaataccttatgtgtttatgattttttttctcacacccttgtatgcccctaaattctgatttttttttatctcttccatacaaatcatgtcgattgaccgctttaagagctattgaaaacaattatgtccttaggccctgtttgattcagcttaggattattataatctggattattaggagtaagctgaaacaaacagatagcttattatgataaattattataatctataagccagattactataatctggtaagccactctaaaggtgcttattttagattattgggtggctaacaactaacaaacagataataatccagagaaacaaacagctagcagcttattctatatcggcttattataatccagcttatagtaatctagttttataatctagattacaataatcttaagctgaaacaaacagggccttagatgtgaggaatcatctcacctgctataccatttggcgattggtgaagttggaacataacccgtatgtggtctgagataagcttgaacttgtgacgttgttgatcgaggagcatatataacagaaggccacttggttggccgaaggagaaaaacttggttgtctagatctctacaagttggaaggcactggttgtatttgtgcctttcttggaactcacttggttcttctatcacggtatatggaacagatagggtgtaagggagatcctgctggctctcaaacctaatacgcattgttagtttgagaagcaaattgttggcatctgcttgccaggttattccttgccttctgctatgcatgagctgctctcattattgtccttgtgttgctctctctctctctctctctctctctctctcatatacaacactatacaagcatacatacatacatacatacatacatacatacatacatacatatatatatatgtatatatatgcttgtatagtgttgtgaacggtaggacaaaatgtgggactgtagacctggttaaaagaaaatgggccagaaccgatgaacgtttggttcgtttcaaaaactgtcaatgcaattagacataatatagagattactacaaaaccagagggtttggtatgaaatgaaacctttgctagctacgaagtggggtgggttagatttagagtaatttattttccttttgctgctctgttttaattttctactccattttttagatggcctccaatttactgacttgatatagtagcaccaacccaacataacataaggcagttattagattcaatagctttgtatcaaaactatctaaaatatatttccatgaggattcatgtttatgttgcatccagacggtggtctcttttgatgctaattaacaagcacacttctactaagtatattaaaatattgttgaagctttcatctcagcagtggccaaaaacaataatcgttaagttgagcaatccccaactaagctcgacatgccagggcagtgtacatttgagaaaactcgtcgccgagccaatgctagggcttacatatcctgggcatcgtcgtagcgacgtagcgtgcttgcggtgtgtgctcgtcatagctaacgaccggatcacttgaaggctgcatcgtgttgcagcggagggcctctggtgcacgatgcttgagcaagacggtgatccaccggcttcgtataggaaaaacagtggcaatcgaactcgctgcactgccgctgaaattgctagttcgatcgtagttaagcatagaatcacccagcaaagggatccgaggcggctgaatagtttccagtgcctcccatacctagttagcagagcgagctaggaggagactacatcgatttttacctcctaaaaggagtactgcaccagtaggagactaacagctctcaaagtggcacgccatgaaaattcgatcgagtgtctttatttatagatagcattacgtctcgagtgaataactattactagctagtatgtacctcagccctgagtggtcatcattacgattcgatatggtggagaaaaacgtcccatcgtttcacttattcgggcatatttaccaacgaaaaataatttgtaaataaaacttttatatgcgtgttcttagggtcttaaagcgaaggctggaaaataaacttcgatgaaaaaactccaaaatcaactctaaatttaaggttaaaaatttaaattttggctgataaacaaaagcataagcgaaaagatgaggttgtttaccgtaagttttgatacaaccactgctttgattctctgttattactactacatgctcacttgcagtttacaggaatagaaaaggcgaggctctctgtttatgttggcccagggttggtgtctgtcaacagttggcccagactctattatctctgttaacattttcattttctgatgagtttaactgcaagcacttaatgatgatctaacagatatcaacatgtgtcagcacttccctagtgatagtgacaccaatagatgtgtagttaatctggataatttatttaactttgcatacatatgagttcattagatactaactttgcatcgtgaacggccatcacagatgtgctcactggtgacagaccgaaaaaaatccacgttgaagattggtcctcaccgccgtacccgttacctgtggcaggctaaatatgcggcccaacacgggtcatctgtgatgggccacaagcacaccggatgatatgaaagaggatagtgcccaacaaagaggactatagtcatttttacggggtcctgttaacagactatcaatgatataagtgactatatatataccccgatacttggtgaaatagttatcacaacccagcgtactgttcctacttcgggtgctacttcgggtgggagggctagtggggcaaatatttgctcctcaatgaccactcatcaattaccaggccctctgtcaacacagttgagggttatcgcctggcacaaatgaccggttccccactagtgggaatttttcagttgatctattgtgtctgagtttttctcactctcttctatgcccatatattttgattttaatatcatttatacctgttttgtcagtagactgtttaataattattaaaaaagtcaattatgtatttgacatggaagtggacgttaatgttggatgtatagggatttgtgtatgatattaagtagccaactacaacaacccttgaaatgtaggtatggataacaggactcacaattcaatgttgagagcacaactattttctaggatacagtcattgaggcaatagatattccatttttgctttgatcctgaattgtggcttatggtgttgagaagtgaacggaattcagacatgtcatcaatgtttggaacttggaagttctagcaccaatatagaagacagttagtgaaaacatgctaggataggatgggtcaatgaattattctctcgtacggttgcctgattggtcattctgagttttgtagctaaaaggtttttgaacattgtaaaaggatcaagtactaactaaccaaagcaaaagccaaactgaagtcatgtttcttgtagtatgtaaagaagcaaaactagttcgtcctttgttcacatttcccttggtcttgcctaaagtcgttatgcatggaagttgatgcatatagctgagacagaaatgtacaggaagtatatatactgagtttacgaaactttgtcagccctcgattttattctgcttcattggtcttattcaagaattagtgaattcattgtatcagacacaatctctgaaactttgttccttccttaacttatgatccatttgttgtgactaatttttcttttcaaccaagagctttctacttgattcgcacttatgtttctgtgctagagtctgacggaaagctatcctctcttgtgaaagaattcgacaccgctatcacgtgaagaccacatcagaagtttctcccaaagacctcgacccagtgcagttatctggtgagatatggtggcagtacatttcatgttgcatcccatttctattgcatgtaactttttcccaagaaatatttagagagttcagacgcatacagtggttgttgctagtcagttataccaaagtgtagaacactaatgttggttgttgtgatgaaagttacacgtatggttctacgtagatcaagagtgcaaggatgggataccctataataaattggtagtaggtgagtctatattgcgttcaagaaaaagaacagagaagcacagcaattagaatacattagtaataattttactattagtacattcccagaatggaaacagaacattattaggcacttttgaccagcaggagaattggaggctttcaatcttaatagaaaaagttcctcacaaagaattttcaaaaaatttgagaagttcctataggatttctattaattttcaaaaaaaataacaattgttatctctgacggcatctttagatagccgccttttcacaagcagttagttaggttgtccgtatatgtaagtatatctaactatccacgggacaagtgggcccacacctttacccaggcatattttcaaagacatccacatgtgtaaaccgttctcgcaagcagattctaaagactactgcatgtgtaaacatattcacatattaaaaagttggatccgagtagttgaaatctttaagtttaggagtggttgagtatttccgaaatagctagcaccaacgcaattttttggcttattcacctccttcccccactagatttgtctcgccgactttgccccacttcctccaccttcactaaggctcaccacaaacaccacaagattttccactttctggtcacatatcatctaagtgtgccatccctgcaccacggctatcaacggctattaccgaagctgcatgcttgcgtgtatgataaaagttgcttgctttctgacttctttgtgcttgctactacagcatgtgaatggggtggcagtagatctactcattcacttgctcctttgcttgtttatgttgattgcatgagagatatggggaaatcacggaggaaatcagcctatggaaaatgtgtgcaaccaaaactctagcgagattaatggtgcatcagtcaaacagcttggtgaggcacagtgcgttgtatttttcttgttgttttgtgtcaacatctaggcactttttaaacatactccctctctccgttccaggttataagacgttttttactttggttaaagtcaaattgttttaagtttgactaagtttacagacaaatatagtaatatttaaaattagtttcatcaaatcaataattaattatatttttataataaatttttcatgggttgaaaatgttactacttttttctataaacttggtcaaacttaaaatattttgactttgaccaaaatcaaaacggcttataacctgaaacggagggagtatatgctatgtaaactcaatgcatctatgcacgtgtaatggcatgagccagatggttagtgcattaagtcatcaaattaacatataatggcgaatgagtgacattcaatgttggtttggtatgaaaagttactttaaaaaagtatttcaggaaaattatatatagaaaatgtttgcgcgaaatgcactgtttgaattagattgttgtgaagattattgtcacatgctatttacttgattatagggatggcttaaatatgttataaaataaattgaataaataacttaaaataagttgtctaacaatgcaattgaaaaatgttttctttcaaaggcatattttgcgaagcatggagcaattaatccattacaacaattcgatgaatatggtgaaaagaacaaggaagtatggtcgatgcttgactacagggtgctctgatcttttgcttacctacgtatttgttacaatgctctaagcctttgcctcctcttgaccgttagtccacaagtgaaattgaggaagagattgaccgctaaaagcaaatttgtaaaaacttatccagtaacaggggacagagattaagatattgaagcctaaagtactctgctgccattcctcgatcctttgccagaggtatcatctcgcctgtcataccatgtggcaattggaagttgggacataacccatatgcgacctgatatgcttgaatttgtgaccttgttgatcgaggagcagaaaggaaggctttttagttggccgaaggagcaaaacttggctgcctagctctcatcgaactagaagggccaggttgtatttgtgcctctcccggcactcccttgatttttctatcatggtacatgcaacaggtagattgtaatggagctcctgatgcctcttagacctaatatgcatgtaagttttttgaggagcaaattgttgtcatctgcttggcatgttattccttgccttctgctatgtctgagctgctctcgttcttgttcctgtgttttcttctctctttctttctcttatggtcatttatatggactcttcgagacttgtagtgttgtgaatggcagtacaaaatgtgggaccgtagagctatttaaaagaaaatgagccacaattgatgaacatttggtttattttaaaaacagtaaatgcaaatggacagaacatggagattactatgaaagcaggcgatttggtatgaaatgaaatctttactgtgatgtggggtttgtcaaatttaattgccttttacctctctgtttaattttctgatctattccatttttgagatggcctcaaatttactcacttgatatagtagcaccgcatagaaagcagttattaggttcaatggctttgtatcaaaaactatgtaaaacatatttccacgacggtctatgtttattgtcatattaactgtagtctctttcctgccagcaaacacagttctactaattacactgaaaaatttattgaagccttaaacttagcagtggcaagaaaaactccttaagctcagcaatccaactaagctcgagacggcagctgcatccactctagggatgaaaacaaaatggattcggatagataatgttcataccagtatagaaagtagatatccaatcgggctatgatcatgtgagagagaccgccaagccaggccacgaagggcagccggtaccaaggggaaccaccggctacatctacgatttctatatgagtcaccattagcttagattatgtgcaaccatgttatcagtttttccttagaagttgacccataatatcaactgcagtattagatcttaattagcagaagaaacgataggattggtggccttgatggcccatcctttttctctttcaatgtcaccatatatgtcattaataccattagttgttcttttaaatcttttttatatccttagacattctccttattatttttttaatgttctgttatatattgctcgctatattttcatgcagtttctttcatcaaagagcaaatcacgctttcttagtatgggttgaattaatcatataatacaaagacttattttcatgctatcagttgtactggttactaggtccaattatagatatgttctttttagttctttaaaaatgcatcttaaccgctgacaaacactggtaagagagattgtagcttgaaacgatatttttaggtatttctccaatgcccaccttaacacgtggggtatcatcttgtataggaaatacacaatggcaatcagacctgctgtgctgcctctgagattacctgctcgatgctcgttaagcatagcatgacccagcagatagattcgtggcttccgatgcctcccatacatacttacatagcacatagcagtagaagactaacatcgatttctgcattaacaaaaaggaccgcatgtagctcactacttaaaaaaagcatttttttccgacgtggggtctttttttcgcaggcggacatgacccttggagccaaatgaccgcctacaaaaatataaatcgggtgaagttcgttatccacctacgaaaatctattttcgcagacggaccacttaagcggcgtctaaaaaatgtttttttgcaggcggaccacttaaacggcgcctgcttggcgaaccttatgtggtccgcctgcaaaaatcctacctacccaaataaaatcagtcatccttatcttctcctccttcatccttatcctctcctctccaccaccatcccctcctctctctctcttcccttcccatcatatcctctgctccctcccctccccttccttccttcctccgtgagagagagagagcttcggcggcggcgcgggcaaagggggccgccggcggcgcgaacggagggcggcggcagaggcacgagtggagggggccggcggtggcgtgggcgaagggattcggcggcggcggcgcggggcggagggcgtcggcgatgatgactaccgcacaacgacgatgactaccgagcgacgatgactactaccgccggccacgtcgctgcccctccccgcgacccctcctctcatagatccggcggaggggatgggtgtcggcagcggcgcaaggcgtatgggtcggcggcggcgcgaacggaaggcgtcggccggcggccctaccgcaagacgacgacggcccaccgcgcgacgacgacgactagcaccggccgcgtcgccggccctcccctcccagatccggtcggaggggggagggaggcggcggcggccaccccatgcaacggaggagttcgccggcgacgacgactcagagacgacaacgtggtttttttagtttacatgtacattgatgttaacttgatgtgaatttgaatccaatgcttttgtgatgtgaatgtctgtgattggattttgtttcttggatgagatttgtgaatattagtgatttgtgatttgtgatttgaaaccctagggaggggtggggctggcgggaaatatttttggtgccgagggtatttttgtaggtggggctagtgtagcatttgaggtgcctgggaagatgcctgggaagattcgaacggctgccttcgaaatcattttcgcaggtggtgctttggtccgcctgcaaaaattgaagatttttagcgtcgtttggatacaggcggaaagttttgccgcctgcgaaaatgtgttttgaccacctgcgaaaaccttttttctagtagtggctgctgcagcttcactagttcactatgtgcactatcagcgctgctctcaatgtgtcaagccatacgcatattggagtatcgtctttatttatgctatctatgcacttcgttttatatcgtctcaagagtataactattgctagtatatggttgacactaccatccaatatggtggagatagaaaaaaattgtggttgcagactgtaagttttgaaatttcagcctgaaattgttcttttatggtctagcaagctctacatatatacgtcacagggtgtctttgtgctatgtttatgcaaacaaaaaatcttaaaagaacgtgaaaattcaggtaggagaggaagaaaagaaagtctcaaaagtattgagatcctctgctgtattgcaaagaacatgcgttcgtcccaaaaacttgtaaaatcattaaaaactcttctcttattcaacgctttcagcaaagttcactctcctcaattctgcagtatgtgatatgaggagcttcatagactgctttgtatgaacgttttctgccaattttataattctgataacatcgggcagcctttatacatagatacatatagcacccaataaacagtgagtaaattcacaaaattacatatactatgataaatctatcacaaaactatagatttaaccacgtgtatcataaaactatagctttcttcacaatactagaaatttaaggtatcaaaaaaactacaaattaaacatcagttttattataaaactactttgtaagctcactagtgctatggatatgaactttaaagtctgtagttatttgataatttcatcactacatctgtagttgtgtgatacgatgctttgtaaaatataataattttggtgttaaatctgtgattttatgaaacacatctttaaatatgtagtttggtgatagtttggtcaaagtatatgtagttttgtaaaaagaaaaaatactcgtaaacagtagtggagatatcatcttatagtttcatgcattgttggttcgagacaaatagccttactggcataaatggggccattgttggtgcacctcctggttgcactcatgatgctatcggggaagactatgcaaccatggacttgactctcctcaaatgaccactctcgatgttagggcttccacaatgtacttcaaaattagtccatagtcaataaaataagtaaaaaagtactaattacccccctaactatcgcggtcgtccgaattactccctaaacccaaaaaccagacatcattcacccttaacttttaataccggacaaattacccccctcgacccaatttagagctgttttgcctacgtggcgtatatgtggcaatccagtcagcattttcttattaaaaaaatggtggggtccacctatcatctaccctcttcctcttctcttctctctctctcatccacaagttgacaagcgtggacgacggggatgagcggcagctggaggaggcgtggcacgcggaggcggcggcgctggcgatggccgagatggagaagacaagtgccgcccggccatggaggcggctgaggcggcgcagcatggcatggcgcatggcggtgcggggaaggcagcggagggcggtgcggccgacggtgggcgcgggcgatcggcgcggaacggcacggacaggcaggaggcggcggagaggcggggacaaatggggatgggcggtagactcgtcgccggagtagacgagtggctgacgagtccgtcggcggcggactcgtcagcaccttcagcaggatgttgcggtcgagcaggatgttggccggcttgaggtcgcggcgcacgagcgactccggcttggtctgatggaggaacagcagcgccgtggttatctccgccgagatcctgaaccgctggctcctcgggatcgacgggcgacggcgtgccggaatcttttttctttttatttttgtctctgcccgcttctgaattttctgatctgatttggcgccgcgttttggactttgggaatgtggttatgtgctgcatatgtagtatattggtttctctttggaatgttgggtaaagaattttgtcgagagctaacttgcacacttgtatatatgcatggccttaatttgcagtcgatggcttgcatcatcagtgattttgcagccgtccaccgaggcgcggcggtaccagcagccgccgccggcgtagctagacacgtacgtggtgcagatgcccaaggtcaaggtgttccgcgtcccgccgccggagaacgcgcacctcttccagcactacacccgccgcgcgcgccaggcgccacgcccgctgctcctgcgtccgcgtctgctcctggctcctcctcatgctcgtcttgctcatcgtcgcgctcacggccttcgcccccgtcgtctacctcgtgtttaagcccaggcagtcggactacacgctccagagcgcgaaccttctcgtcggcctctcggcgttgcgccgccgctgcgcctccaggtcggccagctgttgcgccgcctctccgccgctgcccgcctatccgcgccgttccgcgccgaccgccctcgcccaccgtcggccgcaccgccgtgcgcgccgaccgcgccgtccactgccttccccgcaccgccgtgcgccatgccatgctgcgccgcctcggccgcctccatgaccgggcggcacttgtcttctccatctcggccatcgccagcgcgcctgctccgcgtgctgcgcctcctccagccgccgcccatccccgtcgtccccgcttgtcagcttgtggatgagagagagaggagaagaggaagagggaagatgacaggtggaccccaccatttttttaataagaaaatgctgactggattgccacgcgtacgccacgtaggacaaaaccgctctgaattgggtcgaggggggtaatttgtccggaattgaaagttgaggggggtaattcagacgccgcgatagtttggggggtaattcatactttttctataaaataatacattcagctacctaaccacattgtggaagtagttcataggagaaaaatagccaaagtcatccataagcatatgagctgcccatatagaataaaatatgtcatttgtctctatttcctctctcctcttcctactacttactgcctgtatacattgtgaatattgcaatagttaaagtgtcccatctatatgtactactttagctatatgcattgatgttgcctttagcacgtcaacacggataaattattctgatggttgtgtgcatcatcactcgtactcaaccgaacaggcttatatcggaaaggacgcggcggattgccactacttaaaaaaaagcacatagagatcggcactataggtaccgaaagtgctaaaaatcggcatctatattttttttctcacctctgtggattgaaaatacaaaaactgacacatttaaataattatatgtattggttctaaagaaaaactggcatctgagataatggtttttaaaaaatagaacctttaatatattataggtgaccattaattaaaaactgacaaccctaatatattataggtgttggaatttttttttaaaaaaaaggcactcctaaaatcgagtcgagccgaacaccggtggcctcccgtccttctcctcttctcatctctctcttctgtcattattctctcctcctttttcctccactgcaccctctcctctctctctctctcttggctctctctctttatctctctctcagtccccctccccccctctctctctctccatcggtccccaccgacccggcgtaagtagcctgacgcggcgccatccactccgccattcagagttctgaactctgaactccattttagtttttcgctcctaacactggctccgtccctagccacgccgctcgctactttcctccaccgccgatgtctctatccccacccaccccgtagcttcggtagcctcatcagggacagaagggcacgagaaagacggtgaggagaggaggcagatgaggccagcgacgctgccgccgccgctcaaagtatccagatccgagatgtcctcttcgattcctcctgctttctctcggccagcatcaccttgtggctatcagatctagcgacagtgagttcggaggtgcctaatccagcagcccaccctgtagccactgaagaagagggtgaagtccctcaggcggctagaggtagagcaaatattgttttcttatgaaatttttgggtttgttttcttaagcttcggttcttgtttttggcttatggtgttatccgatttggtcatattgaagctatgaaactttacgaggattttgttgtattaacggatacaacttggtttccttttctcctattctgagttggttttcttttctccgattctgagtatgcaaagaacaactgggattcaaggaggatggcatgacacgctcgatggagaaagacgtacacgacagatgaaaacatattagtggattcagggacaagacaacggcgtgatgcgctcaacgaacaaagacgtaccacaacagatgaaaacatcggcatgacgcgctcaatagacaaaggcgtaccgcaacaggcgaaagcgtattagtaccattggaaagttacaaatgtttttagtagttaagataagaaattgaggttcggttggcagacgaacctcagatttatgctccaacggacacttatttgtcacctattgaggcttatttcaactccttccctcattttcactcaagttagtaacagaaaagatatccgttgtttgagtaatttccgcgctcaactactccctttctctgcaacaagttataagcttatcattcttacatggcaacaagccaacagcaaaatcgctgaggatgaataccaatgtcatacaaaaaattgtgttggaattgacagcaagtgagaccaatcgaatggagaatatatccacatctacaaaattgttactctaaagtgaaagcccttctgggttgtgtgcttcaatgtcaacatgtttaatcccaggcacaatcttttggatctctgactccagccgatccacttcatacccaagagcttcgactacatcctcacctgtacaagcagtgtttttcagatagagataacaagcataaatcccttattagagcaacatatatatattgcataccgtagttagacatgacccttattaactccgtatcatccttggacaatgaagcctcccggaactgtaaaacggaaaaagcaagaagctcagggatgtagaaataatgcaaaaccaaaactgggtgatcataatgtcctatgtccaaaacagcacactctcctgacaaggtagagtattctgtctcgcctgtcctctcctcctcaaaattgatttaggacatgaggcttcgaatgatcattcgtttcctctacatgtgtgtgcagaacacaagaaaatctcacgacaaaatgaggacttttcattcattatacatctttaaattatttaaatactagtttaagagttttaaacactgaattacataattcaagtgattttgacactgcaaagaaaaggcgagggaaaacaagtcaggtgttaagacttgaactcacaactaccatagacataaggtctaccattagggcacttgagtacctaaaatctcattaaaatcttgtgctacaagtacaaaaatcacttatattgctagcatgaatattgaaatcttgaaagtaattattaaaatcatcaaaaacaagtaccagagataattaaaaccatgagaaatagcttttaagtgtacttggggattcgggttgtataatgttcactaaactcatgtgtggcaaagtaagcaagtaaaaggcatcgggggcaatttgaaaaagcagtgacttatggagggttttatatttttcttccaatttcctattaaggctaaacagcagtagaaaaatatcagtaacaaatatctagtatagttgtaacttgtaggtgctagaataatatttgtgttgagcacgcaagttaaacccaaacactaacttatagctgaaaatttagctagcatttgaatatatcagctacaaggcattacgtacaatttaaacaaatatagctgatgaatgagcagttgtttcactaaattagcaactgagatataccccgtacaaaaaacagcggccagcaaccactaacactaatcaaactaattttcagaggagaagagcacctgttttgcccattctccacgtccagtcctttccaaataattctgcaccaggactactccattgaaatctatgagaagattaggccagaaaattgtcaagaaaagagccgtaagggagtatgcgaggtaaacaaaataagaaagtaacaggactgatgttatagatgagttcaacaaatcaataagcaatgttaatgggaatagtcacttgcagacacattacaccagctcacatgaggaaaaatccctgtgggcacttgctatcatgggaatttcagatagttctagactcaagtaacacaacactacaacagtacattaatttatcatctgaattggagccaagtcatgagttagattaacgaagaagtataccatattagtagtaagaaatacagtaaatggttaatagaaggtacaacaggtctctgcacatgaataaaaccatcttgatcatttacagatcaccagttcatctcacagaaacaagattgactgtaataagtgctctagtatgactcttttaaacaaaaggtaggcttaagaacaatggatataatcataaatgaagacgtctcaaactaaaaatgacatgcatcacaagtactaactgaaaatgacgacaaaaataaaataactgccttaaatttggagaaagccagattataagagctgtaccaatttcagctttgaatctaaagaatcctggtccaatcacctcacttttgcaatcataaagagcatctacaacctgcatgatgcaagaaaatcagctccataacatagatccagtgtgcgatatggaataaggatatccacaaattttcaccggatcagccttcagaaactcaagaacacgctgcatgtcatgatcatcaatagcccttccaattaaagcatgcctgtttctctggattagaaaaatagcaacctacagagagcacaatagtttaatttggaacaaggcatggacagggatgagaaaattggagaagcaaatcatcagcaaactcatatgagtacaccttttgcactgtgcacaattttggtgattctttggcaatagacttttaaagttcttgttcaatttgggtggcatttcatgaaaacaagattggctaaagctggttttcagtcattagtgtttatgttttgacttttctgaaaatcaggaaaaggtggtcttacagaaaagaatgcaattatatgcttttagagatctccatgttgccccaaaccaatggagacaagatttaaggtggttcaagctagaaacatgtttaaccaaatctagtattatcagaactgtctatccaaaatctcctttaagactacagctctgtatggtaaaccataaattgttccaggcaaacaacagccacatgcatatctgacctgcttactttttagagagaacttccttgggaattggacacgtcatttttaagtttaggaggagttgggtactactgcagattataagcagtaagtgttacctaacagtatcgactgtatacgtgatacctgagtacccgacaacccatttatggttccaattatgtaacaatatacaaatgaattaggcttttttagattttagaaacacacaaaaacatggatagcatccacaattttagtatgagcagaatacagaatatctgaataaaatatacttcagaatagatgtagtcaacatacaagaaatacacatcaataaacaaatctttactggtagctatgaatcttttggtcttggggtttcacaaactgctgatatctgaacatagtgctcatctgttatgatagccaaaatactgttttatcttgcatagaaataaaaaatgaacaaagcaccatttggcccttcctagcatagttgatgggcattcgatgaagtgtagacagcaacaatagaaatgcaagaaataagaagtttaacaagataagtgggataaaagatttagattgtcatagtttatttaattataaagaaacgaggacatgatatttgtgtcagactaaggggtatacatgtatccaataccaaatgaccattcaataaggcagaaaacaattgaacaaatattccgttacatcaattagtcacacatagcaacagaatataagccaagaaagataatagaataatatgaaccgactatgttaacataccattcccagtaagttgccaacaatgatggagccaattggatcatacatagcattgcctgtggtttgaacagccaccaaagatgctccagcaattgcaagacctgtaacagcagcaccatcctgtaggacattatcagggcatgagaaggaaatcaagtagaggaatagcaggtgagtggtaaatgaacaaaacatttattgatatggcatcaccatatgatacttatgagcaactgaagcagtcatcaactgttttagaaacaaaatttcatttcgacatgaaaaaaaaaagtattgaggtagtctagaacacatcactcacttcagtcatgacagcaactgaagttggatcatgaccacgccagatgtagtccctgatactcattccttctgctgctgcacccttcctaacagcctttatagcaaccagcagtgaagcacctaagaggcaatagggtgactcaattataacaaagtaaagacatggttagaatgtcatgtagcaagcatgtaataccttcaattaggaaggacccaccaatcactaatgcagcatagtggatgttctcagggggctgtcaaataaatgtgtcacgatataacaactgtagttaggtaacaaagattttctaataagatggagtgcatgtgtaaaatcttttggtgaatcaaatgatacatttgcatcatacttgcgaattccataagttttgaactccatgcacaatggtagcacctgaacccaaacaaaatattccaactgcagatatcaaggaccatacaaatctttcttttgaataaccatagctgcagaaagagaaattaagacatggggcaggcagcatgtcagtttatggcatatcacaaatagccttaccactgattctattgtgagtagcatttagtggtatactggcatgacaatgaataacaggattccctgtttatcttcaattcaagacaattttactctggtgaaaataactgattttccatgcagaaatgggactaaatttatggtacagagaaaataacagtaatgaaagaaagtgatatttatatgtcaacaaagcagcatttccaaattgacaatcgatacatacgggtgtagagcatctggagcacgtcttgagctgctcaagccatatgcaagaagagcctgatgtttaatcaacaattaagccctggacatgaaccttcaacaaagcttacaaaaaaagatagcaaaagtagaagcatcaactacctggttagcgaagtctgcaactgagtgcactagctcagctagcataacatgactagatgttgaaagccatacaccaaacttcaacgaaaagacaagaaaattacaccacagtgctgtgttaaccgctcgatggctgagatcacattccattagcatcaacatgaaacaaaatgtaataggtaagcttgtgaacaatccaaatatgtaatgattaactaatcgtaatattggacataaatctggcaacatatgcaatgaagaactaaaatcgaatactcttcttgccgttgttttattttaccacatggacaaaaacataaagggttatgtgcaacatgtttttatcagtaagcatcaggaaacatatttcacttgaaccgtacagaataggtaaagtactccacaatcctttcctctcaagcttacaatagtgctacatccaatccccctcccattgctatcaatgtcattgtgtaggacgatcacgaataacatttatgtccaatcacattatagagccaaaagcatttctgacgcatatattccttgaacactcaccccttcaacttcaatcagatagaaggtatcaagtaaccagagcacacctttttattgcaatgcttccaatatattaaaagtaaactaacaagatcatacctttaacccgaaaatcaatacgactgcaggactgaaagaaggtaacacgctaagttgcttgcacattgcaaatagaagacgtactacacacgaagcttagcacgccatacaaaggttctaacttgagcgggggaaaaaatggggcatatccgtctcacctgtgctcatcgtcaaagtgcgccttcttcttcgccttggcgacacgaagagaataacctgcgccacaacaacaagaagaatacgcaaagagagaacctaagaagcccgcaacaacgaggtgagagaggaaagagggaaggtgagcgaggcacccagtcttactgcgggagagggtgagccgtacgggaggcgcgtcggcgacggggccgcgcggcggcgacggggccggggggagggcccgcgcccgcgcccgccaccggcttagccctaggacccccgaggcgaggagcgggcggggcgagaagggaggagggggcgacgggtggtcgtggtcgtggtggtcgccgctgcggcgggagaggaggaggaggtggtggaaagggtatggcaaggaggggaggcgggggagggaggaagaggatgaggaggaggagctagaccaagagaggaggcggaggcggagggccgcggcggcggcgaatgggcggcgcatttaggggtaggggtgacggcggcggcggcgaggctgctgctgcggcggccgcgggcggggcgcggcttccatgcgagggaagcgatagaaaaaggaagcggggggagtttgggcttggttggggcgtggagagtggagacggcgatggagtggacggtgggagagagcgatggacccgacggtggggtggagctcgtggacgctagggttgggccaatctctgtcacgacttctcttcccggacaacagctgccatttcttgccgagggcctatttggagagcctccttctctcggaatcaaaactctagattttttttagaagttaatacttatagaatccaggaaatgaaattaagatttttttattctcagaagcttaagctcctccaaaccggccataaaacttataactagtgttttactacgtatttatttaccctgtgataaaatctgatttatcctgaaacgtgatattcctaaaagttttatcttgcgtgataaatacgtgactcttaaataaacacatgtactaattgcatgtttgttcggatactaactttaccataatccccctgaaaaaaaaaacataatccaacttaccaaagataaaagatgggacaaacccacacaaattgtgaccaacgacaaatgtagcaatgtttggctaagaaatgagcctatgacatgtgggccagtaagttagtaaagtatggtttgtcacagatatagcagttagtaaagtatggcttgtcaaagatataacaaccaaccaaatacttactttaactaaagtgtgtggtacgtctaatgtgtgacgtgacaaactatggcaacaaaaccaaataggtcctaagcagggttggccctgcacttaggcgagttgtgagaccgtctagggcccagagcggagggggggcatcaccaaccccatcccacccccatcctagcctaattgatacgggtaaggcttcctctttcacgtcgcttcctttttatccccgatttgctccttgaccgtgacttcgctttgcacccatttgcaccatctctccatctctatgcgataagcaggcaacatcagtgagagtcggcagcagcgaccatcaggaaacccacaacttgccccttgcatcatggtgactgcactaggtattctcattggcatctatagtccaaaatttaggttagttttattttgttcttgatgattaatctactatgtaattttaggtgttagaatatttcataaggagcatctttcagtactcacaaaagggaaaaaaattgcatcaagaaatgagacattggatatctgttatccccaattcaaggtatttgtactatttggtttatttttcatgttatactatcaatattaattatagagaacggaatattgtattgcaattatttggtttatcatgtagtaatattgattttgtcactttgtagaggatgtatggcttataaaatatatttacaagtacaagaatatttagccctaaaggccttaacgttgggttcaccgttcgcctaggaccctccaaactatagagtcgccctggtcctaaggtccacatatcatcctctcatgttttatagatcacatccaagcaatgattatcgcgtaaaacccttcgacacccacgtacaagattccaatcacatagtggattaccaagtcattgatgatttgtatgttacatgtgttgatttctatggagtaatattaagaaatttacaaaacccaatgtttttatgctgctaatgtcctagtccctacatataagtatttgtgaatttttctctgattaacataacaagaggaggtagcgctgaaagttaataaaaatatgtgtgttgcaaaaaaaaatatacctaacaaaatggtaacagatgaggacagtggagaagcaaatgttgctatgaagaaagcaaataaaggttgcaacaaaagtaaaaacaacaaagtatagtacttactttacctttatcaaagctacttttttttttgaaaggaatcagcacgagactgtgctatttcattagatataggcgtaaaaaaatacaacccctaggggcaaaaaaaagagctgtacaaattacataagcactatgattaagctggtaagaattcttcaagtcgccttgcgcctgctattatccaggttcttgcctcttcctttatttttgccataaggttgggggccgccgtttccttgtgctcgaagattctttggttcctttctttccagatttcccaggctatgagtaggattaaggatcgcagccctttcttgggcacttcccttttgttggctaacatttcccaccattcgtgtatgctttagcatggctcccaattgctcggatccaattgttgataagccacccagttggccgtcagtctccagatccttctggtgtatctacaggaagctaaaaggtggcatgccgtctcgttcgtcatacggcatagggggcacactccgctatttggccatcctcttgtagctatgtcacatcctgattttcgttttaggatttataaattatttaataaattattaatagaatttatattaaatgttctttaatttacaagtgaagttaaatgtgggaaataaaatttcctaaatataaagcatggatggatttaatttttattaaattctccatgattaagtcaattctctgaaattttctcggatttttcggagctcaattcctaaatgctacaaagaacagttcagtaattacttgatcaataatgatctaattataattgttaagtgcttttcttgtttaaaatccttaaattataaattgttgtttaaaaggaattattagaaatgatcttaaaagcctaaaagagaagatctaatttttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagccggcccaaaacctctctctttctctctccctcggcccagtccggcccagtccgccgagccgccgctctcttctctctctctgtcgctgacaggtgggccccacctgtcggagccgtcttcctccttcggccgccgccgcccgaaaccctagccgagccgcgccgccgccgctttccaatttggccgcgcctttccttctccggtgaaatcgattgaagggaaataatctcctcgatctcctcttccttttctcttatagaaactccggtcaatttcctttggaaataggcggattcgagtttaattcggattcgtttttccccaacctttccatcccgccgccggtcgccgtgggcctccgccgccgcctccttgcccctttaaaagcacccccggtgtctccgctacccgccgcctctctcgccttcgcccgccgtcgtgtgtagcgccctagcctcgtgagcttttgcgccgccgtcgccgccgttcgttcagccgtgcgccgccgtcgctacggtcgtcgtcgtcactcgggaaggccaccgtcgggatcgccaagtcgtcgccgtccccgtccaccgcttcgccgccgctagagaccgccggagcaccgtcgccgccgttgacccgatcttctccgctgcttcgacctcatcgccgacgccgtccgttgctcctccgccgttgctttggtcaccggtgagttcgccgtgccgtccgctacccgtgggtgctctccgttcgtgccgtcgtgccgtcgttcgccggcgagcatgtgcgcttgagccgccgagttgccgccggtgctgacgtcattgctgacgtcatcgctgacgtcatcgttgccgttccccgtggcccggtcgtggaccgtttgatctcggccgtccgttttggatcaagtcgatctcggccgtccgttcccgtaaaccgttgccgtgcactcggtccaccgcaaaccctagccgctgacgcaataatccttcttttccttttcaaaaataattcattattgcgtcataattcaataaaaatccatataagtgttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcagttgaagtcagaatgaggccgttcaagtctcataattcatctaaaattataatctacatgtttgtttactttttatgtattgtttatttggtttttattagtcttttccttgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttctactagatattagatataattgcttagccatgcttagaaacattagcacactattgggataacttatgactcactgttatttaatgatggcttaatggtagctcacgatggttaatcgtgttatgataattaattggtaattaaaatatgattaatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactaagaagtggcggagataagcccacgggggtcgctggggagtccatgcctctggtttttgagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgttgttcagtgttgattaaaatttctgattaactactccactattttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgtgggagtggagccggagcttcgctagattttatttttccgctgcagttttcttcatggtgaggactaagtgcctcttaagtaagtacttattattttagttaatttgatgaatctgcatattaaattgtcagtttgtgtacctcggctgattcctggacgaggattttatgcacaaataagtttggaaattacttgtgaatttccgggcatgacaagctagtcgatcggaagtccagactctattttgaatcacaagccatgcataaaatttgcattttgcaggggcccaagatttccaaattaggggattgaagttggtgccgactgttcctagacactgagccttgtatgccgaagaggccgagtattctccatgattcgagagcttccagacgatgtgatccgacttattttggtttagcatgatgtcctgggttgcgctccatagggacacaagctggctaatcagttccactgtaaaagtagtgttcccatttagctctaggtcatcgatccaggtgtcattttcaatgccttcacgtagcgatttgcttcttttcttggaaattgcatagacgagcggcatgctgtcctttggtctttgcccgtccagccaggcggactcccaaaagcggatcgtgtttccatcccctattgttattttggtagctgcggtgaagagaagtttgtccgtttcatcacacggtgtatctagtcccacccacggcttggtggggtctttccattcatgccagagccatctcagtcgcaaggccctcgtaaatatctccatgttcagaacccctagtcctcctagtgcggttgggaggcacgtccttttccagttcaccttgcatttccctcctgtaatgtcccccgtccctgcccagaggaattttcttctctttgcatctagaacgcccaaggcttccttagagatcttaagggcagtgagcaaatagataggctgcgcagtcagtaccgacttgactagagttgatcgccctgccggcccgatgttttttcccctccagccggtgacccggtttgctattttatcaaagatcggttggacgtccgtcttgcgcagccttccaagtagaagcggcaatcctaagtattttatggggaattgggcccgtaacgctgggacgccatcaaggatggagtctagatcaatgcttgcacatctgattgccgccacctgtgatttttgcatgtttgtgaccagtcctgtcgcacgtccaaaacgcatgaaaatgtcggtgaaagccttgacatcctctctaaggctgtgttcgcatgcaccttttcccatcccctctccttcgttttccgcgcgcacgcttttcaaactactaaacggtgtgttttttgcaaaaagtttctattcgaaagttgcttaaaaaaaatcaaattaatccatttttgaaaaaaaatttagctaatacttaattaatcacgtgttaatggaccgctccgttttccgtgcacaggagttaggttccccatctcccccatccgaactcagcctaacagggtttatgaaaaccactgcgtcattagcgtacatggagattctgaggcgagccgctctacctcttagcttggttatggcgtttagttccgttgctttggagaggatccattgtagggggtcaattgccaatatgaagagaagcggtgatagcgggtccccttgtctgagtcctctgccatgcactatcttttctcctggtatcccgttgagcagtacttgcgaggtggaggtagtgagtatggtcgtcacccagtctccatttctgcgggaacccatgatgttgcatcatggctaaaaggtaatcccaacgcaccgaatcgaaggctttggtgatgtcaagcttgaagagaagcattggccgccttgttctatggtatcttcttgccaaatttctaacatagaggaagttgtcgtggatgctcctgcctttgatgaaggcgctttgattgactgtgacgagggttcgcatgtgtaatcgtagtcgcaaagccaaggttttggagagggtctttgctatactgtggattaggctaatgggcctgtagtccgtcacctcatccgcgccttccttttttggaatcaggacgatgttagctgagttcagaaggttcatgttcgcacatctcagattattaagcgattcgaagaccgccataatgtcccccttgataatgtcccagcaaactttaaagaagttccctgtgtagccatctggccctggtgccttgtcagctggcatctccttgattgcccgatgaatctcctgttccgtgaaaggatcgtccagatgcgagaggtccgtcgttggggcatgcaaggcttgccagttaatatcgcatgttctcggttctggcctcctcatcatcctagaaaaatgttcgaagataacatcatctttgtcttggtggctcaccgcccagccacctccactgcgaagtctttggatgtaattctttcttcttcgagcattgactttgaggtggaaaaattttgtatttgcatctccctccttgatgtgcattacgcgggaagcttgcctcttccttgcgcgttcaagcgttgccaggccaagtaggcggcgtttaagtcctgctctcagccggtgctctagcgttgtgagctctctttgctcctatgcggagtctagccgctggatgacgtcaagcgccatgtggaattggattttcgcctcagtgcagattcccctggaccactctcgcagactttttccggtaatttgcagcttatgatttaaccgatgcatgggttctgtgtgagttgtctgcttgctccaagccaccgcaacaacgtccttgaatcctggtatccttgtccaaaaactctcgaacttgaagggacatggtttccgtggtcctgaagtattgtaaaggagtagcgaacagtggtcagaagggcctgacggtagagcatttaggatgtgctgggggaaagctaggtcccaagcctcattacaaaagcatcggtccagtttcaccatgatcggccgtcgcctctcattactccaagtgaactttctgttctgtaagtggatttcttttagctcacaatggtcaagggctaagcggaagcgggtcatacgcgcaaggttaatgttctcattgctcttgtctctagccctgtaaatcatgttgaaatctcccaggagcagccagctctctcccgagtttggcttgagtcttcttatatgccgaaggaaggcatcttttagccggtgccttgtaggcccatatactccggttagcatgaaggtagtgtttaattggatgactgtgacatctgctgagatagagaagcgaccgactcggacgttttgcacatttaatgtgtcactatcccaaagtagcaggattcctccctttgtccctctagctggtttgaagtcgaagcgatccagtttgtatcctcctaggaacctggcgagtgaatcatccatgttttggagttttgtttcctgaaaacatgccatgttgcatttcgtgtccagcatgagctcatgcactgtgttgcaccgcacagcggaattcaacccccgcacattccagttaactatttgcaagttttgtgacatttggaatgatggttgcttcactgattctgctcggcccaaacagccagagtttggtctagcttaaaagggcccaacttgctagaagtgatggccatgtggtttcccggcccaacccgcaaggcccatggggcacggtggcgcagtactcgtgtaagtgcgaaggtgggctttgtgttgggccggtggcattagaggaggagtaggaaggcttttttcctttttctagcggcccatgcactctgtcgtcgtagattttttggtgatgcactcggtcgtcgttttggcgatcgctgaggctgttgatgccctgagtgcactgcctcgttaccacgctcttttcgcgattctgcgtcgtagaaatcacagttgaaaacgaagaatgtaggaggttcaaatcaggcttatgcccgtgccgacatcggcgatacatgcaacacaaatgaaggaagtctcgatcggctggaatgggcgcgcgcaggctgccgagagtccagctacaaaagagtagtctggcatgacgatacatggagattgcaatctccagcttcccctttttggtagaagcatcaagcgatgatctccttaatctccgcggcagcttcatccaccccttctcccaccatctcgacaagggagtccgtggggttgtcgtcgtcttcaatgtcgatgccgaacaccgccgtgagcgccgcgatggtgtgctgcaggagcggtccctcgaacattgcgacatattgagcaagcacctcctccatcgaagcggcgccgtcaccgccaggcagccatcccattcgcttgaagaggacgcgctggcatcgttccatcgtcggcaatgccggctgcttagcgatgcgggcactccgacgtttggcgccagtgttgtactgcttgcggagcttgacacggcggccgactgccacctttcttattggcggcggcatggggatgaccgccattggtggtgttgcaaacaggctgtccagggcgagctgtgctggcgtcactgacgtcgttgttgtcgtcgtcgcaccgcttggcgtgttcgtcacggcggccttacccacgacattctgtttcggcgactacagggcgagaatgtctgccttgttcgcaacagggagggcaagctgtgtcggggtcactgacgtcattgctgttcttgttacgcctcttggcgtgttcgtcgcggcggcttcagccacgatattctggcccggcgactgcaggacgatggtgtctgccttgttcgcagcagggagatgcaccgccgtccaacacggtgattgcgggctcagcaacggctcctcagtcgccgccgccaccgccacttccattctggcaagtgcttcttcaatctcctgccgtgtggtctcctgtggggagacgtttgccggcaggtcacacttgatacgcgccaaaacccggctcaccgggattggttctagcagggaccaggcttcatccccttccctcgccggttcttgaatcttctccatcagagtggtggtctggttgaactcctcagccgccaggttgtccttcaagacaggggaatgcatggctaggagaaattgaaatttgcttaccatagcgtcattttccctctggtgcggcaatgtcagctcaggttctgtaggctcgccatcgccttccacacctcggttgcgccaccccctgtagcggttgctgttctccttatcgcgtggccgcggtgagcgcgtgcgctcacggcgatacttcgcttctccgtgcttccaagactcgcggccacgcgcgaggtcacggcgtccacggccgtcgttgtcgtcgtcgccatcgtggtcccgccggcgctggttgtcgaagaagctagggtggtcgtcgttgtactcgcggcgtcgccatggccgctcgttacgacgccccccacggcctcgcctgccatctcggacgcttcgttcaccgcgttcatcgcggtcgccgcggtcatcgcggccgccgcggtcatcattttcgtcgcgtccgttgcgctcctcgcggctgcgatcgcgaccgcccttgccgcggttatcgcggctcctcctgtcatctcgaccgacacggtcgtcatcatctcgctccttgttgcggcccaagcgttcatggaccgagcgtggcggctgcgggtgatgcgggaacgtctcgaaggcgcgagctggcaccggctcaccatcgagcacccccaggttccagggtggaagtcggcgccgcgtcggctggcaagtggtttcatccgtgaggataacacccgccgacgtgtagtcgtggatctcctcgaggtggaaggggacagggtggtggacgcctttctgccaatgcttaggcggcttctcttccacgaacagaatctctgcttgcttgtcttttgcacgtttggtaaacccgagccacattcgcttggggattgtgctcggattcacagtccatgcccagagattgatcgtgcgggtgttgccggactccaccgggtgcacaaggtcagtctcgatttgctccagggcgcaggtgcgtccaatgagccgctcggtgatgtccgccgcccacgcatgcataggcatgccatccagacatagacgcactctgaacatcagagcaacgccaagggcgttttggaggctacgccacttgatgaagtgcacctcgatgccgcggcgcttggcgaagcccttcttcaccacgtcttcacagtggcggcgatgctggaacttgatcaagaaggcttctgggtggtgcagggagacagccacctcaccttgatgaagcttgaactcctcccggattacctcctcaatttccagggcccctgtggaaggtggcgcacggattgcccatgaaacagctgcagtgttcccccactctctcagctcctcgtcaatggcatatgacgtggggatgaagcagaaatcttcctcagggcgcgtggccggatcaccgagctgtgccattgtcgtggatgttgacctggtaggcggtggcgggatgacaacgccgacggcctggcgagtatggatggaaggtgtcggcgaagcagtgcggcgacggtgagttggtggcagggtagcagcagattggcgtgtcggggtggcgctgatgcgtgggcgtggcgaggcgacgttgctgcgcgttcgtggcgaggcgacgcttttgcgtgggcgcggtgaggcagctcggcgacggtcctactcttggacagcctgtcgcgagcgcgcgcgcgacgagagtgagtcagcgcggcggcattctctcgctctgtgccccgaccgacggcaggtgaagcagtggattggatcttggcactgggcggctcggtggtctttggcgaggcagatgaagcacttcccgctcgtctctgcccagaaggcgcagtgggccgcagagagggggaggtgtgatggacgttcaccttgacgcgatgaatgcggtcgttggccgcggcttgaaatctggagtcgttgggcctcacttgaatgctgctcccttcgccaccaatgccgccttctaaccggtgtccaaagcgaatcctctgctttgctggctccctgttcccggccggcgatgtgacgccgcggtagagtagactcgtaggcattactccggcgtgggggattggagttggccgggtggtagctgctccggacggggataataaatgaatatttcaatttggggcactgtctctgctcgaggggcaaattcaaatctggctccagatccgggcactatctctgctggggaggcaggaacgagacgcacccaaagcttccatctcgcccacgaaccacctcggcgaaggagcgtggtgccccagctgactcagatctgggcagaggtgagggctccaagcagtaacccagccatggtgaggcttgcgcggcgccggcggggtggccagggagtcaagaggatggccaggtagctgcagagacgtctggggacctacggaggaggcggacgggcgtgggcgacgccgacgggagtgtcggcgccggcggatggggtgggagcggcgttggcatgagcggcttcttttactactactaattcttgattaggagtactgtcatagtgttacacactcaaagctacttgcaactctaaggaaaagcctggagcaaattaagatcatatatgtatgccatagaaaatattgttaagtagagagtacgagcacacaataaggggttatgtgggaagaaagtaatagttcgttaactcataggtagacgcaagcattgaaataactagactataatttaatataatttgggtcaagatagtttactttggtttgggcttcgagctaaaagcttgttggttgaaattaattttgaaaattcaagcgccattaatttggttttggtgattaatgacaaatccaattccatgagactaatattgttgtaagcatttctttgtctagtctcatatggatatgaaagtggagtgtgtgagaggtgattcccggacttcatatgagttgagatagaaatgttcattgatggtggaactaaatcacaaggatgaaatgcatggagatcaagctatatgtatcacactttctctccatgtacatattgatatgttcatatataatatttccacgtgattgacatatgcatatgagactaatgttttatttgagtcttatctcttatttagtctatttacattgagaacgtggagatgatgaaggtatggttttattttaatgtctatatttgagaaatgccttctattcttgtattggataagctctcaatgtggcatatcttgttatgcatactcttgcttcacacaaatattttgtatgcatacatttagggggagcaaatcctatactttagttatgcatgaaatcgatccaagttattcactttcatttaattgggatctttacatttgagcatatatttgagtatataacacttgtggtgttgattaatactcatcatttattcatatccttttatacatgcgattgattggtcaatgtgtgaaggttgacaaccgaatcattgggactaataatttcacttagttgaataagaaaaataggttccaaggattgaaaagatgttgacgctcaagtgatatgattacacctaaaataccaagaataacaaagcgaagatattgaagatgtgggatacgaagtggctactatggcaagacggtgaagggcaagcgatgctcggtcgcgatggaccatgcgacggtgaagggcaagcaaggggcttggctccgaagaaccaaatccggtggtaaagggcgagtgacggctttgtcatgatggactgtgcgagaccatttgaagctacaagtaactgcatcaatcatttgaagaatatacggtgaaatggttttggcgttggcgtcccttaagacaaaggaaggaaatggaaagaaggtattcctattggtataattctattcctatttatatttgagtatagaaatgccatactattaagagggatgcaacgtcgatgcgtttgtttatgtctcggtgctcaaagtaacctatcatagtactaccttgagagaaacccaagctttaacctatcctttgagtggttttagaccttgttattggttgagttgggtagtcctctaagtgagctttccatagagtccaagatcatcaaaagagactcccgagcaaaagttatggtcgttttactctgtgcttttcagaagttccgaaaatggatgcgaaactgagtttagcttctggaaattttaggaagttctgaaaattcctgtctttgcctccaacagctagtttttgagaggctcgggtatataaactcctctacccctcctttgagtggctgctgttcttggggagtattagacacatccaaagcccaatagccatccccatttccctacctttgtggtgtctctttgtgagggggatttgagaagagaagagagttggattgagagagtgaggagtttagagctagtgagcttcactccatcctttgtggtgcttctttgtgagagggatttgagaaggggagagagttggattgagagattgagaagttgagagcttgtgagcttcactccatactttgagcactcgagttcatagcaagcaaatcttcgattgtgtttgttactcttggggactaaggtctcctaaacggctaggcgtcgccggtgagtacccaagcttgtggtgtgccacggaaagtttatgaaggcttcgatttcgcctccgcaagggaagaaatcaagagtgaaaccgaggagtgcatttgtgcaacctcgtgaggaaatggttgaaatagacccggcccttgtggcccctcaacggagacgtaggatccgtggatccgaacttcgggaaacaaatcaacgtgtctcctctcttggtttgctcgttcttgccatctctcatattgtgcttgagcttgttttgacccgatctacttgcatgcttaattaatattgttggtgaccttatatcttgtttagattccttgtttgtcaccttttgattcatatacattttgctggtggctggttgatggagcaatgaagggactatgggaatggataggacttagggtttagtattttcatgggccttttaccactgggcattttcttaggccatttcagtcttgttggtctgctatgaaatggtatgattgggcctgtgagctaggcatatttggctcatgagtcagctcgagctggctcgttatctctaacaagctaaaacatcagctcggatcattacaaaagtgcaacgagccaagccgagtcaagccgagctaacgagccacgagctttttgttcacccctaaacatggggcatgggccctaaggcattctctctctctctctcttcatgtatatatgcaattttcactattaaagtatacctttaatccattcatatgttaatcacaatgaaaataaacattgatagcatcacgtgtatggcatacccatatacatgcacttactattactagaaaataccacatggataatagactaatagtattacttatgtttatatgtatatatggtgtatcacattgtgggtaatagtcctagttaggttccttaggtttatcccattgtaattacattatagagttattgggcaaattacattctcaaatactgtggttgggtagcactcgtagaaatatcaaataacaaagaacataaacaatggaattgatatcatgatatgtggatcaaactttggctattctatcaattactttcaagagataacaaacattacaatacctaattacaatgggaaatgataaacaagaacccatctacatatccacaatcttaatgcttgactaattagcagttcaatacataccagcggccatgtggcttcgtcaacagtgaatgtggggaacagtcggatgatgatacaattgcttataacagttaccactcaatagttcgttttcagtaataatgaacactttaacatctaataatttagcacatttgaggaaggaacccaactttttttttggaaacaaaggccaactgaaaggtcagctagatttgtacatatgcccctaaagaaaggacatattacaacttgagcacagcgtatgcagatgaggaatttaaaaagataagaaaaaagcaaccaggtccttattagtcttgcttcttcccctgcatcagtaccatgatcgatgatggcaacgatggggagctcgcaaaaaccatggcaagctgcataaggttccgccaaacaataaatttgaatgggccttctagagatgaaggttacaacttggaaccatgggagaacttcagctgtcgttttaagacccgtacgggaggcaaagaagaggaccaaatgcaaagcaggaagatcgctggagaaggggctgtcgaccagcgctacctggttgatgtttagattgaggacgaagccaccaacccaagcagatatgttgttccttcagctgccgacgtcttggagagacccgacaactcatagatagaaggatctcgtcggcaagttcctccatcaccggagtttcttgggacaagtaaggccagacactgacgacctccttgaactgcacaaaagaaacgggatgaacctgaaaaggggaaaacctaactacacctactactaagcagagaaggaaggtctgacccctcccctcccctcccctcactggtggggaaccaccggatttgaggagaaagaggggttgaagagaataagtgatttactgtgttttgcgagagatttccggatcattggattgtatccaactcattttcaatactaatagatattgaattatactccctccagtgtgaaatttgttgacgttttagctcttgaagaattatatgatatttcttgatgttttagcttttttttttcatcttggaccttcttgcccctgcatgcagccggccattacacccattatttccaacgtcatgcatgcatgctgcgcaggcgctgttgacttctcatttcctgttcaaccattactctcgcgcgagcggagtaatttccttcttctatggctgtttgttggctctttgccttctactctcctccttgcactactttcgccatggagcaggtcgtgcaggacacagccaccgtcgccgccgtggagcaggttgacgctggcgatgtggtggtgaagctcgcacaacaggtggacgtcgccgccgttgtgcagaagtgcaggacatcgacgctgcggctgtggtggtgaagctcgcacaacaggtggacatcgccgccgttgtgctgaagtgcaggacatcgacgccgccgctattgtccaagagtcgacgccgccgttgtggtcgacgctgccaacagtcacacgtccacaatgccatgcaaaaatatatggccactaagaatcaaactcaagactaatagcttcagttttgcatgcgatggccactcaaatcaagagcaagttgtggtttggtgtgcctcgaaaccgtatttattaggggtaaaataggaagtaggaacactaattaatcactcattgatatgtgtaatcctgtctagaacgttaacaaattaggaactcgagggagtagtcacttagtacttcctattcatcaattaactcccatgacacatgtctcgttatctcctaaacatgtcattacactggaaacatcttgtacacctcctttcccataaaacaaagatggaacacaacatttctatgccagctcacccgtgacatggccctctcctattattatagcaaccgaaaacccggtcatttgcatcatctcctcaacagcgtgttacaccacagcaaaaaccgccgagttaacaacggacagattcgctcgcagctcgaataggaaaacccgcaacgtcggcgtcgctttgcctgtgtgctcggcggcccatatttacgcacgcaagcacgcacactaggcgccagcgcgaccaaaaaaaaaaaaagaaaaaaaaagagcgacgcgacgcgacgcccaaacgagaagcaaccgggcgcacgcacggcgatacgagacgatacgccgccccaaacccaacccggaggaggaatagaaggggaaaaaaaaagaaaaaaaaaccccacgaaaaaaaggtgagagtccgaccgatcgccggcgacctccgccccgcgttcgcggatgcgatgcgccgcgcgccccaccaccaccaccaccactgcgccaccgtggtgggccgccgccgccgacgacgcgcagggctgccccgccaccgccgctgctgctgaggagatccgtcccgccccgccccgccaccggctcgcgccgacgaccgccgtctcgcgcctccgccgccgccgccgggtggcgcggcgggcgtgtccccgccgacatgtggctgttctggcgcagcaggaaccgcttctccctcgaagagctccggtgcgtgccccccccctacctacctgccctccctccccgtcccgttaggtcttcgtggggagccgccgcgcgcagatctgcgccgcgctgtaggctgtagccggaatcagcgcgcaatttcgtttcggttgcgtccaactaaaacctcgtctccgcccgattccaatccaatcgcttcttaattttgtgctaagtaggccttcatgtctgtgttatctcttgttgtcgacttctctatgaactgtacaactattaagcttggtttagaattgaggagtcatggaagtggtaaaccaaccagaaccgaggcatatgtaaatctacagtacaagagaggggattcttcttcctctcctgtcccctgatggcatgatgtaatgtcctcaactgcttaatactgtttgcatttgctgttgttgagtacaaagtttgtaatacggaggagataaattggagaacaactgtttttgagattggatatgcaggattagtcatgatcaaagtagttcaccttggaagtattatttacttctgtgggggtttgtctgtgcgatatatattaaaatcaagaatcacatgagctgtgatggttgagcagcataattacactaagaaggttgcacaagctacaacgtgcatttttataccataaccttgtggaaatatcactttgtggtttgtgcctgcttccttgcaattagaagcacacagcacaaaaggggcattttaactaatataaactttttattatagtttatttgctagtaaaaaaagaaaatgcctgcctgttaagaaccctcaatttgtaagttcattattattctaatgaatgataaagtaatccatagctgtttgggacacatatttccatcgtgaaccatctttccttaatttagtttgtagtaagtgttgaaataccccaggtatttttgtgtgtgtgtgtgtgtttaggggggggggggggggggaggcataaacaacgcaaagccacgaggcatgatttttcttgtgtttagttacaattgttatgctcaatttaattttgatatttgttcaaagttacatttctcattccttttctaatgtttgctaaatcaaaagttgttgcatactcatatgttaatgctctatgtaagtttcatccttggtttttattcctatacttgttgcatatcttatgctgagacaggtcctttgctgcaggtatctaacagatcagctacagaaggttcatattgtttatgaagctaataaggtatagttgatgttcctggttatcgccagaatttttgtgacaattttaagttgattggcctgacgatctttcttttgaaggattttgttgttgaagcattgagatcaattgcagaattgatgatctatggagatcagcatgatccgtcatacttcgagtaagtatttaatgggatggtatcttggaggtattatcagttgatctatttgtttaattggtatctctttcagatttttcatggagaaacagattatgggtgaatttgctcgtattttgagaatttctaagctctcaagagtgtctctacagttactacagacaatgagcatcatgatccagaatttgcggaatgaacattcaatttgtaagtcactacagacaatgaatattcactcaataatgcggtatctatcctgtgtctacactattttgtttttgaaggttctaatctgtaagcaattatattttctgcagactatattttcagcaatgagcacatcaacttcttgataacgtatccatttgattttcaaatcgatgagatgctatcatattacatttcctttctacggtttgtaaaccagtccgaacgtcactgacatcattcattttttttatatatattggcttacttgatttttgtttcatgaagggcaataagtgggaagttgaacaagaatacaatttctttgctcgtgaagacaaaaaatgtactcatccaatccctttttatgcactttcggtattgttttccttgcttcttttgtttggataaataaactaggattctattctgtatttactgatttgtgtgtgtatacaataggagtagctcacgacaaattcctagctgccaattacaaacagaccttcagattgaatccgacaatataattcgccattattgttatgtcattcttgacaccccatcgaggccagcaatattatacgcatgcatttccttccagtgccatagtttctcttagctccacttagttctgaagacagatctattggatctatttttctggtctatttacattatttgctacattattttttttggatcagttgagctgtacatgttatatgaaacacagtcttgtaacagattttctctatactatatgcaggatgaggtcatttcctttccgctgtatgttgaggccttaaagtttgcttttcatgaggacagcatgattagagttgctatacgtactttgacgcttaatgtgtaccatggtaggttggatagccttgatggccattgtatgtctgttatgcaagttcttaatttgcatttgtgctgtttcttaccagatcgttcttttctttcagttggagatgaatctgttaacagatttgtctcacgtgcaccactgtcagactatttttcagacatggtcaatcattttcagaaacaatgtattgacttggataagttggttgttcgttctgttcggtaagtgtgccactcatttcgccattcatggataaatccagaacatgtcactaaggtccatctgcatccagaatatgccactcatttgatgataacacgttggcctgtgtcctcgtgctgttaagacatcgatgtcataaaaacggcttccttctgcattgacagttatagtaaatgtgcaaaaataatttattttcttccgtctgtgttctattctacagaaatgcagattctgctgtgccaacagcctctgttgaggatgcaattgtgcaaattgaagatacactctattatttcagtgacgttatgtcttctgggattcctgatcttggaagattcatcactgaaaatatcttgcaacttttggtgtttcggttcttactcccatcgttgcaaaggcagagcactgtaagtttagcgagaaatattttttgcatcctatttttgatacctaagcttcctatttgttaaaatttattatgttcatgttcttttgtctaggatttgggtataagtgtcactacttccatgtacttgatttgctgtatacttcacatttttaagaacaaggatatggcaagcactgttgctgctgcccttttccatcaacctgattgccatgataggaagcaaggaactccaaacggttatacctctgagcatgagaatggcatatctgacaatcagggcactagcacctcagatatagaccagtcaaatgaagacaaatcggatatcttgtcttcatcaaacacgcattgcttgcctgatgatccatcatcaagtgattgttgccaaggcaatacgcttaggtatgctgctcttgctttgtttgagtttccattatgcaaactccttgattgtagttcttactagtactaatttgtaaactatagatggtaatttccactggaaatggggataaggcagtagtctgtagtatgttatatatttctaaacatggtacgtggtattgttaggcatataatggttgcgaagtacattttatatgctaaaatcgttagggatttattggcatgatcttccttgctaggtacattttatcttagaaattctggtagatttggtatattctgattaaaaggttcattgggatcttattcacgcatttattgatattttataatttgttatagttatgctttagttgtagaattagtagttcaaacttgttagtaagaatgtctatcatgtgccaagcaccactccattgctcatgtgcgcaccacaaacatgtatgcagaatgatcttgttttaccactccattgttcgatatttacactaactgtgttcttgaaggcttgaacccatttgtatcctgataaatttgtaagtttaggggcataagtggcacaaagattatttttagggacctactaaaatgatttttaagtttaggaatccaaatgacagcactaagtccttgtttgggaggcccaatttcttggctcattcacatccaatggccaggttttagttcatataccctgcccatccccatggataccccaggtttttttaacatcccaagcatgccctaagcaagtggggggctagtaatgctccaggcatccacatattttgagagcttccaaaccacacaaaaaaaaaaaaccccaccaagttcaaagttcaataaaaaatgcatgggagggtagtagcacccattaccttcatccttccacgcacacttcaactagaatgttaattttatattaatagattagcgaatttcatggttagacttggcatgttttcgatctgttgggttctctggtttctttggagatgttcatgatatcaggtgcgtggatgatagtgtggtcattattatcgtaagttgcctgtcgtggttgtccataaatataagggagatcttgctgcaattttcctgctgatttttcttttttaaaaaaactggactcaaatatcttgtgtatgcggtttggtagacctatgtttatgtggatattcaggacgttacagaaccttagtgcaattctcttctcttcatgcattctgctccccgtggctatgaaaaaaatattattgggacactgacatggtctccagaatgcatttgtaatgaccaatttgcactgttgtgacgtactttattttgcagataaactcaataaaattttatgaaattacagaatattgcatgagatatatctactcattccttagtatggccaatataaatattccctaatactttggtaagttaaaatagtttgattaaatgattctaggataaccttaggcactatatttatcataggtgatacagtagatagtgacatagacctttcttatgcatatgcctatatttacacagctatgaagatatttgtttttaattgatgtttttaatgttgctttgtggtatgttaaggttggatgttaagtagtacgtgcataattttacatattttgtcattctatatggtaaaatatgaatccatttccttatttgcagggaacatttgctgtcttatataataagtggggatgacttccaagctttaggttctttgtgcttattttctacattgttgcagacaaaaggtacttttactgtcctcatttaactaatattttcactgtggaatttccaaaaatagtaattatttgagtccatattgtctttctagaacttgatgaatcaatgctagatgcacttggaattctgcctcaaagaaagcagcataagaagcttctattagtaagtgctattcttcttcttcttcttcttcttcttcttcttcttcttcttcttcttctgcaacattagtacacttctgctattatcacacccagaattctgatttacatgtttgttagatgggccttgtaaattaatcatgctgtggtaatggtatctatgttgttttgcttgtgcaaaatgatgcatctgtttgtatgcttgaaggaactaattttgtgaacttttattattaatatagtacataaactcccttttttctatgtgacatttgttgctatagcttaacattcaatattgaaatgacataagtacataacaactggagccatgattaacttatgttaatcatgttaacttatgttatattgtacctttgttaagatcatgtgagctgtcttaggcacactaattttctgacacctgtattgtgaacctgcagcaagctttggtaggagaagatctagctgaaaggcaattattttcatccagtagcggtctagcagatgacagcatctgcagtgattttgatatgtatgtaaggaagcttcaggtatactgctggttctttcacacacacttggcaggatgcaattatacttggtgccgtctactactttccaaaactttctatgacatagtggggtccacaattaagtcctttactatcttataatatataagagaaacccacacgtggcctggtatctgactgcaaatattgtctcctgttatctcattgtataatatggaagacatgcaatggggcttagagccttgtacatgtaaaagaaaaatatcaagaaacacaagtagtccctgtagtatgttacctactgacattgcaacttcaagttggcccccacctgtgtgtactgagaaacaaaaagaaagtttatagtgctaacttttgtttataactttttaatttatgacttaaatgaatttactcttgttttcccaagcccctctttagttgagcctgaattttaaatctataagtttaatttggtgatagactattacaagatcacctacatgtttgttttgtcttttggtgttaatttcgtgctcgaaggggtgttatttgaactcgttgccctgcgcttcatcaacaaatatcatttatgattcttttcatgatcataatttgtcatgtactccctccatcccaaaatataacaacttttagagttcaagttttgtccggaatataacaaactaatacttgtaaaaggtgatttttactactaaacttcccatactaccccttggttttattatcaccccaactagtctgggcccaccagcccacacttcacccaccccaaggagacaaacaagtccttttacccctctccttaatagccgtgccaagggctaaaacttggtatattcttggtatgttttgggatggagggagtagaagataattttgaacttgccatcctagaatcagacagatttttaggacaaattgtccgcaggtccatgcttattaaattgagatacaaataaaactatcttgtttctttcttgttcgtgtgtttgtcaattattctctagtaaatttgttatcactatgctatatctatgcattttgtcttctttccacaggataaatacggtttaaagtgtcatcatccacggcaaatgacctctaaattccacagatatcaggtttgttttaattttgaaccatatggacattaccagtagatcctcatgttcgtaatataggtttaggttatttttccctcaaaaatggcatcattttttaaatttattttgattgtaaacttactgtcattaactaaaattgttgttccatcagtacatggctaatcattggtgcacactttattttgttatataagtatgggctacaacctgtagacacctcaataaactgtattatagatttaatgatttattattaactgagtaactgatacagtcatcctgatgtctctccaaaaatctatgaattttcttattcaagatgatctttttatcttgcttgcatctacatcaggttattttgaaagaatatatttgcaacttaaaaatatccacacctacatgaatcatgaacgcctgtttccgtattaatattcattcattaattttcgctgtagtatacacttagaggttgatgtgctacatatttgaatatgacttccaatattcaagcattttattttattatcatacttcatatattaagggacgtttctatcgtttgcactttgattttttgcaggtgctcgatgcattagttgcccttttctgcagatctaatgtatctgcagatgttcgcttagttggtggctggcttttcaggcaactgctaccccatggagaagaagagttcactgcttttcatctaaaatggctaaaggtatgttttgatgcattttagtcctgtgatgtttcaaaggagatacagcaatacatgatccctcaccagatcactattcactgggaacttggcagttctttcttgttgtttctagtcctgactttgaagcaagtgtcatctcctaatcctaatgtttgaaacttccccatatatgtcacagtacgcttggttgtggctagttaactagttgaatcactaaatgaaaggtacaaagatgtagtgatagagagaatatctgtatatgggatactgtccaatgcctttctaagaggacaggcaggctaccaactgtcatatctcgtgctcaatgttgtcagatttcatgtactctgtactgatcatggatgtgaaggttaaatcaagcatttatgtatccctccacccccaccctcttctttttctcttccacattgtcactaccctttcgtgtcagagatgaatccatgctgcccatgtatctggtacaattagcctaaatttctcaatgttgtcacaatgttttaatcgcgcaggattcgcataaggattacagtataaaacttttggacgaatctggaggatgctggcgggacttgcttgttcctattgttaaagaagcctggaagaattgcaagaaaggtagatttcaattttgaggtggaagatcttttttccacacgtactacaaatggttatctttgcttatacttttttaccttttccactggagttagcaatcgagacatcttcaccacctaaaggatccaagtctgctattttacccctggattcatgttcatttggaggtcagagctcgttgatcacatgccatgtgacctgtgttgtcctcaactgtactgtgttgaaccatgatgaaaacttgatgtactgaatcatatgcactgtatttcaggtgattcgtccattgccatcgcagagagaatctatgagatggtgaaggtatgtaaatattttcattttttttgactcatccataaaaattgaccgatctgaaatcataggtttgttccgttgatatgcatttctggattttattaccatcaatatgacagggcctgagtgcctgacacagaagtattgcctattttggttagaagtcctaatatccattggcaactgaataacatgtaagagagagaaccgaatggaaaaaccattgataaccatatccacaattctttgctggttgctgtgctggaatctgtagtaaatgtggccacaaagatttacttcagtcatcattgtgctcatggtcagtttttaaaaaattaaatggatgtacatgcatgataatcagctaattacaagatgataatttgtatttgttagtacaaagtttataattactttggagtctgcaaagttccttaccgtcctacttttgtttgtcatactggtagtataaggctatattttacattttataacttgtaatggttcgatagacatgctgtactgtgtgctcttgacacagaatatcaaacttcaaaatgttctctgaaatatttcgagcattaccagcagtgtaggtaatgaagtagattctgccacttttcagatgccatggatataaaaccatgaaaaatagcaattttgttgcacaggtcagaataaacacgaaacaagactgaaaaattctcctattaatggctcgaatacattaatctttacaattgatcatttagaagttgtttcttatttgctttataatcagatcacaatttgatttgcactgttacaatcagcaaaaactgttatttgaacacatacgcatgtcctgagttcttttatacatgcagttctatactcttgctagctgtagatctacaaaagatgcggaggactcccaaacacaatacccacccaaatgctgatgaaatcctctatcaatctccaagcatagaaatatccactgaccacaagcaaccaagggagagaactgagatgaatgctaacataaggcatgataaaacttgtgccatcacagagtccttgatgttgtcacggtaggatatgagagagcaaccaagggagagaaccgagatgaaagctaacgtaagagacgaagacttatgtggtcacacatagtcccagatgttgtcatcatagttgatgacaacttatgaaaggtgcactggtcgtaacaactgcttgtggttgactggttggggcgctgtaaagtccttgttgaggtatttggagttgcatgctaggtattttatggctgctggggttgcatgacaaagctatggaacttggctgtactggaatgagtttttagaagacaaatattatttgggttctttgaattcagttgaacgttttatgttgcatttaaatccaaatctactaagtggagtcccttattaacagaatctgaattaagtaattctttggatgtgaattaacataccaaataatggccctgtaaaatctacatcttggtgtttttgttgaataagtgtttattccctacctaccaatttttagtagtttattccccacgtaccaaacttttgtactagtttatttcccaactaccaccttttgtaccatgatttgttcttttgctactaacttaattttctttttgcaaaagatggcataatccattatattatgggacggaaggagtaaagtaacagactttgccctttaggctgtatcaaattcttatttgtatggttttaagatcccttatgttgcaaaatgggtaaagtgaaatgataagaacgattattggaatatgaccatgccttgttcaatattctatgagtgaaaatgaatgttttaagggatactctaattttaatggtgtaacagaagacataaatatagtagatatatgattgtaatagtgtatttttcttaatttgtcatcacaagtctaaaacaccattcatattatcaatggaggcagtaccaccataatacatatgttttgtgttatttttgacgtttagagagtttgtgttcaaggtttatctagttatctatctgatctttctgtaaatacaatgtaattatgagttgcacttgcatgcactggccagttcacccaaaggcttataagctcatggtgaaagtcagacaattcacttgcacatccagacctcacatgcaggatagaaactagcacagttcttttttttttttgaaaaaaaaaattaaattgcactgtattcaaattatagaacatttaattctgatgtcatattgagttgcatgcacctgacggttcactaaaaaacatagcctattgagaagggttggcaattgtcttatatttcaacagtaataatgccaacaagaagccctactaaaaatgcctctaagttatatgcagagtgaatgtcctgctaggttttattttttgtttgggaactcttgtccaacatggtaaaagctgatgcactaagataaaatttctaatcgccatttccgaaatgaaaattttaaagctgaatgctagttcagtgttcttgtcctatgaattttatcgagctgttggtagatcttggctagcaaggtggactgtgaatggtgcgcgatatgaatcaccaagacaggtactcagtcatggtggcatggtctcatggcaagtaagctgaggtggatggattaactgatgcagtgagagcgttgcgacacacagatgacagatcgggagcatagcagttgatgtcatactcatgttggcatgtgacagtaatggcctatgtttggtgaagtgctgtggagcagtgtggtgtggcttgtcagtaatggtgcctactcatgctgccagcaggcatatatggcttggccccagtggtacagcaataaggatttcacagtggccatggcaaccttggtgacatgacgacaacagtagctctatggtgacataagtggagatagtggcatggttaggaaggacagtaattcttattagaagcaagcagggccactctgggatttaggaaaataaattaccctgtctggtgtccaccttgcggagtggcctttgataagaatatataaaaacaatatgcatagtctgcattgtgcatttgtcgctttcagcagttttgaggtcactgaatttatctcatgttgagtccaatgatcaggtaagcaacatttgttgctcaggctataaaaagctctctccttttttttttcctcgaaataaaaaactctctcctaacaaatgtgataatcactgaagttgagaaacctagtgtttacatcattacaattactactcttaacttacatatgttctgacctgtatgctggtggaagaaacatcatgctgcttttgagtgaatttagatcttttgtaccctctgtgttttgctgctagagtcacaaattgaaacatgaaactaaatttctgagctttattttcaatgcgctatgctttattttttccttcgaaggtaaggaaagcaataaatttggaacatatgacttgttctgtcatagttgactatgcctctgcttaatttattggtgaaatggctggcctattaatttacatattttattaggaattaatgttactgagatatgtgatgattttttccagggttttgtgctacagcgtcaagttatcctcttctgccttggagaaactctcaccgaccagcctcctattttttccccaactgatttgcctgtaaataatcgagcaactttagcaggtttcgatggctcagtacccaaacctggacttgaagttaacttaggtctgagtttacctggaaatttaaactttttcatgcttaaatcatcacaagtgcaaaattgtcttaattctttcctgcacttactgatacttcgatttgccgcattgttgttgcagttgatgcggtcccttgtcgaatagcatttgagaggggcaaagaacgccacttctgctttttggctctatctaatggaacttctgggtggattcttcttttagaagaattacctctcaaggaaaaacgtggaattgttcgtgtcacagctcccttggctgggtctgatgtatgtattatcattacatggcaaatcttttgtttttttcatgcatgatgaaatcatattcattgaaaatatctagcttgtaaaagtatctttatttgtgagtaatctaatgtgaacattttcactttatttcagccaagaatagatgaaaagcatgcaaaatggttacatttacgtatccgtccttctacagttccctttttggacacagaaaaatacaaagggaagacaagaaagtaccttgttgatggaagatggacccttgcttttagagatgagcaatcatgtaaggaagcagagactatggttatagaggagatgaagctccaacaaggtgctgttggagaacagttgaagctattgcttgaatttgacatgcctgaggatggattacagcatccttgctcctctcatgaaaccacttcggatgatgggtcatgacttgctagaacatcatcgatgatcgctcatgccttactggaggtttcatcatgtgcagtgttcgagctttgaaaacatggtggcaggaaaaccccgtcgctgccatctccgacgagcaagtcggtcacgctctgtacattacatcggcagatttagggaggtccccttgttgacacactgtagagtttcgagttttgactgtttttgagttaagttagctcgataggattctttgtacaatagtttgtacctgtcctttgtaatgtcatacaaatcacattccattctttcataagcttcagggcagagttgggctgtgtacactaattgtttgaagaaatgtgcaggcaatcatatctgttgtcaaaaggatgccctgactatagtaataaaatatgaattttgagctcctccatgatttttctttgtagaccactgcttatgtatgaactatttgttttgtttgctttttcagagaagaactgttagctttgacaagcaggatgctcagctaaacaagacaaccagatgagcatcggttgtgcttgttgaattctaccctttgaactgacgcttggaattgagtttgatgttcaattgattgatgcaacactggatgtctgcttcacaatgcagggtcttggtaagatgatagtcttctgtagaccgagtgtttggactttggagcaggtgagcagccggttcatccataaaatactgccgttcatcgatcacttgtgcagaaaaatcttttctgatattattcaagatttgttctttggatcatgtctaacaagtagaggtacgttcatttcaccagagaaaaagaagatcgaatctgaatcattcaggttatactctcggtagtttggaacactcaaggttacattgtcctaaattaataagtactttggagcacccaagaaaatttttttaatcaaggttaaggtgaaatttaaatgaaaaataattgcgattggtcaagactattaaacgggtgaagaaatgaagtgagagagagttgcgatatgggattagatggagaggtagctatatttcagggcaaaattgaaatgctaaatttagttatatttaaagattggcatctgtcggcacagtttggttcaaatcttccgtatattttttttttcttccttgcctatccctactgataagtgtccatccatctcccttcacctctttttactgcctctccaaaggcaaaagtgggggttaaagctttttttttttttttgggggggggggggggtaattacaggaaaaagggagctttctgattggcctctttctgcaccgagttgccggtaaatttatgcacgcgataaaatggactgcaaaaaggaaaagcttcctctttcccgtgcttagcaacgacgacgaccatatagcatgcccgaccgaccgagagtgatctgatcttccttaaaagtgccacaaaaagggctgaaagatggggggcaaggacaccacaatgccatgagaattcagaagctatgcaggggttgagataggaatggataacccttctttttcccaaaaggaaaagcaaagaaagggattagcaggttatgtgtgcattgtgcaatgaggtttttgattttcttttttaaaattctcattcagttttctacagtttgcatcaaacatagttgcgacattacatagttggcatctatcaaaacatacaacagggtcatatagcctatttactgcagataaaaagtcgtggcctttccttttaccaaacaacaggctgtcccaaggccttttgcaaggagcatgcgaccaaagcagcgctctgcagctgagctgcatgcaggggaatggcaaaagcaaagcagagcagagggcagaggaagaggggatgcgtcgtcggtctggccggcaaccggcgacagagaggggagaggtgaataatgtgaatccaatccaatgagagacaaagtgaggtaaaaaatatgaaaagagaaaagcttggaggggaggggccacggaatttgtttgtttgttcgtccaattgtccctctcaagcccttggcatccaacacatgtacttcatccacagtctcaaaatttaagttgggttagcccctatgtactttgactgttgattttttttctccataatgtattatcaataactacgaaatttagcatcgtacagaagtattgcaaatataaatataagatataacatgacactaaacatgtaccctattagtttaattattagtaaaaaaatgaattttgactttttttctggtaatataggtggcctcatatttatattttagtatggagggagtagtatttacatgtagaatctactggctgcttcttagaaaaaatgattgagatttacacaaagagaaatcaagcaaccgataaataggccatccatttcactacggttagatatacgccacatttgtcaattgtattcacttacagtaggcaaccatatgccttacatcttattaaggataagtacatgtgatgtatatatatttaaggcggaaatcctaatggacgggtgatcgctcccccatccgcccagcgatcaccccctgcccctcccctatactcagatatactcctccctcttctcccccttcctcctccccttcttctctttctactacagtacaccacacaatttttttaaaaaaacaaaagttagaaaaatttatgtatagaaatactatatataaaaattttgaattcaaattcaaatttgaatcgggtaggtaaacttttgacttataaactttgggtctataaactttaggtgtataaactttagatgtatagaaatactatatatagaaaatatttgaattcaaattcaaatttaaatcgagtatataaactttaggtgtataaacttttagatgtatagaaatactatatatgaaaaatatttgaattcaaattcaaatttgaatcagatataattcaaattcaaatttgaatcgggtatgtaaacttttgacttataaacttttgttctctaaactttagctgtgtaaacttgagttgtataaactttaggtgcataaatttactaaaataggaaagtaatgcggtgccaaaaaaaggaaaccagttaggagggtaaaaatatacttcccatccattggcccgtataattttcatctctcgacttcatgtagagcctttccatcaattattaaaactatgtagaattcatttttatgttcttttatcagtataacatataaggcactgcattgaagagctaatgcatgacagatgaaattgagtttagtacgattattcgaagacagaaacaaataaaataaatattaaaagtttttttttaagaatgctgatgaacaaagttttttttttctaaatcttactccctctgtttcaggttataagacgttttgactttgataaaagttaaactactttaagttgattaagtttgtagaaaaaaagtattaacatttttaattcaagacaaatttattatgaaaatatattcaattattgaattgatgaaactaatgtataaacttagtcaaacttaaaacagtttgacttagtaaaagtcttataacctaaaacggagggagcgtttctagggatttccacctctgatacgtgagagtgggatccagacatccagtcagtttagattttttttaaaggaaagtttagatccaatttttacactacatgagtcaagaccatagacgaaatgggcagagcaaagtcttacccggttttaagacttgaggacgaattctaaggttgtatcatttctctgagatgtgaattgggtgtgataatcatctgaccaatttcaaatcaaacttccattttacctatcaatctcaacgacatgtttgcaaacaaaaaataatttatctataaaacttttatatacgtgttcttaacgatctaaaaacaaaagctaaaaaaaactacgatgaaaagacctacaaattaactctaaatttatgattgaaaatttaacttttggctgataagcataaacataagccaaaagatgaggcctaccaaaatttatcttcacatgtgagttgtgacagaaaaaaaaaacatttcacatctagtgatttagggggtgtttagttgtaggggtgtaaagttttggcgtgtcacgtcggatattatatagggtgttacatgggatgttcgggcactataaaaaaaactaattacagattccatcagtaaaccgcgagagaagtttattaaacctaattaatccataattagcaaatgttcactgggcagcacgttataaaatcatggagaaattaggcttaaaagattcgtctcgcaaattagtcacaatctgtgcaattagttattttttagcctatatttaatacttcatgtatgtgtttaaaccgatgtgactgggtgtaaaaatttggggtgggatctaaacatgaccttactctttgcatcacagagattgcattttgtttctgacttaagacatgaatataattaaaccccagataccctaacacaaaccaatttcaattgaaaaggaatttatataaattaaacccccccccccccccaattctccatttcctagttcacaattttttacatgcaaagaaactaaaactaaggacactagtagtctagtctagtacaccaaaaggggagcaaaaattgggtgggctcagtccacatggaccctactcggaaggaccgagcccatgaaccctactgactcgtgggccccacctccactgggccccacccccaacactacagccttcccgccatttttgaccgttgccgccgccggttcaaacacctccgccacccaccgctccatcacctcgtcgacgaagtgccccgacgccgccgccagcgccgccgccgcctcgccgtcgacgcgcagctcccgcccgccgccgtcgagccgccccgacagcctctcgcggacggcggccgcggcgccgtggtggtcgccgtcgagggtgaccacgcgcgtggcgatggactcgaggaggaggcggtggtgcgagtggccgtgctcgccggagtcgtcgccgccgccttcgtgggttatgtcgctcgggacgccgtcgtcgtcgtcgtcaacgtctccggcgtcgttgtcgtcgtcgtcgtgggcgaagaggttgaggttgaggtcgaggctgtggccattgccggcgctgcgccgtgcccgtgcgcgcttgcggtcgcttgttggtggtgaactggtgggcgtcttcctcttgaggtccccggacggcggcgactgctccgacgtgtacagccgtaggctgatgacgccgctgaccgctgcatcggcgagcttcgatgtcgtcatgaccactacggagcccgagagatcgagctcttggccgccgaacttgtccttcagagctccgctcctcgacgccgccacgagacattccacgacgtgctgcggcgcgcgctcgacgtcgtcaacgacgagcacgagtttgttgccgccggcggccgccgccatggacgctctcgcgacgacgtcggagcggaaatcgtcggcgcacccgaacttgttgggatcggcggagacgacgacgacccgatcagctgagccgcaatgcgtctcggcgatcaccgccgccacccggcgcacggcggcgtggtcgctccccttcaagagcagccagacgcccgcgcccttcgtcccgttcccgctccgggcgccggcggccaccgcgtcggcgatctccgccacggcggcgcgctgccacggcacgttcttgcgcagcctccgctccagctcgcgcgccgccgcgccgtcgccaccgccgccaccggaggacgacgccgagtccgagagcgggaggctgccgagcgcgagcgccgtcgtcacgtcctggcactccggctccctcagagaactcagggacggcagcgccgccgccgccggcggcgaccaccgcaacgcctccatgcccaagaaccccgcaatgctcggcttgccgccgccgttcggcagcaagcaagaagctgaccaccatgggaggaggctgcttggtccattgccataagctccagctccaaacgactgacctgagcatggatcgccgccgccgcagagatgaagctttctgcatagcctactccatttcctcttcagctcgatcaaatagttctcctaaaatcacacaaccaaaatatctcaaacatgaattcccctcactttcacaatgcaaattccaagaactctaaatcaaaacctcttctgatcgattcacatctctgtttctttctcctaccttgggtggctccggcacgagccagccggggagattaccggcggcgcgtgggccctcctcgtcggcggccgcctccgccttcaccgccgacgcctccctctcgtagttgtggctgcactcggtgcagagtaccagcagcttgtcatccagctcgttcctcgctgccggctcggcggccatggcgacgaaagggctagcaagctgctgctgctgctgctggtggttggtcgccaccatggcctgctgcacaggctctccattgctggacacatgaacagtatcagttagtcttaacagtagtacaagaaagtgaaactcagtttgaaatttgtctcaaaattccccaaaaattggaaaatgatacagaacggtatcccgttcagacgggacgacctggtacctcttgataccctattcggacgggatgatacctctgagatatcgcctgatatatgaggcatcatctctttcgaacgggatgccgtccgtcctatagcattccgagactaggagtgcatataaaaataactatagcagcaggtaagaaatctagtgtgaatctttatctgaatcctttaccctgaaccaaatgtgacttgatcttgtgcatgagagacgcatcattgcaaggaaaagggcaaaagacagcagcagcagcagcactggaataaggctgtgatgccttcgactactaaattagtgtaacatttgtaccaaaaggggagtgtttgcgccactgtttgctgcatcagagaaaagccttttttgccgagcagaaactggccaggattcagatggaatctctgcaaccccagcagagccaaaaaaagccagtactaacactaccacctccccacattccccatgaacaaccatttttcttctccctctctgaagcctgaacctaagtttttactacaacaactactactactatcttccagcatgcagaatctgaatcttgaaagaatgaagaagcccccccccattaatgtgaaaaatatgcttcaggcatatttgtcaacctgtcataatagcttacaaaaagaaactgttccctaagtcctaaaaatatagcaagctctacccttcaaaatttggcccaaaatataaactcatgtaactattttctcatttcaacaaatcacaaccaccccgtatttttctgcacccactctcacctcgatcttaattggtactaaaactcggatgaatgcttatattttaggacagaagcagtaagccgtaatagtaaatggatggatgttcagagagatggttcttgcaacatcagatgacaaagtggtcctgctagctgttcctattccagacagcaacacatcacaagcagcaaagcaaatgctaagcatagctgcctgcatgcccaacagtgagctgaccactgactctgatcagcagcagcagcagcaagggaacaacaagctagcaagaagaggagccaacacaacaaaacaacaccaagcacaagcaggaggaatggacagcgagagtgtgacagtgccagaatcaggctgctgggacacatgcagggacaaaggaatgaacagtaggtgttcgtgcaaatggcggacaaggcaagggcgtaagattcatgggggtgctcacgtacctcgtggtggtggcgacggcgtggaggttgttgagggccaggccggtgccggcgccggtggggacgacgacggcctggagcgcccacgcggactccagcgacgggcggcggcggcggcatcgcatgtatgtctggtagctcgccgtggcgacgagccagacgcgcccgcgcggcggcgcgctggctcggaggtcgccgaggaggcggccgagctcggcgaccatgtgttcgacggggctgtaggacgaggcggtgttgtggtggtccgcgccggggtggtggtggtggtggtggtcctcgtcgagcgcccagcggaggtcgccgacgtagacgaccaggccgccgcgcttgacggcgtcgacgctgcggcggagctcggcggccttggcgtccacgtcggcgcggctcatgaggcggacgtggacgtaggagagctggagcttgaggaggtgcgcgccggcgagctcgtccgggacgtcgccgccctccagccgccgcaggagctcgccggcgacggcttccgccattgacaccgagtcgccgaccaccacggggttggtccgcctcccctgcttccgcaccatcacctccaataccgccctcacgtcctccttgcacgacggcaccgccatgcccggcgagctcaagaacggcgccggccacagcatgaagccgccgccgccgccgccaccgttgccgccgacgccaatgctggggtcgaggaagaagtgaggtgggatggccggcggcggaggggacgatgaggtggacatcatgagcgcgctctccccctcgaggttgctcttgacggtggagctggagaagccggcctcgcgcatcacccggctcacgctgggatcgtcgaggatggagatgatgagctggtccagctcgaccttgatggcgagcaacggctgctgctgctgcgccgtggcagccaccggcggcggcggcggcggtggcggaggaggaggctgctgctggagcttgacgcaccgcggcgctggttggcctgcgcgcgcttgagcgcggcgacgagcgcgttggagagcgtcgggttaggctggatgagcgacgacgcg

SEQ ID NO: 25714 - DNA, 16697 bp, Oryza sativa
gtcgcgcgatgccgagcgcgagtttgagcaccgcggccgcctcggcggtgagagactggtggatggtgtaagcccccgcctgcatcgatccgtagataaccaccaccccccaccccccacaccaatccaacaacaaccagctcgccttctcttctcctcctcgaccacgtcgtcttcctcctctcgccaccaccacctttgcaagctgaggcaagaagctcactgccactgacttcactagttcactactactccttttatcagtttcactcaagcaatgcactagtaatctactactagtaaggctaaggcagctgcatgcatgagtagctagcttgtctttctgcaaatgctttttttctttatctttatagactgcatttgcatggcaatggccaatggcaagattctctctctctctagtttggagaagtaggaagaaggagaggggattgttggtttgtttgtctctttatcgagaggatgtgcgtttcgtcagcctttgctccctcactccggcctcggctactctcccttcaattctcttttcttctgtctcgtgttctcttctgccatagcataccactatgcattgccatggcgatggctttggcatgcatgcggcacgtttcctttgcgaattaggccatgcatcgtcgatcgttcgttttcaattcaacaaacagctgctgctggctgctgctgctgcaaatgctaatgcatgcacaaagtgcagggggtgttcccctcccgttccatccattttgcttctccggttaaggcacgtactcaccctccctatgtaccaaaaaaatggatttctgtaaaatcccaatgcaacggtaataagtagatgaaagtaccaaaatagctagtgatggagccagaatgatttttgagacctagcaaacttcaatataactatagtatttattatcttcttggaatacacaagatgcgcatctttgtattaggagaaataaagagtatttacaaatggagccaaacaagaaaaaaggagggggacgggaagataggagaaggaccaacaaacttaagcctattctcgcgccaatataaggaaacgatttaaagcaagacctaaatggttagcaccggcagcgccgtgtgtgccaaccgccagagagttgcttccgccggagagttataacaaatataactagtatttgttatagaaatttcattatcaatttacttatcaatattaacatttaatggaattttcggcggcgagcactggcgattgcccgagctagctgggcggtggcttcgccacttaaagtatcccttatcctatcttattataaagttagaacctactgaatcctaaaactcaacgtgcaaagatgacacatcatcgttcactaacaattattacatcttaaatatcttgcaagcatgctatattatctataattctattctataatttattaacttttagagctttaaaatacaagcatgttaaatcataacccacataattcacataatatttcaatatatctctccatcatttttataatatcctatatacctgtatattttatcctcacttagttaatattatttctctcttctatcattaatccatattacatcatttgtttttagccattggatgactaatctatagttcaaatatcttcatcctttcttctctcattaacatatatttccccaattgtttttagcccttcttttcttctctcataaagccacatcaccttacttttacatttgaatcatcattctatatactatttaaatgatcataaaccacatcaacttatttaagcttagttcgtctagctatttacacattatttctacctattgttatcatactaaatttctacagcaatgcgcgaggttttacctagttaataaaaaagttatattgaatggtgagttggtaggggtatttaagggatgatttttttatttcgtgcgccaaaagtaggtatggatgttgaatttaattctttttggacaaggttcaaattctagagttaatttatttttgaccaaggtagggagtacaaaataatagcaacattgtttaaaaaaagggtatccctttgccgtggctgagtttaggaataaactcttttaacttcttttaaccgagaaatcaactctaggttaagtataaaactaggcattttaaaccccacctatatacatccctatacaaaaccattttggcaaataatccttttgactttataggtggtataaaagagaatctaccattgcagtaagctaaggtagcccacgtcatacgtatcatctatgaaaacttattctagaggcgattgctattagtgacggcctctacaaattagctttccaaaggctgtcattattagtaactacgtctacaatgtccctctcttgcttctctattatcaatccctctcgagtctgtatctctctggccttgtacactctctatgccttcctctctaatgtcagggaacctccactattctctctcgctccttgttggctcaccctttattagtgttctctctctcaccagatccatgcttttctctcactgcagcttgggacacggcactgccggatcagatggagggaagagggatgtatgtgtgtgtgggggtgtgtggggtggggggggggggtggtcatcgaatccttatgagaagcatgtgagggtggcagtgctagaacaatggttatgagctaacgtctaccccatccctcttccttgtctacgctgcgatgggagatggagtaggagggcaacaacctcgactcttcgatcccctaccttgtgttggcagtagtggtggcgattgtcggatctggtcttctctttcaagctaagtcttaatttattcctcctctctatattatcctatctcttagccttttctcctaaatagatcgggaggccgactggaatccacatgaactcatccacggcggtgggggtagatccacatgagctcatccacacggtggcaaagtggatcaatgcaagcttgtccccggtggtggcggaccatggcaagcctgtccacagtggtggcgggcgaatcgagcccatccatgatgggagtggtgatgccctagcagcaatagagtacgagtgagtttcttttaggttatagaatgattaccacgagcggacctcttataagaaattaaacataatttagcagcctgtgaaagtaactgtttgagtagtcagtaatgtataacattctattataaaagatgtataaaatagttccatgtcagtaagaattagattacttacatatcgaaagaaaagtgccattaaaaaccagattggattgaccttaattaatactccctccgtttcaggttataagttgttttgactttggtcaaagtaaaattgcttcaagtttgaccaagtttgtagaaaaaaatagtaacattttcaacccaagacaaatttattatgaaaatatattcaattattgatttgataaaactaatttagttttataaatattattatatttatctataaacttagttaagcttaaaactgttttactttgaccaaagtcaaaatgacatataacctgaaaaggagggagtatgtacttaatggacatggttgttaagggttttattccggttttattggtgaaaatcggtttctaaagttggacatacggtgattgacattggaaatactactggaataataatccgaaatacatgtgaagatcgttataattaaaaggtattcttaaaacatgggaaatacaatcattaatttttcagcctttaggtcaagcaaagctcgtgctagcttgacctatcaacgatgggattttctacttcgtttgacccaactttgaacactcagagtgcatccactcaatgccagactcccttatctatcacaatgtccatacgaccgtataggagtttatttatttatttatttttgaaaactatatgctccatcggtttgtcgtcaagcaaactatcaacaaaaaccaatggaaaaaatagaaaatatgtaatgatgacaaaatttggttatccatttttatacttttttgtaaaaaggatgaatagaaattaagtactaaattaatatatactataatagacatatattctacattttttttggaaattaataaataatacatatttgggggagttcctagtcattattaaccaaacacataccgaattatttctatcattgaagtggtatttcaccatccgtctatatatgcggccaattttgacgaaaattaaactgcacgagctctcgtatacaagactgtcgttatatacctagttcgatacagttacaaagttgcatgcctaatctttgttgggagtacttgaatgcatattctctttttcttctttttagtaaaaagaagagcagcgcgtgataaggtgatcagaactttaagcgccagaaattagatggcctttgtgtttcagggtgtgctctttattcaaatacatgcactaatatatttgtacaattctttattttgaaaaaaggaacttttttgtagcggcttttgtgtttgcagttttttctcactttcttggtagggcaaagctaatagaccctgaccttggaaaaatgctggtcagtatctattttctgggccttttttaacattataaaataagttaactaggtatgtatacttataagttgcaaagtgggaacaaataaattcgggagtggtttctataattgcctggtacaggaaacgtttatacatgcgtctaatatctagttttcaaaggcgtttagcgagcctatgtaattcagcttatgtagaaatcggttattccacatgcgtaaaatagctctcgtgaaaaactatttacgcaagcgatattttaaggaccgcctgcgtaaatgggtcgtcgacatataggtgacctataacatgaggcagccctaaatttaagctccctatatatggaaaagaagcacaatatacatataggtgtttttctcatgcatattaactctttaggagttaaattggttttatgcttaattaataatgaaaaatccattctctttaaaaaataatttgacatgcttctcgtaaaattcctagtcagcctttcttctcgtttatttctactaagaattgtacaatagtacatcttgattttatttttctatttttattatcacacaatctatttaatttatggagagagccagccatttttctgctgcattttattaccttgatcacaaccgttagctaggaaagatgtcgctcattttgatgctaattaacacgtttcgacaaagccctagccgatgacgaatagagtaatgtatgcccaatgtcgtactagcagtagactgatcgaagccgtcattagcatcaaggtagccttttaatttggttcagacattctgcctttttgaggcttttgctaagggatattcagaaatcgagctgggctggctgggcgtgagagctaaagctgtactgtcactcaatttccaaaggttgccgaatttgacgttgtaatggaatgtctctttttgttcccctcgaaagcacaacaagctcactaattaaggagctggtggtatggtttagtgtgtaagtggcagacatcggacaatggtgagattgtacaagataaacttaggacagcacacctcatagtcatccatgaatgacttatggcctgatcttaaacaataaataaattaatactccatccaaatatcttagacgtatttttttaacttcttctcttaacatgttttgaatgcatggatgcatggagactataaatacaactatcttatttgaaaaaaactagaaaataaaatataattaaaactttttggatggagggagtaataacaacaacaacaataacaatacctaagctgtttagatgccactttcagaaaccactactggagaactaatatttcattgtggtactcaaaatcacaaatatctcggctagattaagaaccggtacaaaatcagatgtgtgttgtaggtaggatcataacgtgcgtgagaggtaagctgagagatcttgagttcaattcccacatcctacaaatctttttgacttggtatgttatctttagtaccggtactaaagatcgaaatttttagttccgatttacttgtcactgtttctacaaccggtattaaaggggtttctaaccggtattaaaaatcgtttcttcactagtgaacgtactattttgttctccaggtgaatgttgtttcattttaagacagttataaggtattggcttactctaaaaaactaaaaaaaaaccaaaaacatcatttaattttttttgcccggcctaaagttttttaaaagttcaacaatatcatgtattattatagatatcaacgacatatagtccataagattaataagaggatcatacatacagatgatatagcacattcaacacaccaattagtaaccaaccaagcaatctcatgataagagcgaacataagagcaagtttaatagcatagccaactactagctccaaattatctatatccaatataatagccaattcatacaatagttgcttactatactattaatacctgatcccacctgtcatatgcacgttacgtcttggagtccatgctgcagctggctatagatctgtagcccgctgctcttctctctctttttttatctctttaaaatatgtttatagctagcttatagtctgctattgtacctactctaatgttctctttcctaatatcatgaaaccaaaatttccctccatatggttccatggccatcctaaacgtacatcggcgatccaacgaccaaaaacaattctttcgacgtgtcagctcctccttggagatctctctctatagtgcacgtaaaatggcatcaaataaaggcaaaagaaaaagaaggaaagtacctagggttaagtgcacggatgcctttctagcagatcgaaaggggcgagaaaaaagcaaaagaaaagtggagtttattccggtgcttaagccactcctcgccttttctccaagctcccttcccaaagatatgagcagagaaaaagaatctctcgtttgtcactgcagcgatcgatgctttgctgcagtagtagtgcagctatagctattgtgtcattgtgtgtgagtgcctgcactgcattgcatgccttagcttccttttctctcagtattacttgctttggttgtgagagtgtgtgtgtgaatggctatgtaaagactcaaactaatcatgatgatgagcaggcacttagtttaataaagcatggtgtactcatctccacccctgtgtcttaacatgatcaggaaaggttttcctggcatgctgtgtatagctgctttctactaggtgtgcatgcaggtaggattgctgctctatctggttttatattttgctgatgtgttaaatgtggatatgtgaggagagtatatttttgctgatgtgttaaatgcgctagaggtagctataatatgagacggaggtagtggtaggtgttgaaaaatattatcttcaaaagtaagactccaatatttggtagaccaacctaatttatttatgctcctaaatatatgctgttacaaacttttctgcaaattaaactattggatcactactacagaatccctaataggggatggcttgtagataccggttcatttaaaaccggtacctattgacttttcccaccttcgtgggataaaaaaatatagaaccgtcatttaagcaactatagatatcagttataaataaaaaccagcaccagtaatatattataagtgctggtaattaaaaaaaccagtacctataatatattatatgtgttcttttataaaaaaaataacatccatgaaaccgagcagagtcaggattcttggcctccctgtttagcgcaaaggaagagggagccaagtggtccttatccacttcgcccccttcacctccctctcttcactcatctcgccaccttcacctccctctctatctcgcccatcttgccacttcacccgcccccttcgcctttcctccagcctcctctccggcgctatccccacccccactctggtgcctccctctattcccctcctccctcttcgtagctgtgggcggctttgccggttgcgacgacgggcggattcagcggcaaggaattatctcgtgggtagatccgacggtgtcagcagctcttgtgggcaaatctggtggtggctgcttatgccaaaggcagatctgacggtggtggcggcaactcccacgagcatatctggcggtggtggcgtttcccacgagcgaatccagcgacagcggcgatgtctctcctcctctctcccacaccgcgaccgcaaccagtcctcgtccctcctctccgccgcttgtggcgtcgtggtgtccaccccctcgatggtggtgactcctgcggatctggcagcgacaaccttggtgtccaaattagcaatttgtgctatgtgaaattgttggatattcagttaaaattttgggtgtttatgatgtgttgttggatggatcgatggtgatttgtgttgtgtgctttagggatgttgttggatcaatggtggtctgggtgtgatgggaaccggctcgatgcatcggctcgtgcattcgtggaacatcaaaggtgttcctccttattagtgcctcctccgtgttgccagtttggaaatctggcatctatcggggtttctcaactggcacaccaatggtgttttctgtagtagtggatcaattaaaagttgtgataacgatgactccatttatcatcacttgtaccacatttcaaaaagttgtgatatttattcatggcagtggtagtgttaagaacaaggaaaatgaacaaaatagaaacaagcctcgaatttttagatgagttattattattactattatgatggaaaacttcatatgacttatactaattatgaaataattaaaaagctaagatggcatgtgttgattctctagatcggcaataaaatttatagggtgtacaagattaaggagagatggtgacacagatggttatactggttcatgccctcggcagaggtaatacccttctccagttgtatgtagattagatctgtatcagtatatgcacaacacaacatgtgaatatatcgtagcgcctaagaaaatccccgcattagggtttccggctccgcctatatagacatgggggcgatcggctaaggttagtaggttatcccttataatccaggtattgccacctaattacatggaataacatcaattgccttatcgagccacacacgcactacatggacttaggcctacctggcccatctcatgctatgcgacccaaaggcccaaccatagatactcggataccatgtcccgcacagcatgcattcgaaatcggagagaatatgtttgtgtgaacaatgtagttcttcttggtaatattatgtgcaaaaatatgttaagcgactcatgtcgggcttgagtcttggcgggtgatctcgctcaagcttcgctcattaatagcactaggtagtagtgtgtgtgggtgatcattcatacaaatgtaggcatgctctcaaatatcaaaacaatgggcattatttaattcaataaccttaaatttaatcaactgaaataggataggatattattttggcatagacatccgatatttgatgggttatatattattttttatccttttagaggtagaaagaggaactacaaaaaaatatgttttatggtgcttggagggtgttggtatttcttaacgacattactagaaatataattctcagcaaaggcgcagaaatattcctagtatattatggttacagatatgatctacaagcgcacagatataccattgtagctttttacccggaagtattccagtgtatcgtatttatttaatcccaagggaagattgataagagaagactatgctaataatttatatgttattgtagtcagagtctaagcaggggttaactaattcaagggtggagtgacacgaagaagaagaactaagttcgctcattaaataaatcataggctatgtggagaaagaataagaaaagaatttatcctaatacttctaatatacaagtatatttaatttacactctctagtatacaatcatacagccaataccccctaactatgccttcctggtgtttcgagagaccaccccttaccgagttccttacaacatgatatttttagtatgttcacattagttggctaaaaaccacgagggcatatctggtgaaaactagctaagtgttggaaacacgtcaaaatcataccgaaaagttttgtaaattcatggaaaaaatattagagataggtgtagatattaaatatattttcaccaaatctcaaatcaaactcaactttctttaagaaaaaagacaaattttggttgaatagtgtcatgttactattcatcttaaatttatcgttttttttactcctaaatgaaattgagtttgaacttgagattatttggtgaggatgtatctcatatgtacacctatctttagtaatttttttcataaatgtgaaaaaattttaggtataattttcacaagtttctatcacttagctcgttttcaccggctatatccgcaaaaaccacgcatcatccaccttgtgtactttgtcttcttccttactctctaaaaaaagcaagataactccacaagcgatgacacacattatcggtttacttatacatataaacaattaaccattctaccaataactgagctcgttaaagtgagcctaacatgtatactcaggaatatctcatattatttttttataattattacacataattaatattagccaaaaacgactatataaacttaaacatgggttaattttttagaacatttcccttatttggaacaaatctggatatctgtggttttacattacgggtgccccaatgcaaaacccgagaaacccgctaggttttgtgaaattttctacttattaagttatatcacgaggttgccacgaaatttagaatgcctagctagctcctgtaattaaatgatttgatgcctctgaatgaataataaaattgtacaaaattttggtacctccgaatttaaaattttaataacatgatagaaacaaaaaaaaaacttgtaatgaagctctactaagcagcatttaaggataggtcataggtgtgcttgcatttgcaacgactcagccgaaaccacggaaagcaaagctggactttgccctttttcacggcaaaagtgcaagactcctgactcctgatcattctttttgccaaagcaaagagatacctttagtttgttgtatctacaacacaatatctatttatttactaaatgtcagttatataatgtcctggaggcacatcattgttgtaggttaggcttagtacgtacttaaattaatttcttcaaagggtttacatgttgacatcaaccaacaggtgattctaatgaaatttattgtatttttccttcagactcttcagctgcagccaaattacaccacatgcataattaatagccaatattaataaagaacccacgtagtgctgacgagagacagatggacgttttggcatcaaaatgttcgaagtttcttgtgagtggagagaataataaaggcaaatatggaataaatgagagtaggaatgtggttaattagttgttataattatatttttcctaatttggaatgcaaaaattctggccaatgttacctaacaatggaactctgccctcggtttaattatttggagtggttgtagttcaaagagagaaaaacgcattatctaatgcagtcaccacagaagtcattttgaatagcatagtatgaaaaaaaagtagtattatccatattaattacttattcaaggaaaatgacaacttaattgtactcatttttatctccacaataatttgctcacaggatcaacttgctccaagtttatcaatttaatgagaggtgcattgctaaatgtggaataaatcacaagttgaacaagcgaataacattatgactttggaattatcctggaaaaaatgatgtaaaatcctgaagagatccaggactactcagtgccttcaggcactagctacactagctattaaactaatgcaacatatatactatatgttttgcactgttggccgaataatacatgcatcatttcagcataatggctgctataggtgtgtgcaagatctacatgtccatgctagcaaaggacagcagatgagccagcatgcaataataaaatgtggctataaatcatgaatcttccaaataccatggcatctgtcttgcttttcattctttgtccccccttttctacactctgtgtatcctagttagcttttttgaccagtttcttttcttaaaaagcagtgaaagtgtactcatatgttgctttcctttacacttttaagcaagatggctcatattggagcatagccagttgcatggtataggtagagagtagctgcatgcatgagttgttttagttgaatccagtcaacagcctttcccactgagcccaaatagtggcactcccacaagaggtgaagcaagtaattctctctgctgtttctcatagtagtagcttcatagggttagggcatttgtgatttgtgtacatgcttctagttagtgtaaggccctgtttctttgagggtctaaaaaagaagtccctccactttaagtcactttaagtctgtagagtcccaaacaggagggactaaaaagggactaaagtgctttagtccataagtccctaagggaggagtttattgggactaaagtagcttttttccacctgctgccctcatgcatggacatggtgcatttctctttgcatagttttagaggtaacatggtcattgtgcagcgcatttaataaactttagtcccttttagtccctataaccaaacaatcatagactaaagtgattagtcctaagactgaaataagtccctaggacttatggatccaaacaccacctaagctatggaatagcacactgccttaattaagtagttaggttacattatattaccgctttgtttcatatataggtttgttaattagctgctctgatctgaagtaggaatgacgcttagaaggttctgagaatggtcttgatggagggtagatgcaggtggtaggctactgtgctgttggcacacctcgaacagttgaggccgagtttacttacaaactttttcttcaaacttccaacttttccatcacatcaaaactttcctacacacgtaaacttccaacttttccatcattacatcgttctattttcaaccaaatttctaattttggcgtaaattaaacacaccctgagtagagatacacaaagaagacgacaagaatgttacatggccattaattctactttatctttgtaattatataaagagcaaaaattatacacttgcagtgtttgaacttgtagcgttattaatcctggccctagactttgaaaatgatctagctagcctcataatgtactcaattaatatacccatcacaagttcaaaagtcttacggtcccctccaactgcttacatggctgctactctagtctactaagtagaggaggagattgtgggcatcaggtctgcgccgggcttaggcggtgtagtggggttaacactagctgtgagtgcatgagtgggagagataagagcaagtttaatagtatagtcaactactagctccaattcatctatagtcaatctaatagctcatccatacaatagttacatactacactattaatacctggtcccacttgtcacacactgcgttggagtcagtgctacagctggctacaaatatgtagcccgctgctcttttctctccttatttatctccttaaaatatgtttgtagctggcttatagcttgctattgtacctgctctaagggaagtagagaaattaaaggagatgagagatgtgagaggtctactctcaaaataaatccatcttcacttattccacacatatcaataaaaccaaaaagactcgaatccccttactttaacaaattataatgtaattattttccattttatctgctcccaatgtatttgtatctcttatttttacaaactccgatgtaataaatgttgaaaaatggacttattttgagacatacgagaaggataaaaaaaagatcgtgaaataggatagaggagggagtaagtagcagccacattggtaacatacctcagttggatgatgcatgtacgtctgtggaacatttcagataacaatgcaagatgataccatgccgaaagtttaagaaccgtatatgcacataacatttccggtctaagaaaacttcattagggacctcgcagcggtctaagcactactacagaaagggccataggtgccggttcctaaccggctataggtgccggtttcctaaccgacacctattggtcggcaccaatactagcaaccggtacctatgaagaaaataaaaccagcacctttagctttgctcgagtaaaaaaaaggaccggctcggctcgaattgagctgagctcactgagcactgtcattgcgtcatcgcccgagttgctcctaaatcaaattaaaatccccaaaatcccaaaatccccaaatccccaaatcatccacaaatcgccaccaaaatcaattgacatcacagtatgaacatactccaatccacaaatccaccaaaatatctaaaaaaatcatccatagatcaaccaaaacatctaaaataaatccataagaaacgagggaggagagcccgcttcatgctccaccatcggcttcgtcgccggcgagcccctcttctgccgctgcccgccgcctgccctcccgccagatccggcggaggggagggcgctgcctccgccatcgtgtgccacctccgccgccgcccgccgcctcccctcccgccagatccggtggaggggagggcgctgccgccaccgtcacacgccgtcttcgccgcctcccctcccgctagatccggcgtaggggagggcgccgcctctgccgtcgcgcgccgcccgtcgtcgaggtacgccgccgctgccgcgcgcgacacatagaggcgagagagacgagaagcaagagagaaagaggcgagggagaatgagagagattcaaagaagacgagagaagacgaggcgataaggttctcatataggataaggccaatggtcggctcggctcggcagcttggataggtgccggttattttaaaaaacagtataggtgtcggtttttctttataaaacctgcacctatattatattaaaggtgtcgggttttttttaaaaaaccggcacctatataggtattggttcttctttagaatcggcacctatagttgcttaaaggtgtcggttttatgcattttcagcccacggaaaagggaaaaacattataggtgccagttttagttattccggcacctatagtgtcgatctccatgagtttttttttactagtgaagtgtgataactgataaatgacaacacgtgacgcaatgtaaggtagtacatatttgttggagtttgtgaagaacaaagagtacctgaatccttagagtatatggagaaaacatgcgatcgaatgtacttgtgattctcataagtaattggaacgaaatgaatcgtctaactaaagttgtgcatgccacaaattaaggccaaacatagatggacataaaaatgtcgaataagcaggtgcttagcacctcgtttacacctaatttattactcacctcatacatgtacttggagctaggtgctctctatatggttgaaagacttgagtttactggtggataacccacttgttgcagtgggatttcggaaatctttttagcacttccaaagcaacatcgagtcaagaaaaaaaaattctctatgcgtcatatagttttgaacaattttaaaataaatatcattctatgtcatatctaacaataaattttgccataaataatacctcgcataacaaacttaaaaatatactagtctcatacataaatttctacactccacaatttacttttttgttttttctgtctgaatatactttatgtttcttggccaaaattggtattttagtaacaaaataactattaaatgaaaaggttatggaatacacacacacatgttaaactattaaccacatgcacagtactctcatggctttgataaaacacgaaagtgattcggttgctcttcatttcgtgatgaaatatatggatcaatttgtacaacgcgtgtttaagtttttcagcaaaaaatgtcttcattaagtttcacttatatatcactggtggagaaaccatctttggtcggtcgaacagatttcacaatagtcccggttgtattaaaaaccgggactaaaaacatctttagtcccggtttaaaagatcaagggtactttttcatctttagtaccggttggtgttaccaaccgatactaaagatctatttgtagtcccggttggtgttaccaaccgggaaaaaagatcaacataagctttactcccggttggagttaccaaccgggactaaaga

SEQ ID NO: 25715 - DNA, 15625 bp, Oryza sativa
  unsure (1)..(15625): unsure at all n locations
cccctcattctctccccctcccctcccctctggctcccctccggcggcgggaggcggccgggcggcggcggcggcctcccctccgtcagatccgggaggggaggcggttgggccgcgccggcggcctccccttcgtcagatccgggaggggagcggatcccggaggggaggaggctgggcggcggtggcggagggcggcggccggcgcgcacggagggccgtccccagtggtggcggcggaggccagcacggagggctggccgcaaggcggcaggcggtggtggccgggcgcaaggcggtgggtggcggccgggcggcggtgacccgcgcggcggtcgggcgcaaggcggccggcggcccacggccgggcggcggcgactgcgaatttttttgaatgatttgtatattttggtggagcattttgttggttgatttagggatgattttgtgattaatttgtggattgtgattgatttgtggattgtggatgtggatgtattttgttgtgcttgatgtaatttttttttgagattttgtgatgtatttgagtatttgagatgatcgattgtggatttggagacaatttgaggatgattgatttgggattttggggacgggatgggatgaaatcaatatatattaaaaacaatgaagaaaagaaaataataaagagcaatcggatctagtctttttagtcctggttgtatctttagtcccggttggtaacaccaaccgggactaaaaatggatttttactcccggttttttcacccgggactaaagatagcgatctttagtcccggattcgtagtcccggttggaaaaccaggactacatgggggttacgaaccgggagtaaaaaccctttctccaccagtgtatatatgctactataggatatgtaaatccaacttatgtaaactctgggataattctacaacattacaccaagagacataggcctttactaatcggtcgactaaggtattacatatatatcatatctctatagctcccgatatacatgtgatgcaaaagtcccacctattaattaggcaaaattttgatacagggcacctaaatgctacgtaatttgttaatagatatcgtaaaaatgtgtcatggttaacaccatcaaaaatcggtaattgctaaaggaaacttttggtccaattgaagggagagcttcttcgaatagacaagaatgtccctagagccacaagcttctaacatgatgttgcagtgaagattttgaaatatgcaactctagatctaccatcggtccaaatacattgctaggatgcatcatattccttctccattctagcactatagattagaaacatttggacctaggggcattcttgtcttttgcaaaaatttctctttttaattgggctaaaaatgtcctctagtcaattataagttttttgggtatcctgcaaccgtgacatgtttttaccatgtccaccagcaattacacaaactttgagtgtactctaaaaatttgcctattaattatgtatattaaagtaaagaagcaacctcccttatgtattaatccaagactactcacatgcattacaaattaaaacaatacataggaacatcataatttagctatattactattcggtcgacatgatatatgtatggcccacaagtttgagttttgcacatttaatttccatgtttttgtctgtattaacctggtcaacccctcataaaaattactccctccataccaaaataagcgcaaccatgagttttgtgtctaactttgatcgtccgttttattttaaattttttatgattaatatttttattgttattagattataaaacacaaatagtactttatgtgtgacttatgttctttagttttttcaaaaaaaattaaataaaacggatgattaaagttggacacggaaattcatggctatgcttattttgggacggaattcttgtagctttgggtgtggattgatcgggacatgttatacagtagtggcacaaatgtttgttctcgaactgagatcttacttgaaacctgtttgacttgcttgtacttttggtgatcatcacgattcatgtgcactacagtgtacaacaacgcccttttccatttggtttgttttgcatgggtgaatcttttccgtgtgattgatgtggatgttgtaagttgaccgtgaatttacatgttcctgctgcctcgtgcttccaatgtacttggtgccatcttctccagtctctttctagatcggcatgtggttgactaaacttcgaattataatcaaggtgtgcgtaccttggagagaataattcaaatggacaattatgctaaggctgaaaatcatcaagaaacttcattatacatggcatgaacatgaatgtagctataatatggttacctcatatatataggtcgcgtccattctatgtcaccaaaagattcaaagaaatgttaagagagaagtgatagatgtctcttactcaaggacaaaaagaggctaataggagaagatgctctgaaataaaataaaataaaatattatgtaaatatgagaggaataaatggtgtaatcactgccagaaaccgtagtacaccagatggctaaaaactattatgaataaaatgaaataccgtcatgaaaatagttcctgacatgttaattcaggactcatgtacgtgtctacgaaatagtgggcaaattaagggcttgtttagtttatggcttgaacaaaccacaaatagaaaaaaaaccaatgccaatagaatgatcatgcatttggtttgtttcaaaaaaaaaaagctattgccaatgttttggcaagaacaatataatacatttataagaagttatgttaccaaaattttgcccacagccaaattttgggcattgccaatgtttagtgagattaaaaatggctacaaactaattaacgagccctaaaactttgaattaaaaaccagacagtggcctctgtccctcccttctggctcgtcgtcttcgtcttcttcttctttttttttcaaagaattatccaaatgtttttttaattatgataattaagtggattatgtatatggtgcaggtttgtaccccttttctgaatctaagcgtttcaatagataaaggaatgacaagggaaaaatagattttaagagcaaatagataggttatgtgtttaattaatttggcatgacatcttttatttccttcagacagtggaacgttcggggtaaaccaacatatatatgcaccagcgcacaataacacaatcaatgttaattgcacatccatatccatacttatatagtttctttatccagaaacagttacgaaaaaaaatgattgatgatcagctcaccacctcttatgatgattcgagaaaccactgtacaataactgatataaagccacagaaaattgcagcacacacgtacaccaatcaatttacatccctgaatctgtctctcaactgccctacatctcctgccaaaccaaaaaaaaaaaaagaccaagaaaagaaacgaaaaggaaaaaagaaatgttgaatcccgagatctcagctagctaggaggacaataaaacctgacctgaccacagctgaatgcaccagctagcttagctatatagctacatacgcacttatacacgcatagataggctggaccctgcatccaaacgtactacgtagtacatgcccttcacggttcacgctcacattccatgagagcaaccaagaaacggccatggcgatcgatcgatcgatccatcgacattgatcgatagagatggccatggccctcctcctgctggacgccgtcgtcgctttcgtcgtcgcgtggtacgtgagagcgacgagtgatcgatcgatccccgagaagatacatatggtatgtttcaatgtttgggaggagcttctgacagacatagtttatcctaaaatttaaaactagccctaccaaataggcaaaattgattatatagtatcgaaagttcacgtttttggttttatagcaccgaaagttaccggttcactttaatagcatccaaagttcaccctgttcccatttttagcacttccgtcaatttttccgtccgtcttaatcgttattgatccagccacacacatgatatgacatttctacccctcattgacatgcattatacttgtacttgtgaggggtagaaacgtcatatcgtgtgtgtggctggatcaagacggacggaaaactatcgagaattgacggaagtgttaaaaatgggaacatggtgaactttgggtgctattatagtgaaccggtaactttcggtgctataaaaccaaaaacgtgaactttcgatgctatataaccaattttgcctaccaaataacgatctagctccatggatttatcgagataataagtagatgtagttacaaaattaatccagaaaataaactagaaactgagtttaccagagtctacacatgattgattgtaaattagatgcgtttaggcgcagcgggcatctcggaggcgagggggaaacgccacggagatagcggccatgcaatggcaggctttcgatcagcaattctcgcgagacccaaggcgatggcatggcatgcatggtagtgttcatatgcgatgccgtgctgctgccgctgctgctagtgctgctagctactagctgccgggttgcaattctctctagcttgacacaagctgcaggtcaccatcgatcgatctgggtctcgattaccatgcagagagagctacatgtacaagctaggatgctgctggaagcaggcagcagggtcgagttgggagaggaccagcagcagcagcaggcagagagaaccctatttgcaggaaccatcggcttgagtttaggctttggctctggactgggccgaggaacgtgcagtagctaccaagctagggggtaaaaatgagagagagagaattttccatgtacttgcagtggtaaaagtttgctctcgttgtctactgtaacgggctgattgatataagttacttgagattggtaccatttcttacctatattatttatagaatggagaagtatttcataactttaaactttggttgaagtacaaaaattaagtataaacattaaaatgggacaacactattcgcccattagctcctatcatttgatctatggctgataatccgtgaaaacatgaaaccgtgctcttagcggtttaaaagatcataccgaaaagtaaactgcaataaaaaaaactttaaaatcaaataatcataacccttaaactttgagagagatcgagagatgggaagaaagaaagaagaggaggacaagtgaatgacagttaatgcccaccaatttttaaaattcttttactgactgtaagatatcttgcagtctaattgtagttgatgcatgagtatattcatactataacttaacttccacatattgcacaggtggttttccttttaatttgtacagcttgtgcagtttaggtggtggtgccaatgagaatcaattttatagtatactagaaaaaatactcatccgtttcaacagggaaaaccgtctttccagtgatacaatagctactaggagctgatgaataaatttaaacattacaatcactatacattaaaattggaaaggcattgcctcctacgtacctacctcccttaactttcgcaagacagttttgtgcccgtatgatgccggagccgatcgtccccatcaaatctaggatctctcaaaattgattgagcgcttttgatccacccgatctcctctgtctgttttttttcctgaaatcggagtgaatccgcaaaattcaggcggggaagatagctgtttggcaatcattgacaagcattaaacaaacattaaatctggcgaattaaatctgaattgaaagagaaaatcatgggggaaaggatgagggaggagtgcagaattgattttttgcaattaagtataataaaaaacacatgggaagacagatcatgtgatggcggcattaggtgcccatgtggagccacagacgactcgagcatgagaaggagtcggaccaggaggtccaacggacgaacaatttttttttggaagcatagttcgttttttaagtacataaagataaagtgaaagatatttcagtcatataaaactattttatatacttactggacattgttttaggagaaaatatcttgtgtatccctgaaatttcacctaatcccttctacgcccttgaattttgctcattcctttacatacccatgaatttgcatgccattttcgctagttgaccgttaaattcttatgaaaaaacccattttgccttttgctgtggagaagcatataaattaatagagtgtattgttggagcgtaaaatttgttagatgggactattatatttatgagttaattatacaccatcttattttcgataaatatacttttagatacgacataaaaaattaatacttatttattatttattagttattaaaagttgtttatgtagcatataaatatatttgtcttatacaacaaatttgttgtattactatcaaaacacatatgctacataaaaaaacttttaataaataataaataaatattaactttttatgtcatatctaaaagtaaatgtgtcacaaataatatggtgcataacaaactcataaatataatagtctcatccaacaattttctacagtccaacaatgtactctatttatttattatgtttcttcatagcaaagggcaaaatagactttttcataaaaatttaacggtcaactagtgaaaagggtgtggaagggatcaaagaaaaacaaaaattcaggagtacataagggaatgagtaaacttcagagacataaaaggaattaggtgaactttcgtgggtacatagggatttctcttgttttagttactactactttttttccatatggcattttggaaccaataactgggctcctgtgtggatcggaataccaaaatgtcctagatattcggcaaaattaattttacaattatttcatagaaaaccgatcaatttgccacatagaaattaattcgcaacattccaaacgggccgtggagctatatataattggtcactcacgaaccggccggcctcttggctatattggtcactcacgaagctcgaggccggcctgcgtacacagctcttccctgcatgcaaatccttcacaaattgcaggtaaattgaagcttgtgctcacgtcgtacgtgttgcacgcatcattctgattcctgacgccctgcctatatgcgtacgtacgtgccctgtacccagatggcatatatgcatgcattcagtcgtatacttgcttagtttcaaaatatatgacatatatacatgggacatatccggtgaaaatcatcaaataaataaaaacccgtgaaaaccatatctatatctgaatagcgtgagagtgttttatccggcaggaaacaaatcattaacactgcattttatcaaaccggtactagtgatggtgacactgatgtgattttctataatagtgtccattctgaaatataagactttatatatattttttaagtgaataccgtggttaggtcaaaagattcctttttgtcacttttgttgttatttgtttaattttgaattgtttacattctcataccaaccatctgattagtttggaatcaatgtttaataatgataaaaatcacgagaaccagtacatcaatgcttatattgtgatataaaatttgaatccagaagaatccatagaaccgaaggtgtatatatagctttatatactcgtcttcatggttcgtttggaccagctatatgtagtatatatatgtatggggacaaaaacggcgacacacactgcaaggctacatatcgcatgtagatgtagccagtagcatgcatgcattagtctgatgggcatggatttaggctttacttctgaattctgatcagttgttgggcagagaagcatgcagtgaaaaaaggaatcgtttttttaacacagtgcatttttgtagctgcatgcaaatgtacaatggtgaaaggtgaaaacctcgatctgcatgcatgatggatacatagatactagatagatagatcatgctgtacacagtagaaaagagtatatcaaagctactcctcacatgcatttcttctcatcagaagctaggcatagcgtacggttaaatttgcttttctgaggcaacatatatgtactgtgtgtgtgtgcagaaagttcaaagcaaggaatatatgaacgggcaaacggacatgttgtacattcagttgcagtgcgcaggcaaaagattggactactcgcatatagtactgttaccgtgtaaagtttacagaaagatatatactcgtggtagaaaagattcagccgagataagatgaacatttactgtttggcatgtagcacttttcccctttccttgatggaggaaaagtgtatcgttatatatgcacgtttcagttcagatacactcatttctacacaccaaatcactagatggtacaaccatggttactgtagtcgtatgcgggtgatagcacatatatgcatggcattgcatcgtaggatattagtagagatgttgctaagctgcggtgctgattggcgcactattgtagaaaacggtttttcgatataagaagggtagtaggatgcaggtgagccataagtggctatgcttgcaaaaaccggtccccggaggccttatgtcggtcgcatgcgacaacatcgattttccaaggtcttttcgtgcatgctggctagccatctgcaaaaaccatttatgtagtagtactgtggggacaaataaataattgcacgaggaaggtcttttcgtgcatgctggctagccatctgcaaaaaccatttatgtagtagtactgtggggacaaataaataattgcacgaggaaggagatgaccgcacggggatgagacggtcgacttcatgagatcgagtacttcctctatatcagtgggtgcgcacacttccgttgggcaaatcttttcttactttattttattgctttacgtgttgagtggtaacgatttatgcttatttatgtgtttcctggtatgtgcagaaagtatgcatcagtgtcactcttcttcacatgtgtaagtatttatgagtattcacgtataagaaaatttcatgaccacctaatgccgagtagttgcacacttgcaaacagttgagagcatgaagatcaatggtaggccgtgtttggaaaaaaaaaaggacgccctgaatcgatagtccctttggtttgcaagctagctaatttacatgttaattacttcgtgaataaaaaacttattatgggcctccaagatgccaaaggagactgcagactccattcattcttcacatctcattctcttcgatcctaatcattccccagccctgtcttctcctttccatttattcaagattgtgctctagctagcttaccacgctctgcggaacaataactagttttgtcatgaatatatatatgttgccatccatcttgatttaattaatttatatttatacatgggaaatgaaaaactgtaagcgtgaagcatcgccaatttgaagatcgctcgattggtcagtttggggctttttgctggcttgggctttggagggaggagatgcgcggcccaggaggctgctgtatttctagcatcgtccgatcgtcagcttttaagaacattcatcttcaatcgtttctcttctctgcatctaaacacactactatagagacgattttcctgaacgctggccccttttggttccagacaggccaaaagcggctccgcctggtaccaggcgaatgccggcgccgggctgtgggctgcacgggataatcgattatcccgtgtggcccacgtaaggcgaccgcttgcgatggtcggtgggcatataatccccagcccgaccgttggcataaaattccggcggtttctctctcataaacattcacaaaattagggggaaggttttcgacctcaaatctttgattgggttccatataaaaggtgtagagcttgttctcctccttcatttgcttacatttttgtcagttttcatcggtgaaatacgatgaaacttgcacttttataaatggaatagtgtaggcacttttttgtttttttattttttttagcaaacacataatgattccattacatgtttataaaagtatttagtacttaaattgaaaagttgggtttgcctctattaaatttattttcattaggatgaaaggacgattttttttttcaattttttagaaatggacaatattttattaatgcttaaaattgttatgcagctgtttaaatagtccgtaaaactttaaattactatgtgattagttccctctaatttaaatacatcagtgtttgaatcgggcatggatgtattaattacaagctttattgtaggtcattgatcggacatggatgtacaacacgaaaagagctcatccaacgttctcgaaggaagcagccaaatttgttgagctcgcaaaggcacatgctgtgagggagaatttgaggagcattttttgcccatgcaaagtttgtaagaacgaaattttgctgcaagatccgaataaagtattgtcgcacatcgtagaacgaggatttaagaagggctacgagatatggacttttcatgggaaagtcggtggtcgtaacgaagagttagatgatttctgttttgatgatgcatacaattttataatcgaagacatgtcacagggacacatcccgaaatacagtctctggtatagagaaaacatttgtgctcactggtggagaaaacatttgtgctccctgtactcccggttttgtaaccgggaatataaatccaagactaaagatggatatctttagtcccggatgaaataaccgggaataaaaatctatctttagtcccggctggtaatggactaaagatggatagggccacatcactattgtttttttctttatattgtttttttctgcttgtatctattccccacccaaatccaaccaaaccattcacaaattatgcacaataaaatcatccacaaatcatacatatccacaatctgcaaatcatacacatccacaaatcatatacatcatccacaaatcatacacatccacaatacacaaatcaatcacaaaatcatccccaaatcaacaagaaaaatttccaccaaaatatacaaatcattcactacaagagatacagataaaaaaaatcactagctgccgactggccgtgcgccgcattgtgcctagctgccgcgcgggctgccgccgcccggccgtgcgaggcccggcgcacgctgccgccaggaacggccctaccttcgtgctcgccgctgttgggggcagccctccctccacgcgctctggccgccaccatctgccatctgccgcctgccgcgcgctggctcacttagtcaccaccgccggccgcagcccctcctggatccggtggaggggacgccaccgccgccgcatgcgagccacggcccaccggaggggaggggaagagggggattcggaggagaggggtgagatttgtgcggagaggaggaggaggaggagaagaggatttgtggatgaggggagagaaggaagagaagagaaaagacataaggttggggcggaggaccaggcgtgctcggcagatttttttttcgccgatttatttatctggttgtttaacaaccaggattaaaaatagatttttagtcccgatcagtaataccaaccgggactaaagatagaggaggggtctgacaaagtctgctttcttttaaaccgggactaaaaaaattttagtcctggttggtaactccaaccgggactaaagatcaaaaggtgacgtcagttctttaaaccagactaaaaatattgtttagtcccggttcttatttaaaccggaccaattgtggattttggacaaccgaccaaagatgatttctccagtagtatctgtttctcaatgtggcactaatcacctcagctacacatgaattggcgcatcgcatggaggcatggccaatgttgcagtatctacggctgatcacacctcggcatgcaagaccaattgtaggtggacacggtgacgacacacacaatgacgtatttggtcgcatcaacggctcctgataccttccaagcctagatagtttgagtctacatacatgcatgtattatgtggggaggagcacacaccaacttatagagaggaaataatttattgatgcataacatcgatcatctctctgcttcgcatgtgtaagggtatttatgggcattcacggtgaaaaaaaaatataaccatctagttgttgaacgcaagcaacagttgggaatgtttcaaccacaagctgcttcatgagtattcattactttcttccctttaaaaattggtaatcactttggatttaaaacttgtatcaaaatatataagtgacgattttaaagtattgtttgtttcatcaattacttcttattcaatttttcttctcgtctaacatccaacaaccctcccaccgacatatatacatccctcattttatctcccgtcataatttagcccattagtcataaagtaaccgcctatatgatgggaaggagtaataacaatccatctcaattttttggaagagagcaaaaataagtacaagaattaagtatcacaatttatttgataaaaagaatcaaagagccatctggtttatagatcagtccacttgactgctcaaaatggactgatcgaatctatcaatttcataatgcatatgcacgccccaagtccggccttgctatttgtactgcaacatggatcacacgatcagctcatcacttcatcagcattctgctccaggagcacagatcaccaagaaaaatatgttttggccaagatcgccatgacgaccgtgtcgaggcaggctacacacgaccaacagttgcctcatgcattaagggtaagaatgggaatgtggcatgtccagtgatcacaatgccttccatgccccattcaacgtacatgtactcaatccaccactactactaccatgcatgggcacatgtactgattgctatcttcttaccttgggacactcgatcaactagctagttaccaatccggtagaggttaccatatatacctttgttgactggactcattttagatacattatactggtaatatatactgctagtacaataagtgtaacttagaaactgttcataaaatttaaaaccaatattttagtaaattcgtgttttggtgactaaagtcatcccattgtggtggttggttgtggcgcgcatggactgtatacatgatataaatgtggagccatgtgtgttgtcaatattcccacgtttattatatatacacatgcagatgcatttgtaaaatgcaacgaaaatttagaagcagccaaatgaaattcaataattagaaacccacacatgcattgttaagactatgttcattgcttcaagttaggtatgagagagtggagtggaagcagatttcgtatgtgttgcatagttggttttaaagataggctaacttgatctaactgacataaaacccatatttaaaagggttaattggaaccatgccgctataaatatgatatttgagataaatgccactactattcacaatatcggtaacgtgccaccataatttagggaaattggaaccgtgccactatgtcgctttttccgctaaaaatctccgttagcctcaattgcacgtggggaagaaattaataagaggtaggatggaggaagatggaactgatatgtggttcccatgtataggggtctaacggaaaacatgacagagtggcataactctattttccttaaattccagtggcacgtaaccgacatcgtgaatagtagtgacattttttaaaaatggcatatttgtagtggcatggaaccaattaacattttttttgtggggaactgactaaaaaacttaattgtaggctcttggtaacactttgtcttccctacgacctctcctcgattttgtctttcatggttactctgaaataaggatggaaagtttgctagttcaattctaaaattgatgaaatgtattctgttggtcagttttgaccttgatggtttggtagcatgtttggaaatgctacatgcatgtatgtggtctgtacctaatttagtagcatatttactactaatattgcaccttcacctaatatagtagaaagccggccacattcaaatatttaatctgcttagttgtataacttgttgtcggattcttctaatgcacagagaatgttacttaatttatgaggcttgttccggtccagcgaaatgtaccgcctagtacaagtacctgtaggtaccattgcaatctgaccgttcaatacatgggggtacgatggggtcgacatagttcttcctcgtggtcgtggccattccatcccctccagctgcaggcatcctccatctcttccctgcgggtacaacttttctccttccatcccctctcgcgcagctgtcctggtctcacccccacctcgatctgcggtcgctcggcggatatgacgtcgcaaagctacgcggcggcgtcgtggaggtctcacccctctcaatccaaggctgcgcgccggcggcggtggccagggcaagcatggtcgcaaaggatgcgcccaactgtgtcgccgctgcggcggcgtagtctcctctgccaaaacggctcggcaactctcaactgcgaacttgctctgcagcattgagaatgcgagaacacggcaccctatctttgttcctctgcatctgatttctattgtgtgttatgttgtgcagtacccataaatctgttcaatcaacttatcctgggatttgttgattgtccaatgaaagatccagtggaaaagaaccgctatacctgtgacacggcaatattatgagttttcttttttgacagagcacccaattacttgttaccgctggcagcctagccctgctgtatttttttctcctccactaacaattttgaagtaacatttgataacttgatatactattttttttagataatgaatttgataacttgatatactatatatacatataatgttcaaaggggatttgacagatttaataacttgctatctaccttcacgatgaaacagagcagtgagcacacttctctgcatcatgttccaggcactagaatttggcacctgttaaattagtgaaatcggtgaatagatgatttatgcagcttacatcgaatcagtttgtgtctataccaaatggatgagaaaagctcactgacttttactaaataagagatgccatcgaattctctgaactttgctaaacaggagtactgcggatgcctaaaatttcagtgaagttttctgaacaggaggaagcagcagcctctgttgccgcatcagcccgaggtcgccgctgcctagaagtccgtcacgctnnnnnnnnnnnnnnnnnnnnnnnnnnnnnnnnnnnnnnnnnnnnnnnnnnnnnnnnnnnnnnnnnnnnnnnnnn

SEQ ID NO: 25716 - DNA, 589 bp, Oryza sativa
tatacctgtttttttaaaccaaattagaacaagcacgttcgtgcgaatgcgcgggctaccttccaaaacaatcaggtaacatcaaagcaaaaccaacacataagaaataaacaattattaaattttattttgtgaatctccatccatagaagggaactatatattatatataagtacttccaagttccaacaaacagccacacagccacacaggtgcacattcgggccattatttagaacgcacaaagctgatatatagcatgcagccatgcacgcatgcagatgcaggagcatgacagacccagtgtcagccactccagtacatagggctacaattacaactatatatacgcgaccaatccctaaaccgagcaagctatatgctgcttcaggctgcagagacacccacatagttttaattaattaagggattgatctgtcgccggagtttcatcagttggcgacgacccggagtttcatcccggcggcgcagtggccggggacgccgcagatgtagtagttgacgcccttcttgaggaggaacgacgcggtccccgtcgccgccgccaccgagtccgccgagctgccc

SEQ ID NO: 25717 - DNA, 1123 bp, Oryza sativa
ccatgacttcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcatgcgcgacgatcgtctccatgttgtcctcctctggggcaacaaacagcaggccgagttggctctggccggaaaggtggccaaatacg

SEQ ID NO: 25718 - DNA, 8306 bp, Oryza sativa
  unsure (1)..(8306): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcgagctcggtacccggggacactatagaatactcaagtttctgcttctgtgattcctctatagtggaatcccccgaggtgcgcttggtacctctcgaaggttctttgttaatatttttctcccttgattttctcctgcccttctgcttgcctctagcggtgtactcatcaccactatcattatcttgttcgtcagatggaggttcaccaaagtcttcatccatgatatcatcagcggtatgctcaggtatcccatctttttgtaattttctcctgtttcgtaatttcattgatgttcctgtttctctggcatccctttctggctcttgttcaataacatgatcatatggctccccctcatggtattgattctctgggtcattacattcttgatcatctggatgatgttcgccactaatacagatctgataaaaacggacagcttaagagaagagaattgcaatgtttaggcaaagagactcaatcaagtatatcatgccagtacacactccaaccagaagtgtgaatttcagcatgcaattaccttttcagatgcttgctggggcaagttgcttaaactttcaccagttgctatatctttacagaaatggctagagttgcttgtctcaaaattggtgtctgtaggagcatgcgcatgagaaacatttggtggaacaaaagatactgattttcctttgccttttttccttcgaacataaggttgaaatttaacagtagttcccgctgtaaaagaaatatgttagcttcttaaaagaagtacagaaaaactagtaaaagttattatatatgattgaagccagctcaaacatgagttcagcatggaatattcacatagtaacaagcataggttccaattaagcttaacttgaggctcatttagttaaggacttctttcaacatgcttaaaaatatcacaggaatttttttttggactacaagaaacatcacaagtttgaaaaaaaaaaaagggagaagatctatacgtaaaataagcacacctgagagctcttcaatgatcaacggactaccatcaggatgtggatttaccatttcagcatgcgagtctaaatcaacagtatcatccaaatcctaaaaacaatcaaaagtcagagcatggagccatagtctttatttgaaatagcagtaccattttttttttctgaacaacgaaatatccactaacctgtggtggcccagtgcctgaagttgtaatagcctcttcatctatatatttttggcatgaatcatcactgaggccttctctatggctatcttcttccgtatcttgggaaaccacatctacagaggaaaccccaaactctggagtagctacacaagcagcatcaatagtctcagcaaccccaggtgaagctccaccagcctttggtcgcagtctaggttggaattttgcagccatttcctcttgagctggttcttccataatactatcagagttagcaacgtcatcgattgtactgttatgagttcccaggtgtgcttgagaatatgagatctgtacactttcttgatgtctagtaggagagtgcagctgcttgtcattgcatcctgcctgatctttaccatcttctttgttttgggagagcacatctacagtggagactcctgccttttggttagtcctctgagatttcgatgcggccttgctggttttcacccgaaacttcggctggaattttgcaactctttcttcctcaacatgagtatcatcacacaatccttcaaagtcagccaaatcatcaattgtcctggcactgcaacaggtcggtggtgcttgggtatctgaaaccaccatgttttctttgtgtgtagccacatgagatacatcatcattattctcttcattttgggaaactttatgtgcagaagaagcgaaaactgttgaagaatccaatgccacatcaggattattcacaagccccagggatactgtcaccacatcttcagaaggtgtgtcaagtataccgccagaagcacaagcattaccatctgtctcactaccatggcatcctaatgatgctgcttttttatcaacagactgttcttgtgaggtgctatctttatttaatgtttccacattttcatctgttgattccacagtaggatgaggtgccagggatctggatggcaaagatgtcttacggggcttggcccgtgccttcggacggaactttgcagctgcctgcccttctgtggcatcagtgatgttgccaaagtcagcctcatcatcaatcattgctatatgaccactgttatgaactccaagaaacagtttttaagtgccaatgtcactggagaaaaaaatcacagatttagggagcacagtaatagataacatgctatctgacaagcaaaagcaaaaaagaaaaaaaaggaaaagggaatacttgattataatattttctaaaggaaggagtatatgacaatatggtgaaatcaaatggcatgttactggtgacctggtggagggtcagagacaaaaatggcgatcaaatgagagctaacatatactactatatgactagctaaatttaatgctaaactgcaaccatacttcagttggtataatattttagattccatgctttaactggtactgcaaatggacaaataaagatgtaccacgagggaagaaaatcatggctgctaacaaaaatcctccctcatcacatcgcatcgctaaaattcacatcggaacaccagaagaagctatgcatctacaacaatacctcatccgagtctattccacatatcgccactagactcatcaagtttatcaactcctttcaggcaggggtggatcgaacttgggacatgggggttcagttgattttgggggaacaaacaacaaactgttgttacttgtattaaggttaaggaggctctgaaattaagagaagagcttcttccagatctagaagagaagctagggttaccgaacgaacgcaagcaaattccagacaaaactagtcccggtgggagagagatgaattctgagaaagaggatgctcacctgcaggatcccctcccctcccctgctctgctcgccacctcccctgttcagccgcgagatggcgcaaggagcggaggagccgagacggcagattttagggttgccaaacaagccgttacgcatttacgccaagggatgggaaggggaagatactagactacggtcggacgtgcgcgcgccaggtgggaggcggcggttttggcagcggcgtggggcaacaatggcggcttcggcagttgccggcccaggctggaggaaggggaaggagctgacatgtggggcctcgggtcccacatgtcggccagagagagaagagctggggggttttgtggactttcaagggagaggaggcaaatgggccaacggcccatgagggggggggggggaagagaagcaggccgaaggaggcgacgggagcggcgacggcgcgcggcccgcggaaggggaaggagaggcttgggccgagcccaaaggagaggagaggattttaatttggtttttctttttatttaaatgagtttaatgaactttgtgacttttaaaattacttcttgagctccgaaacttcacgagaaaattttagagaatatttagggccaaagaatattacaaaatattctcggccaatgatttttaaaaggaaatttttaattccctcaatagttcacttgattaaattgatttaacttttattaaatttctagaaagtgtattattaaatgatttttaatcccgaacgaaaatcggggcgttacaactactccaccttttatctcaactagttgggtgcttgtgcgttgcaacaggaaaaatatatatcaatttaagatcacatgttttaatcactcatgatcccacgtgactaaaatttgagctaatgccataaaagctaagtgataagcagataatttgcttaataaaaaatacttgaaaagaaagttcaagcatgacatatatgtatcttcttctatagctggacaatagtacgaatacatgaacaataagttcctaattttttttaagtacacataacgttaagtggatcccactccgaacagacaatgattatatgtatcaaatatacaatgtaacagtcatccagccatcataaaaactcatgatatattaaaaaaatgaaaatcatctcgagtgactgtatgctacattttaaatccaatgatagaagcttaatttaaatgataaaatacggtacattaaagacatgtatcaaatatatgctaatttttgttgcataatttgcatacaaattgttctgatcaatgttaaatttagttcctcacaccaaaaccagcatctaaaaatgaaaatcgtacatcatgatgtggggatcatggcatgcaaaagcaaccagcaaagtagatgaatagactgtactgcagaaaatgaagaaaaaaacatggtgtgtgtactgaaataggtaagatacatagcaagaatgtggatttctgaacttaaacttgaaacataaaattaaaaactgaacttgcactaatgttcagaatgtggttttcaaaactacaaaatatatctgttgttattatgaagagaaaacatggcagcatatgcagtcagcagaacttaccaagaagtatattatactggagaggtagatggcatgatactgaacttgaacaaccttaagagagattgaattgaagaaaattaagagatgatcaaagtgtagcctgaaaacaaaaagcagagtgagaaaggtttatccaatttctctgcagatattcattaaaaatatattgcatcgatcctttttaatgtatcagactacccaagatacataatcttgattttagctgccataattaaaaaaccatcgaataacaaacatgagaaattatgtttggaagggatgcagtagtcttctcatctctgttcagttcaggttttagacatgaaggaaaacaaaggaatgtttccaatttaactgaggacttgttcagaacttaaccgcaactctggaaaatcactgtttggttgcaatttagttcctcatatcacaaccgacgtctataactgaaaaccgtacatcatgctgtggggatcatgacatgcaaaagctaccagcaaagtggatgagtagactgtactacagaaaatgaagacaaaaacatggtgcacgtactgaaataggtaagatatgaaagatttatgtaactttgaagaacaatagaggaaaactactgaaatgtattgaaagatttttttaactctcaagaacagaatagacaataaattgtaagggttttctcataatcaaatattctaattaagatggtgtcagccttggaagcagtcatattaatcaggtaatacacattttacatacaagaacattcatgtccatatgttacatattttagtagcatcaaataacagcttaacagtagcatacattagcatcagtaaaagtacttgcgattttttctccagaattttcagtagcatacattaacagtagcaatttgagatgtttgcttgtcaggtacagtaaaccactaaggacttcagattttggattagagttttgcatcacagatatacatgtacagtgaacaatggttaataatgaacaatggggatttagtcagcacaggagatttctaaagccattattatgcatctaccataccctgcctcgtatgcctcctcctgtacaggaacgggatcgagcagcactcttaccttgttcgctggtagggtcgaggagtcctgggatcggtggcggcgcgagggactcgaagccggttcaccttcaaggtcgggacggcgatggagcgacggcgccgacggggctgcgggcagcggcggcgtggagcgtcggcccgacctcgccttctccagccgtcgcgcggagtcacgccgtcgatggagcgcaggccgctgctgcggcgtagagcgacggcgttggaggggatgcggcggcggttgaggcgggggagcgaccgagagggtatgcggcggcgtgaggcggatagggggatcggggggtttgagggggagagcgcgaggaaaagaaaagaaaggctatcgaggcgttggatttcgcgatccaacagttcacactccgcgagtctgcctaggcgaggatttaagatcaccactacgctttttttaagcgagatactattgaactatatactattgaactatatgccacttttatatgtggcaattaactatttgccactggacccacatgtcatagacacatgtggacccacatgtcattgagataggtgtggcaaatagttaattgccaaatctaaaagtggcaaatagttaaaagcccctttttaagtagcacatatttctagtggtggtccatgtattagaaaaatattaacaaactcggctagagattgtgtcgacaacaaactcctcatagcaccagcaatcactaatcgccgctccacgcacagtcaccaccgttcattctttctccaaattgaaatgtaaagaatggtaaaggatgacataatatgaaaacttttttaaaaaaatatagtacaaattataatttacttttttttctctaccatagttaaacatgagtttgtccattacccgatagtctcatgatatgttaagtatggttaggccggtgtactcagctattacttaataatctcatgatatgttgatgcataacgatataaagacttctactaacacatactgattaattatggttaaatagattcagctaaaatagataaacatgataccatccatttttctcaataataaagcattcgattgtggtctcctatttttactgcatgatatatgatgacttcatgttgccctgattaagtattaatcttccctgcaaaattacaaacaaagcaattaatctacaaagaacggtaactatattattgtccatatctgttcaacaagtgtctatttacaggcttgagcttcttggcatagcactaggtttattttctttatcatcgcaatttgtgtgctgagaggaatgatatcttgaactaattatcacataattgtgataattatcacatatcttgaactaattatcacaattagttcaaaattgatgcaatttgaactaattatgtgaatgcttctaaagtagtgatcaattagtccctaacgaggaaactctactgctagattgtgtgaaaaaattctgtataacctagcatgagactacaaaatactgcataagaacctttgaggtgtgctagtcaaaatgatgcaactaacagggaagtaagcactttatctcctttcttggtttcatcagagtaaaaatctcgagccgtgatgctattaaccatgaagcacagccacaagctgtaacaatgcaacttcagttgaattgactttagtcttatcctgaccacaactgaatcatctggcttggtttgcttgcgtccaaaactccatgatctgccagtagaaagctcaccttaaaaatgttctcacccttgtaagtctcctactctcaagatgaggcatcaacttcaattaccagtagcctctacaagagcatgagcctcgagtaaaatgatgaaaatgagttggatccctgacagttatttccctattttcaccttctgatagcaacttcagagtttcgtggctttcccaggatatcctctgattcttcataactcttacaggagcaacagatggcaaagttgtcaacccaaaagccactgccaataattcaccatgtctgctgattgagctctcactaagctttctgctttggaattctaactcccaaatgtttgttccaccatgctcagtcttctgtttcaccctgaccaacaactcctccaaggttgtgtgaattgtgttatgtgaacaggagttatctccatcaatgaaattatgaatggatcctccaaagtcggtccaactaattccagctacgttactgatgcctcgctctctcattaggcctctcgtcctcatagccaatgagatttttccagcatccatgtataagttat

SEQ ID NO: 25719 - DNA, 12280 bp, Oryza sativa
tagtgcatgccaaagtatcgggtcattttctgatccagaactcattatgaaatcttcagcgtcagctatcttgccaacacggccaaggaggtcaaccatgcacgctttgagtttcacatccagggaaaagccatcatctggtatcgtgttctcgtagtacctgggttacaaaagaaaaacccatgattaacagtgaccaagacttaagaaatgtgattaggtaccagaaatggaatgtttccaatgaatgtacccgtttagtaccttgatgcagttagcatcctatacttaagttctactccagccatctatactcagtaatgcttcaaggctacaacattattttgtgtagaaaaagtatatgaaactcaaaccctccaccttttacatccgggcttgggaccggcattggcagtgtcacttcaagtctgatgatctttaccaatccctcgacattgacagttcaaaaaggcataacacaggatatccttagctagagttaacacaagaaactgaatgcatgccacaatgcaggcaatatgcacagttgatttatgatcttgagggtaagggtaaggttaagtgtgaacgtatctaccatacaggtaaattttgtatttgtcttaaatgaatgcatggtctaaacatgggttctggcgggagtgaaacacctgccaaaggccttgaatctgttttttttttccctttgcgcgtggcgcatgtacagttttactccttctctgttcaatgaaattggcagcttgccagttcgttcaaaaaaaaaaaaaagaatgcatggtctaaactgactgggtatagctggcatgctttttcaaggactgctttctgccatctatgccatcattgcccttctgaagattaccagaatagcatctctcccttgctattacgtataaattgctcagtaaaagaggcaggagaaagtcaatcaagaacgtgagaaagaataaaggaaaaataataaagagagaaagttgcagtttcagaaaatgaaatacctgagaccttcatctcccagcccctgatggctgcaagcaataagagcagcaagagaagcactctcattcatcatgacaccaagattcttcattttctcaaagagctctagggccttgctttcatagccatgaaccgcatagctcaggatcatagcggaccatgagaaagtgtccagacatgaaatctgctcaaatgtctgttttgaagccttaagatcacctatattcctgtacatagcaatctgggaattgccagagacagtaaattgatcaagaccagttttgactgcatgacagtgtatctgcttacaggttgttggtacagaaagagcagcacaggcactcatcacacttgatatggtgaattgatctgtcccttttctggtgtagagaagctccctaaacaagtatagtgccttctcaaagtgctcgttctgcacaaatgctgtaatcatggatgtccatatgaagacatcttctttaacggtcatatcgaagcatctcagactgtcatttacacaccgtgcttttgagtacaagttaatcagcacacttgcaataaactcgtcaccttgaagcccactgagtatgacatgggcatgtatctgcctaccacatcgcactgcattggtcaaattgcacacttcaagcacactcttaaacgtaaactttgacggttttatcctcttcttgagcatgtttgaaaaaaacgtgactgcttcgattctaatctcagggcacgggtcattacccaaccgagcaaatcctgctatcatggcattgtaaactaccacattttgattagggatgcactgaaataccttgatcgtcttctacaatgccacattattcgcgtacatgtacaccattgcactcccgacgaacacatccaagtccaaaccaaccttaaccacacaactgtgcagcatcctccgaacatcctcttaatcacctagctcagagcaagccttgaggatgccacccaaagcaaaactgtccagcttcacccccgaccggtgcatccaaacaagcacattcactgccacctctggccaccccatcctcacgtacgctgacaacagcaggttccaagaagcctcgccccgttcctcggctcgatcgaacagcagcctcacctcatcaatcatcccacatttggcatacatgtcaatgaccgaattggtcaggaacgcggtccgtgcaagcccgctcaccacggccagcccgtgcaccacccgcccgtccctccagtcccccacgcgggcgcacgaggcaagcgccgcggcgaacgtgaacctatccacaccatccccgctggcccgagcgtcccggaacgcgtcgagggccaggcggcaagagcccaggccggagtagccggcgatgagcgtgttccacgagacggcgtccctgcgcggcattccgtcgaacaggaggcgggcgtggcgcatgtcgccgcagcggcagtagagggcaaggaggttgttgcgcaggaagaggcccggcctgtaggcggcgcggagcatgtgggagtggaggagcttgcccagcgccagcgcgcgggtcctcgacgcggccaggaggaggcggccgtacgccgacggctccaggaggcgggcggctggggctgggcttgcggcgggcggcggcgagaggggaggagggatgatttgggttggattggattggaggggagatcgtcggagaaggcgtcgtctcctccgcggcagcatcgagctgagctgacggatgcctcgccgcgaccgcgaggttttggcctgggtgggtggctgggtttaagcaataagcacggggccaccaaggactcggcatatttagaaaaaaaataatttataaataaaacttttatatacgtgttcttagcgataaaaggtaaaggctgaaatataaactacgatgaaaaacctccaaaattaactccaaattcaatgttgaaaatttaattttaacttataagtataagcataagccaaacaatgaggctgtaaagcatcgaaaatagaagatactaaaatatagtgggtctatttgttaattcctgtaagtttatcctaattatcaaagggataagtatttattttcaattataatatggatggcacgagctcacacatacacttatatatacctgcaaatgtatcctttaacgcacgctcaaaggaatggaaactaccaacatgtcctcaattcatatttggaaacatattacaataagcatgcttgtgccaacatgtgcacacatcacactcatacactcacaaagattaatactagtaaatctctacttgaaaaaatagaatcataatattcaaagaatttgaatttaaaccctgctattcataagtatgatcatgcacccatggcttcatcgtcctatcacactctaaggactatataaccaattttatctttaaagtaaattatagtttgttgtgaattctgctctagtgcgttttagatgtgcagcatgcgtgtctctatattttgaagcaatgttataaaaatgctctaccccttgttctttctttcctcaaccttggcaacggctttctgacgaccgtttgtgttgtctatcttaaactctgctctcttcttctaatatattgatatataatttttttgcgcttttgcggaaaaaaaaaattgcttggttgcagtgcacatgaaaatacaaaacagtggcattcattcatattcatattcacgcgggatatggtacaggtactaggtggtgagggcattggggagcgaggtttgagtgccgaggaccttgccgccgacgtcggggaagcagtcgtggccggggagagagcggacgcggccgtccttgtccaccttcaacgggtaacacatcaggtgccccttcgtctcctccatctccggcgacacgtacgccctccagttctcctccgccatctccctcacccgcctcacgcactcccccgtctccggccgcccgaagcactcctccaccgccccaaggtgctccgcccacagcgacatcctgtacccgtacacctgcaatgcaaaaaaaagtgaatattagtgaataacctaatatcagagttggaaatttcgaaccgaaatttcggtcattttggtcccctccgatacgatattacttcggctaaatttttttaatttttttcgtgaattttggtaatatttgttcaaattcaactaaattttgttcaaaatttcggaccaaaatttccgaaatttcgggatttcggtgaactccgatcaaatgggctaaaaccgatagagtgaaccctacctaatatcaaataattaaaaggggtgaggcttttgaacctaggttggctagttcaacaccttgtggagttagcaagaaaatcctcgtttctctacatctgcaatgcaaacacacatctctctctctctcgtcatcgatcgtaatgaagctctttggatgaactgtacctgtccacgaggagggccttggccgtgatcagcagaccacttgtagtgtggctggtaggcgcccatggcgatctcggtgtccctgcagccttccatggacctctggttgatgttggccgatccgatgatgacgtactcgtcgtccaccaccatccctttcgagtgcacatagatcatgaatctccggagcttctgtgccgagcgctggatgcatgattgttaatttgcaacaatgatcagccacgagtatttcaccacacgtagtagtaatacatttacctactacggactacggagtagtatcctgctgctgtactgtaccagagtggagttgtcattgcataagctcgtctgggacatgctgtcaccggcggcgacctcgcgcttgccgaggcagtagaaattcagataatcttgagggtgagcttcaaccaatccctgcatctgcagagcgtccgctatgatcttgtacatcatagacattgtttggctcttcaaaagaataccagatcaaaacatcagtatcttaattaatttgtacttcctccgttttatattataagactttctagtattgtccacattcatatagatgttaatgaatctaggcacaaatgaatgtgtctagattcatttgttaatgtgtgcctagattcattaacatctatatgaatgtgggcaatgttagaaagtcttataacctgaaacggaggtagtagttatttgcatgaataaatgcctgcagacctgccaaaagaggatttgctgcatcggtgccgcggttgggatgccttcaggccacattggtaggacaatgtacaccgcgaactgctcatttgccttgatcttgcttgcaatcttcaaggccagctccacaggtattaagttatcagcacctgatctcaccagagcattccaatcgtaatatgaatgcagaatgcccttgtagtcattaccaaatgtgagtaacaaacagcctgacaggtactgaaacactaatcctactatctcttatgccattttcaggttctaatgtgtcgtttgccatcgtgcatctgaacaatccaattgctgttcgcaagtcatagcataaacatgtatgtgattgttaggctgatcaagtctacaactacaagatgttaactgttggttgccaagcaaagaaatttgtagtgaaatggcatttcataagcttcacctaaagcagaactgaagacagatttacctgcgcttttatgtgaggaccataagaacgatgacccaatgaaatactggttctcaatgtatatgaagtgctgcgcagacctgattgctttgacatatgcactgtgtatgcttttgtcgatctttagattctttgcacagacaagattctgcagaagaaaagggaaaataactaaacaattgttgaaagatgcacttttagctggtgctgtggtgcatggcaaaggacactaacctgagactctgcctcctgaacaatttttgggaacccctttacagaacctgaatcaattgacctgaacacctagccgagcaccaaaataagtatgaggaagtaccatctaagatgttactgtagttcatgtaagactaaaacaaagtcttatacctgcacatgccaattttctgggtccttttcttcacaaacatgtgcattagcctcatctgcagctggggtaacaatccaggacatccggtttatttttatcagcgtgtcatgatgccaacttgcaactttcttaagattgaccttccatttggttgcttttctccaccgctgttcaaagtttgtcagtatatcaaaggcagcagggccctcaatcttgcagtgtaaatcatgccatggctgtcttggtccatatgaattaacctgtagatcaggagaaaggatcctcggcgttcatattcttatcagatagagaagatatattttatagaaaagtcagattgtacaacgtgctgccaatacattttatggagatatttagcaattcacatgaatttgtgtaaacatctatgaaggaactccatgatctgataacagcttatgaactggagaacttacaggaaatgtaggattatggaagtccttgttgaaagcggtatcaagatctttgaaaagcctatgttcaggtgtatcgtatctgccgtcgcacaagtctagaccaccaatgaaagcagtgattttgcggttgttcccagtagcttgtgtatcaacaagcacacatttctgatgatgtgtaaataaagttcccactacctggagaagagaaatattacattagcaagcatcatcgaaaggttttttatgaactattaacaggcaaatgaacaaatggtaaggcatgagtttgctgcatgaatatttagtgtagctttctcagactcagaaagaacatcaggactattcatcctgacaaatgcagataagcaacagaacatgaactagtgagaacctacttgtatgtgatttgtaaaagcaggcataattggatagtgtgtactagtaggtattatattcaataacaagtaattactatacttatgttcatgtactagtaataactaatgaggcagttaaattatagcgctatatcagacaaagatttctgacctgctgcttgaaaatgctaagcttagtgctggcatagcgaggaaccagcacacagtgaacacctgaatgcctgaaaaactttttggtctcctcgtcgtgtgtatgcatgacaccatcctgcattcaacctgaattatttctcacaatatcatttccgaattcttgtgagtttgacgatatcaattcatcagagagtacaactgaagaagaagaagaagaaaggatataaaaaagatgatagatagatatactaccggtttgagaaggaacttgtcatgcgacgtcttgtcgtcccagagcaagatgacgatgcggacgccctcgcgagcccttttcttgagaagctcgccgagcgtcgatggcgtctcgccggggagcgcccgggtgggctccctgacgagcttgacggggtggtagatggaccatccgaccatgtacacgaggtggtgcgcctccacgatggagtggcagatgtcctcccagcatcggccgtgctcgtacgcccttccgccggcgatctggatggccgggaggccgccgtcggcgacgtgggcgtcctggtagagggtgacgccgccacctcggcggagagggaagtaggcgttggggacggcgccggcgccgcccctgtagagggggttgtcgtcgatgggcctgtactggacggagaggcggagctccggcggcggccgcatggggttgctgctgcagtggccgtcgatggggaaccagccctcggcgggggcgccggagaggatcctgtcgacggggagggaggcgacgccgatgagctgcgcgccgaagacgtcgttgtccttgacgtggaactcgagcctggagacggcgtgggcgacctcgacgcggaagcgctcctcccacctggggttctcggagttggggatgacccgcgtctgcgcgacggtggcgccggcgaggcagacggagacgtaggggtcgctggtgatgatcttcttgggcctgacgccgccgccggcccggcgcgcgttgtcgccggtgccgccgcacgaggagccgcaggcgccgtagccggtgaagaagcggcgcatccgctccgacatgatgtccatgttggggaggcacttggcctcggttatccaaatgtcgaggtcgccgtgcaggagcacggccgactccgaggaggcggacaagtcggcggagcttttccccatgccgcgcaggggggcatgctcttcctcttcctcttcctcttcctcttctcctgcttggctcggatggcttgcgtaacaatacaggaggaaggagagagatggcggcgcgggcgggggcacgcgcgcgcgggacggaggcggaagccgaaacaagaagaagaataaacggacgaggtggggttggcgacggttaatccatttttggatttgccatggccgaacaacggtcaggtgtttcgcgttgccatggacgcgtcggttcgcagagacagttgcttcactgtcagcatcccgttttgggcgtctttaaatttggttgtgtttagttcagcgcaaagtttaaatttttattgaaattggagataatatgactgaaaagttgtgtgtgtatgatagattgatgtgatgaaaaatgactgaagtttggatccaaactttggatctaaacacagcctttgcctaattttgaaagttcacacccgtttatatagactcgtctaaaatagtttaatgaaagtttcataaaagacgtttttattcgcctaaatagcttaatgaaactttcgtaaaagaaaaagggttgcagtcatcttgtactccctccgtcccttaatataaaggattttaacattttgcttacactatttgatcattcgtcttattaaaaaaatttagaattattatttattttatttgtgatttactttattatccaaagttctttaaacacaacttttcattttttatatttgcacaaagtttttgaataagatgagttgtcaaacagtacaggcaaaatatcaaaatcccttgtattaaggaccggaggatggagggagtataatcttaacgcccgttctcgatgagaccaccggccaaatttcagatccacacgaaatgtactcacggggaaacgtgcaaagtgaacgttaaaatcatttttgcatggaaaagtttacactcgattttgttcagaaattggacttgctcaggattggaaacaaaccaatcatcaaaagggggacagtaacaaagtatatactaatgtgcacgctgcaacaagttcgcatgatgaacatattatttgccagtcacaaaaccatcatttgaggtacgcagccatggcccatgggtcatccgaccacaattggaatagttttgcatagtgtaaaggaaaatcagcaggctcttgctaactttgaggcgatacttaaagagtagaccagaattggcgatatcagacaagatgatgagatagctagttcaacaacactccaaaaaacctccatcaagatggaccgatccaaccaaacagcgtttacttgtcttccccctgattaaatatagaagataaggaaattaatgaacattcaaaatgataattttgaattagatacgttaaaagataatcaccaatgtcatttcacaatgaacaaaacttgctacacgcatcctgtaagtactagattcatgacagccattataacttctgcagagggttttcaatactttcacttcacccaaaaggacaccaacacaacatttttcccatggactgttgaaaatcagtggcttcaacaaacgataactctatccttccacacacctgagagtgttttcaaaaacaatctaatcccaaactgaccaaaacatgactgccatgagatcatctatacaaattttgacaaatgctgaattaagaaaaaatcccagatatagaaaaggggggcttgctatggaaacacaaggagtggcctaaacgtgtttggaagttggtaaattactaccaaccacatgaaacgtgtgctctattttttgtttgatcactgtcagcatgtacctaattcctagcctttggacaatcgctgatagtaagaagctcaacccatgcattcataaatatgcaacaagcagtagcaaacatgtagtgcctgctatgtgttataaagttaaagtggcaaataaatttcaccaataacctattctggtctaatattaagtacatttcttttccagaaacaccaagagttgataactgtaccacatacaaccaggataaaaatatggtgaggtcaagtaaaagctaaaaaagaacagtaaaaggatgcagttgatttactgatggtaaagtttgactagtcaacaaacagatatatataagttcagggaaaatgagaaaacacttacttcagaatgagcagaaggaacggtcgaaactttgggtgaccactttggaggagcaccattgaataagtatgaacattcagtgtacgcagctcctatccccacaccagctccgagcgcaactgatgcccagcgagtagttgggctacctgtataaaataatactggtcaaaatatggtggtgttcttttctcctgaaaatgaagatggagatgaagttttttacgcaaaacgaggtggtattaacatatgattgattgagctttaattattacaaacttgaaaaatagattaatatgatattttagagcaactttcatatagaaagttttcgcacgaaacacaccgtttaacagtttaaaaagcgtgccacgaaaatcttaatcttcatccaactcttgttggagaaaagaactaaatttattagtactttaatgaatgtctattcactggtattttaaggcagaactactccctttgcattttttttggacatatgccatttctaacaaattcaggataaaatatgatgaatagtaattcaagaaggttcaaagagaacgtattgttagttgtattgtcaagatggtaaattgtcatagctaaagtactcaagatgtaaaaggagatctcagcaaacgtgttccattgtttaaagagtatctggatgtcaaatccgtgctgaatgcaagaaaaaattaaaaaaaaaagatacaggaaaacttaataactaataatgacttcagaatagatatcatgtgaagcccttcatatttgagattgagcatttgaggttcacctaggaaaagatcctaaacatgcatgctataatgtgtgctcatcaccattaggaaaaaataactggagagacatcaagctaaaatgctaagtgttgatcacataaagcacagtcaacactccaagattaaggattagtaccagaccacaaatcatacaaaacctcagcacttggcacacaaaagttactacgattgatccccctaaggaggaccaccagttcaccactgatcacatttcaaacatattctaggcagtatgagaactaatactatcaatggctaaacatgaattagaagggatctaaaccgtgacgtgctgaaaaccaataccatttaacaaaaacttctcgtaaacaagctaccacacatggaagctgcccatacgaaagaaacacaatgttgtaataaatgttcaccaaagccttacaagcaatccaggcatagcccccacaatgaaacaaggatatcgatacgtgattcaggcatcctcacattctgcttgtttgtacttatttcgctctcaatgtcatacagtaaactaagaccaaggaattttcatctgcacatgtcaaatcccagaatcattgtggcacacaaaaaactcatccacgctaaatgcgacacctaatcacatgatattgcatgaaaaaaaattactcggaatataaagcaaccagttcctacataacgtgcattatacttggatgtaaccctaattagccaatccctcatcagagtaggccgatcggaacggtaaaacgagagcaacggcgccaaccctaggccaatgccggaacaacgagcgcgccgcaaccagatctcacgaaatcgcacgcaatgggaaggcaagggcgagtttgggaggggggaaactccttacggaagaggaggaggcccgcgaaggtgccacccagggtggagtaggcgacgcggcggatggagatgtccaggcaggcgtcccacttggcgtccaggtcgtaccgcggcgggatccccgacttggtgggc

SEQ ID NO: 25720 - DNA, 18663 bp, Oryza sativa
agggggccccccccccccccccccccgttttttttttttttacgaaaaaccagcaggagatgctcctattgaaatgcattgtcaataaaagatatttacaatcccaaaaagttctaagagggagaaaagaaaagaaaatagaacttaaaagaacaaattacagattatctagccatgatttccagggtggtctgtcctgagctctaaccctatgcaaaagtagggtaaaatctttacggaaaagagatttctaggaattgaaagtgggtgttatgttgttgaaaatataatcattcttcttctccagatgttccacaatactatcgcaacaacctcaatgaaaaagacttgggaaaaattcctttttgcttcaatgaacataggcatgaaacttagatttgattgccattggattccacaatagttccagtttactatttcacaagtaaatataagggtctatttgaggagctttagattctgagaagcagctgtttggtagccagcttctgagaatctggaaaagctctgaaacccagtttctccagcttctggcttcttagttcatttttcagaatctgtaactacagattctcagaagctgtggactgtttggggcagcttctagcagaagcagcttttgggaaaagctgtagctgagagaagctcccccaaacagggcctaaatatagccacatgggcgcggatctaaaacgaaatgtagaggggtaccacttgtttaatatactctactttaaatcgaatttaagctgacatgggtgcctaagtttgtatttagggggtgcacacatggttaaaatgagtaaggtatagctaaaaaatttcttgactgggttcctgggcaccccccctgagatactctacctccacccttggccacatactccgtatttattttagtcctaccagtgaattatttttctggttacaaatgcacatttattgtacagtataacctctgtttttttaatagatgatgccattaacttgttgtaacatgttgtcacacgtttggctattcgtcttattaaaaaaatcacgtattataatttatttggttgttagttgttttatcacttaaattattttaagcatgaaatttgaatgagatgaatggtcaaatatgtgtttagaagtcaacggcgatatctatttaaaaaaaactaaggaagtatatgtttaatgggttcagatgacgtctacctgcatggattgagtaatataaacggtgctcataagcactttagcaatgactaacaaatggcagcattttgttgtaggctgagaggcactgtaccactaactaactatgtgcactaacattagattataaaaatgttattaaaggtcttaacaaaatgtctatagattgcacgatcaagaaagagacgcagctgaaaaaaaaaagtgaatgaacaaataaggggaaaaatagacacggctggaagggaaaataaaaaatgtacaacaaaagaaagcacaaaaaaaaaaaagcgtcgacagcaggattcgaacctgcgcaggcaaagcccaacagatttcgagtctgtctccttaaccactcggacatatcgacctatcgtgctgttgctgctgtggtttcaaattttacttagattttttcttgctgggtcaacacacacaaatgcatacagagaaaacgttgatagagctgttgcaactaaccactccacaaaaatagatagagctgctgcatacagagaaatcgattggtctgtgccattcattttgtacagtctacaaaaataagcgaaaaataaataaatcattacaagggtcgaaacaaatacaatcagcgaggaaactgtgaagagtacatcatctctctctccatggtatagcacctagagacaacctgagattctggattagcaacaaggcccatttcaacattcttggtgctgttcagggaagtacatttgtacttcggagttaataacggctttatttcgctgctcctttgtaagtcttccttgtatgcccttgatcttgcagctcttaggagttgcagtcttatctccacttctttcattttaggtctctttgctcctttagtctttaagcacatctctgcaactgaggccatttcatcaatctctctatggctagcttcctctacaacttgagaatccagtatatccattgttgttttatctcttaggctttgaagaaaacagtggcacaaatttttctgttcaccaagacagttgagaaaaattggcttcttccttgttaggagttcaacaagtatcacaccgaaactataaacatcactcttctcggttaattggcttgtatagaaatattctggatctaagtacccaaatgtcccctgtactattgtaactacgcgagtttgatcaatggaaatggacctagaagcaccgaaatctgaaaccttagtagtgaaggtaccatccaagagtatattagttgatttcacatctctatggaagattggcattgcagcagaggaatggagataagcaagtgcccctgcagcctctagagcaatcctcattcgatcatcccatgtcaacaaacaattggtgctcagatcaccatgaagaagaccatgaagtgtgccattagaaatgaattcatacactagaagaggcacctcagattcaaagcaacaaccaaaaagtttcaccacattacgatgaataatctgggaaaggatggcaacctcattaacaaattggtcaatctcactctgctccacaattttggacctctttatggcaaccactcgttgatcggataaaatccccttgtaaacagtaccatggcctccatatccaaggatacgtgttgggtcaaagttgttggttgctttctctaaatcttccaaagaaaatattcttgtgttaggagtaacattgttactggatgagatcagctgctccaagagaaggcctttgttttttcggaagtatgcccttcgaattttcttccgagtgcttctcttccaccttttgaataatatagctgcaattaatgtaagagctagaactccaaaaccactgctaatcccaatggcaagtcctacaggagtaattgcagcaattgaaaagttattctttgaggggtttgataacattttcaacaattggagtgcatgcatacagcaaacaataaataaaaacctgacatacccaaaacaatattttgcctcttattggaagtgcactgccttcttactcgatcataagacataccatgaggacaacaactatagcttcctttaaagttataacatgtcccattacaatagtttggtatagagcattcatcaatatctgcaaacagaaaactaaaaatgtgaactttaatatatcaaactcttgatggctcctatatgcttttgttttcaattaaatgcacattaactacaacttccacactatgaaaatcattggataacatatcactctcttcagatattccatatctccatgctcctgccacatacaagaaaatcgaatgcactagatacattaggaatgtgtacctgtacatccattttggacataaggatttccttcaaatccaagagagcacttgcaacgataaccaatatatagcttcccatgtgtaacatcaagacactcgctgtttgtgctaacacatgcatatgcacttttgctttttgcatcttcacacgtcaaattggtcacagaccacttccaaacaccatactcttcagataaatcagacttttccaaaccataaattaattgttggccaaaatatccagaaccaccatagtatactgataaatactttgtgttggcatcttcaaattctgaaagcttgttaacataaaggagtccttcatctaatgatatatttgtcacttcatattttgcaggtggtcttccaataagagtgcgatttgatgcacaactcagttgaaatctcctcttagcaaaacagcctggctcaagcccaaacgggaaaggaatatttgtgctaccacatgatctagaacaattctttttcggggtagggttaaactctgttccagttaagaaacatatatgaccacaaaaaatatgtagtgaattaacaatcaataaagaaaggaacatctgttcagagaggagctagagttgcgtaggtaccttgtttgcaatcatcaagaaggtagggattgccatcatcagaatttcctgggcaagcacaagaataacctccatttgccacatctatgcaattgttactgccacaggcaaattgtgtcttattatccaaccgagctgttggacaatttggttcatctgcgatgacagtcgagaggtatgccatggaagcaccaatggtgcttgcatttatcttattggacaggagatccgcaatgctaaaaatgtaaggacggaaggttaagaaagccttgatggtgatattgttgaagggctgcggtattgtctcgttactcttaacaatggtcactctaaaacctcgaaataacaccgggaatgtgacagtgcagcaacccatgccattgcaaatccctccttcggttgccatgtgcatttcctccatggaggcacacttgatcgtgcaatgacccacaaggttaccagtatctggatggaacaggtaaaccccgatcccacaaccgaggaacgccaagtaattgtaggtctcaacgttgagattcctcccaggagagtcccatgacaagttgtaggtgtcaactccatgaatcatggggatagtgtacatgatagaggcaaggacagttcctgaaggatagaggctaatcacctgagtcatagtgtttcccaagaagagcttcaaaggtttgctggtggtgtcgcaagtaagctcaaagccctgccgaaagcaaccaggcccgataccataaggataccagatgttcacttctccacatgttttggggcagggagcaagactagcagcagtgggaggaggtgctccagatgccaccaacatgacagtggatgctatgatcgatagcaaaaccagctgcatgctagctattatagtttcttttgttgaacccataagatgggaaacaagaaggtacccaatattatatagtatacatcctctgagaggaatggaaatgtggataaccaatatcgaccagagcagaagttctcccattcattaaaagaaggaaaagaaaacaatttctgcaaccttgccgggtcaaccaagctagccatgggggaatttgcagatgatcttgggatgcttttaagactcttcgccactctcttgacgacatgtaagacttgtggtggagacaaatttcctttctttttggttgaacatattgtagtccaccagaacgaaacacatcatcatgtacaactaaagttatgtttgacttctgttgcagtatgagacaagagttagtctctgtgtgagcaggtagaagatctgtttgaatctaatgcccaattgtgacaacgactaccaaatccaactctggtcaatgcagtatcaaagctgtctagtgtgtacatgctgtgtggatttatgaacatactaacttgcaaaagaaggcgttgatcaatggaaccacatcactacataagcatacaaaaggtctaaaactaaaaggacagttggttttaaggatatccgtacggaggtcacagtaaaccaaatcctagggaaattcatgttgcctatccatctagagcgctggaaaataccatccaattccatagcaagactctccctactcttccatgcaattgcacatgagacaattagagattaaaaaaaaaagacaagcacttcggttggaactgaactactgaagaaattcctacgatggcgaactcaaatataagggagaggatatgccttggaatttgggggagaaacagaaaccgtaggttgttgttgctgctgctgctgccatggaagcacgccaacagcgacaggcagccgctcgccgtcgtcgccgcgcgccatcccccgcctcgcggtcgcggatgcctcggcgccggcggcccctcgccgcccgccgccgccgcggtctcgcgaccccaacgacggcgacgagcgagataggtacacaccgtcacagggctttctgtgagatgagcccactacacgttacggaattggcccatcatgaacccggatcaccgaaaatagggccgatacggatctaggtgggccgacacggcccaatataaggtgggctcatcatgatgaacaccgagaaagccagcgtgcatgcatgtgagcatgtaggacatctgaagcgaagaaaaacattcgtattataatttcttacagcagcaaaaaaagagaattacatcagactttacagaaaagtatcgattcaactctcttcattaattacagatcgatcgaggaaacaagcaacgcatatgcataacctctgcttcaattcgatcaaaaagaaaaaaaaaacactccgaacctctgatgaagatgaatttcattagttcacttcacaaaagggcactacatcatcacgctttacagaaagaatcaattcaactcttctcatcaaattacagatcgatcgatcgagcaatgcatatcttcatgcagctcagtgtctattcacggatcaaacaaatacctaatccatgaatctctctaactaaacctacttcgatcggattcgatcgaaagaactacactactagtgctagaggaacagccgctgacaatagagatcaatcaagaactcgtcgagccaagaatgtcgtcgagcgtttctccggcagccaggcgcgtgaagacctcgccatccatgcaaggtccgttcgccgtctggatgaactcgtctccgccgccgccgccgccgtcgacaagctccgtcgtcggagcccacggcaaaggctcgtcgttcaacagatacctcatgtattgttccgtggcggccgtgctgaacgtgctctccaggttctcgtccatcggcgccgacagcagcgcgtccaggtccaactccggcaggagctccgatgactgctcgtcgtgctcgctcccggcctcctcttgccgcggccgcgcgctgggcggcggcgcctccgggtgatccacgccgtcgtccgccttcctcttggagccggagcactttgccgccgccgtgcgcgcctccgcgcagaccgcgcgcggcgagcggtagaccttgcagagcacctgcttgtctgctccgtcagtggcgtcgtcgtcgaggccgtactcggtcatgcaccacccaagcctcgtgaagctgcgtgccgaccccgacgacgacgacgactcgtagacgccatacactacgccagatcctcacacctctgtcgggatacctgtgacgggcaaacgatttggtcactagtgaccattacctctgacgggtcagtcgagataacgtcaccggtgagccatccggccgcggaccgtcacaggtatcccctcacctgtgacgggccgaaaggaaaacccgtcagaggtataccagtgacgagttttgcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaatatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggtgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtgggacatcaagatacaaacgagcaaagagtgaaggtgaaggaagtaagtcaaagaggggaggcccagtaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcagatgacccaagaaacatgcgtttcgcaatgtgtacggacggcattaatccttttggtgatttgagcagtcgtcacagtacatggccagttctgcttgttaactataaccttcctccctggttgtgtttcaaaaaaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgagtatacggcccttggccacctttctggcaaactgggaaagggaaatgggcgcattctgagtgtatgaaggaaacaagaaacaaatggttggagcatacacaacaaaagggctacatgggtgacaggagatatattccaaggtatcacccgtataggaacttgagaaagaatgtcactggacacagagatacagcctgacccccgacagagctgacaaggacagaggtgcacaactgagtgatgggaataaccaacgagtatggaaaaaagaggaaagttggaaagcgataagagaatagcacatcgaatgagaaaacagaggagcatgtggaaaaacaaaagacaaaagagaggagcatgtggaaaaaaaagtcaatattttggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctgggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataaggacatgtcttctttcaacgagtggctgaagaaccgaattgccaggttgcagaacttgtctagtgaaacacttcagtggttgtcacagggtcctgaatggagtgccaccacctggcaaggatatgacataaatggatacacctttcacacggtaaagcaagacagcaaatgcacagtgcagaacagtgggttacgcatcgaggctgctagtgacggtggtcgtcgtgatcaatactatggtaaagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtataaggatgaaccgttcgttctcgccaaacaagttgttcaagtgttctacatagttgacccgtgtaacaagaaactacatgttgttcgtgaagggaaaaggagaattgttggattggacaacattgcagacgaggatgattacaaccagcacgtccacggcataggtcaagaaatacctctagaagaggaggaagaagaagatgaagttcaatatgcacgtgtcgaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattggaaataaaataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacatgtgacgggctctatctgtagggccgtcacaggtgacctcacctgtgacggcccagagtgttgggcccgtcacaggtggtcttacctgtgacggctccacggttggcgcccgtcacaggtgacctcacctgtgacggccacatagttggcgcccgtcacaggtgagtttgactagggttgacctaaggttggacatcttctagatcgatccagatccggcacccactctcactcactcactctctcgaccgccgcctcgcctctctctctctcgatccagaccctcctcgccgccgcctcgacctctccaccggcctcctcgccgccgtcctctctgccgccatctccgccctctccgccgccctcgccgcctccttctccaccgccgcctcctcactcactctctcgaccgccgccgtcctctccaccgccatctccaccgtcgccgcctcaacctctcctccgccctctccgccgccatctccgctgccctctctgccgccatctccgccgtcctctccaccgccatctccaccgtcgccgcctcaacctctcctcctccctttccgccgccatctccgttgccctctctgccgccatctccgccctctccgccgccgcctccaccgccgccctggccgccggtcgtcctctccgccgtccgtccatggacttccccgacctccccgaccttgacctccccgacgccgggatccccgaccaccgccggtcgtcttctccgccgccgccaccaggatccaggacgactacggcctgcgccgccgtctccaagtacgccgcttctccaagtatgccgtcaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctagattttatatacatgattttggtgcagtgaatcttagcatcaatagaggatcttagcatgaattttgctgcagtggatgttcttttctttatggataagaacagattatctacacttattgatttatatacccttgttgtctatgaatagttgaattgttgtttatatacatgatttatatacccctgctgttgctgccacataaattattgtgggctgttttattatctacacttgccccttgctgtctatgtttgcccatgctgctgcctatggttgcaactgttagttaaaacttgaatgtgtagctagtttgcaacttggatgtggatttaagtgccatttggacatataaccattcatggagtgtgtactgctatatatgttgttttgttcccttttgctagacctattgaattttgtggatcatgtttacatttagctgaaaaaggatggattgatagattggcaatagtgtttctagctaggtagggtagctagctagaaatagtttattaagctagctagttaagggttatcaaaccatcacaaaatacaaaatgcatggggaattttggtggtttggtcagtgtagtccacggacggaaccaacctacacaccaaaattttcaatgcattttgttttctataattctttgataattaaggacctttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctacacccctgctactgctgttattgtgggctacttgttaatacacctgttccttgttttatgttgttgctgcccctgtggagtatctttgcccctgcttctgctgcccaatgtgttccttgttaaatggccagtgatgaattgctcaataagaacagattatctacacttgttcatttttttgcccctacacttgttcacttgttccttattaaatggccagtgtagagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttgtgcacttgctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgttgtttatgtgaatctccccctgctgttgctgcccctgtggcatatatacccctactgctgttatatggccctgctactgctcttattgctgctattatatggccatgctgttgctactgctctaatttcctgtacttgctcttttctttatggataagaacatatgaactacacttgttctattttatggataagaacagatgaactacacttgttctattttctttgggttgctttttcctcctagtagctgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccaaaattcatggtaatttataggataaattttcaccacatgaccacataaattttagctagcaccccttagcaaatattgccttctgtttgtgctgcagaattgccgcaggaacaacatacgtcgatgtcgggcgggacaagtgcaagtaggtctagtagaaatccgcggtcacaaaatatatggccaaccacagtgcaagttataagagaggttgacgctagtggtaggcccacggcgcccaggactgtcattggaagatggtctaactgctgcgggctagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggatgaattggaagtcaaagctcttcaccgagtttgtcaacccgcccggcaatcatacgccgttcgatcaataccctcaaataaccgaagcggtgtgggaggaattctgctctctcaagaccacccaagagtttagggaatcaagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgtcgaagaggcgcgaagatgacatcctcacaaaggcgctcggaaccaaagaacatctggccgaactcggagaattagtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccatccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccattcctatcatcgcctgcctatataactataggttttgatgacctcttcgaccttttcaggatccggaagttagacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggtttcttgatccatccatggtgaatgaggttaatttacgacagagcttcactgaggtggttgactatgtcaaccggtgtttatgggcccatcaagacaaggagtacatcatgtgcgcacataaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcctatatgtggaaaagggtggtaggcacaaggagggcaagaacaaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaaccccccccccccccgctatcagaggcgaagtgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtaccattcatctgttttctccttttttttcccttattgacaggttgtggaggttcacaacgaacagaatacaagaaattttggaaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtttttcagagggcatggctagcaattcctgaggctagccaatatttatcatttattttttttctggaatcaactcatcagtgacggttcggaagaaacatccgtcacaggtaacctcacctgtgacggactcgcaaacgtcggaccgtcacaggtg

SEQ ID NO: 25721 - DNA, 19789 bp, Oryza sativa
ggccttgcgcttgctggtgtagcgcggggagcagaagaagtaccagacgctgccgctcccatgggttcccggcgccggtctgtgctcgccgacgagctccgtcggatcgtcggagtagacgtcggcgtggttgatgaggcggtgctcgaaggggatcttggcgatcttggggcggaggaagagggtgatgaggccgtcgtcggaagggcgaaaagcgtagcctggctccagagcgatctcgtcgtcgtccatggcgatcgatgagatgaactggatgaggaggtgaatcgatctggggaaggagagctgaggatgaggattgaggagtagggatcgatggaaccccttttatcgtcggcgcaacgcgcgatcgaatcgtagtcggaatccgatcgggacaagaagaactttcgcgcgcaaattaaataaccgttttttggcgggaatcaaacgagcggtcgagatggggcgtcagattgcaagatcaacgaacgacgagcgagcaaatgcgtcagacacagtacacagtacagcgaatgctctagcttcaggtgttgaaacttgtagacgcacgagtctccttgtggacacgctcacagctgcatttgtatgcaactctgacccatgtgttcatagttagctcgatcgatccgtctggaggacccattcgagggaggtcggggcatggtttagcgtatcgtttggaccggggttatcgtcaccccgcggtagcatgataaccacgataatcatctaaaatcgcacaaaaatcacatccaaaaattcgaattcaaaactcggcggttttgcagtttcaccgtgataatcgcacggtttatcgcaataaccacgatattcgcacggatatcgtgggttgtgtagctgaaatcatataaatgaaaaataaatagggaaaaaatacggttgaatatgtgtagaaaactagaaattgagaataattggaagaatatgtaggatacttaaggcccaatattgtcttcctttttccaatttgtaaaccttttcagttttgccttgaatttagcttactctattttaaaaaatttcttcaccattggcaattacaaatcaagaactatatccatgattttttttccggaatcttaaatttggtcaaaattcatccaaaccatattgccggtttctcttaccgtacccccgcggtaagcgcgataaccgcgataatcacgcgattatcgcgcgataagtgaaaccctgggtcggggattaaaaatccgactccctttcacctcttctctaatcacgctatgtattttgttgtcggcccattgagccaggtcgcgtggcggtgactaaatggaccgaatcagaggtctagccatgcagcatcgcacattcacatgatgtgcgatgctgcttggatatgcctataattcggcctcaagtctatctatgaataggttcactttaggttccttgtcttagttcgatattcgtcctcaaatcgtagaacaagatacaacacatatctcaactcataaaaccggtgtatgatatataggtcccatgattatatagcaactggtttcatcggacgtgacaattgattagagctatatatgacaatgaccatcccaccacaatattttttctcattccgagaagtgactattacccattgaaatggaacctaaccacaagagtgtccaacatatccataaccgaatacatcacctagcctgcatgcactacagaacaaagaatcaattatctccattttaaactccctaaattcagatcccaaccacgatcctcccacccactatccaatataatagctcccaaattgagcagatccaacaatgttctaactaaaaaagtactcctatgtactaaacaacaccaaaattgagagaatcatcgcatcgcataatacaaaaaagagaatagtaatggcatttctaaaccataaaatttataatggcatagatccaattaaacctaaaaaagaacaccatataccacgactacatttttttaacgactcgcataagacagtacggagtttatattgatagcagaaaaaaaaaacaatatcacaaccctggaaagattgtaactaggagaaacaaaaacaaacataccgacaccacgagttggcaactcctcacacaataccctggagaagacactattaccaagccgaccaccgctaagcgtgaccaattgccactaggccaacaaggggtttacaaacgcctcgccaaaacacctgcttaactccgaaagacaactgcttttactgtaaaagaacaccatgccacaactgtttttaatggatcaatattttctatgatcaataatagttctcgtgtcatggtgaaatcctgcttgatcagcagctgcgtcctcctccgttctccaagctgttcatcttctccaaatctctcatgaactcatcaaatgcaatctcagaagacccacctccgttgatggcatccagcgccatgtctctcgtctccaccaccctctccctgagcttcctcccttcctcggtctccatcaccagcctcaccttcgcctccacctcctccgccgccaccgccaccaacgcgccacccacctcgccgccgtcgagcgccacggcgaccttcatctcctccaccatgagcaccctgttcatcgcctgctccgcgtaaagcggccagcaaatcatcggcagcgccgacatgatcgcctccagcgtcgagttccacccgcagtgcgtcacgaacgcgccggccgcctcgtgccgcaccacctccgcctgtggcgcccagttcttgaccaccatgccgcgatgcttcgtcctctccaagaaccccgccggcagcagccgctccaggtcaggctccggcgatgtgctctgctcctccggcgggctcctcactgcccacaggaaacggtggccggagttctccagcccacgagctatgtccttcagctgcgccgccgggaacgcgcccttgctgccgaagcagaggaacacgacactctggcgcggctgcgcgtccagccacgcgaggcacgggtgtctctcgccgttcttgccggcggcggcgtcgaccagtggcccgatgcagtagaccctcggcgtgggcttgtcgggaacgcaaacgccggcggcgagcgcgttcagggccttgggctccagccgatcgaagctgttcacgagcacgcccttcgcctccgccatccgcttgaactggtacagccggaccttggtcgcgtcgctctccttgtcctgcaccgtcgccaccatgtcgacggcgcggagcggcggcatgccggggaggcggacgagcgccatgcccatctccctgaacgacggcacgtcggggtagtaatacgggaggtggagcaaggcggcgagggcgctggcaccggaggggaagaagaagtaggcggggatggcgagctcgccgcgacgtcgagcgcgtcgacgcagaacgcgtcgagcaggagggcgtcggcggcgtcgggcagcgagcggaggaactcccggagcacggggttggccaggcggagcgcgtcgagggcgcgcctggccgggtgcgcggcggcgtccgggctgggcggcgccggcaggaggcggaacgtgatggacgggttggccgcggcgaggcgcgccgtcgcgtcggccgaggtggcgtcgttgtcgggcgggtcgatcaccgcgacgacgacggcgaggccgcggcggcgcaggtgcttggccatctccaccatggggttgaggtggccgacgccaagagacgggaacaacacaaacgtctttgtcctcatggctccgatcgatcaaaagggatgcgaaaatacgggaacaaatgctcataaatatagtgagagtgagagcggcgttgaatggtaagtaaccccatttcttggcaaaaaagccatgggaagaaagtttgacacgccataaggttatataaatattgctgtaccagaaaatttttccacatgagcttttatttaagttttggaggaattaattcaaaggatttttttctcagaagtctaatctaccatcacttgagtgagtcagcagttgagtgggctggtagacgaggaaggaaggtatatcaggtagtatcaggtagctcgcgtgtcacgttacggccgttctcgtcagcaatgactagaacactttgcgagtttttatttttttttaaaaaaaaggacgcgaatagtcgggcttttttttttaaaacattgtccgagcatatacagatcgcacgcaggatgccgaatagtcggtctttttttaatggcttctactgtatccgtcctataaggctataagtgaacttttaacctctaaagttctccacggagattaaggagagagcccattttctagtagtaacatttcaatcttaagagacatcaccattcaccaatgctgcagctgaacaagcacctgtaactgtaaggcagcctgcctgtgccttcatcggttcatcacttcatctccttgcagccctctatcaacacatttagatttcacccatttttattcagaacttacaacatccccgatcgattttcaaaaatggcagtcaagttctagccattcgatgctcactgctgcctagttagcacaggaatcaggaaacatgtgcagcaatccagctgttagaggcacagcctgcgttacagcgaccgaactcaaaataacaaagacgaactggcaaagtggccatggcaactaagatatcgaagagagtattcaagttatatttttttacagcagcaaaaatgataacctccacttcacttgcgagtactccttcaaatgcaatgatgaaaaaggatgccacctgttgatctcacttcctaaaccagaaccttttctgacataagctaaagactatgcgattttcttagaagtactctcccatggagaaaccaacaatgatcaactgatgatcagaaactgtaatgatcatctgatgacaagaaactgtttcacttcttgtttttgttgtccacattcagctgctggagcccaagcaagaggtccttggaatccaggtacaccttgttgtttgagcttgccatggtgtgagagatctccctggcagcttcaatctgtcggagagcgaggaaggcagggttgttgttaatcgcctcaccaatcagctgtgcactcttagcctcaccctgttcaagcaggcctcacagtcagactcaacccacaccaacaaaaatgaaatatatgaaacaatgaagaaataaacagtgccattgatatgtcttaacaattgtcactaaaactacaggtagtaaacttatcaaggaatatggtgaaagccatctaaaccagaaataatccattgcatctttgcttacctgtgctctgatgatcgcactcctcttgtcttgttcagccttctcaacaatgaactttgcacgctcagcttcttgtgcagcaacctgcttggcttcaattgcatgagtgaactcttttccaaagctgagacttgtgatggacacatcatccagagcaatgttgaagttgctagccctctctgtcaggatcttcctaatctccctgctcacagcctgtgttggataaaggaataattattaccatatatcctactatattagctcttaaactaaatatcatactactatattagctcttaaactagcatagcataccatggaaacatattagatatttaaacacagatagatatgataagacagtacctctctctgtgtgattagttgactggcattgtactgtgcaaccaccgctttgagtgtttcatgaatgattgaaggcaaaactctctcattgaaattctcccccagggacctgtagatggttggtagcttctctggtaacggtcttgtaaggacacgaagaccaattctcacctgtccaagttatcaaattgtatcaaactaaaaatgtgttggtactgacctctaccaatgttactttgaagcaaaggtctaaaacaagaaatttgcacacaggtaccgatgagcaaaccaatttgtatggtcaataagagttctaagttgtgaagaatcggaatttaaatgcatgtcaacaaaaaaaaaagtgtactgcctccattgcaggcaaagcataacacgcattgcaatgctagtcacacacgtaaatgttggttctaaaccaatgtaccaaaccactcacattctcaaaatgctaagcacatgatgaaaatgctaagcagttcagatatacccaacaaagaagcatctcacatacaagagtcacttagcgacaagtcctagtatagggacccaaattaagtgattaagcaagcacagcaagaacattccacacaactttgctaacattcgcaaatcacaaccaacaaatcaccttctacatgctacaaatcatcatctcaacgacatgacctagtcagaaaccccaagtgcaaggacagaattttaccatctggagatcacggcttccagaagtgctctcgacgaggttggggcgggctcggacatcgtagatgatcggcctctcgaaccacgggatcatgaagtgagtcccctcagggtacacctgcaccgagcacacaaccaaccacaacaattcattcaaacgcaacccaccaaatcacaagcacacgcatagcttctctgaaacccatcggcatcacatcacaagttcactagtaggcttcgatcgatgggttaccttgtccttgatgccctcgaggcggttgaagacgatggcgcggtggcctccctcgacgttgtagaggctgttgaaggcggcgtagatggcggcgccgcccagcagccccaccttcaccagccgccccgcggcagccgccggcggcgggctcggcatcttcgcgcccttgaagttcatctcgccggaggggggacgcgctcgcggcggcggaagcgtagggttttagctagggttttgcgtgatccggcgaggaggcggcggcggcggcggcgaggagaagaggtggcggaggagaggaaatgagaaaggagaaggggtgggggtgttaaagaggacgaacaggaggaatcacagccgttggatcttgatccgacggcgaggagggggcgacggggttgggtttctttcctccactgcaagaaaggagacggtgtgctttacttcctctgcaagatgaggcgcactcccgaaatcggacggtcgtgatcgtcttttcttgcgtatgtacgaagttggtggttatttccgctggagattttgaattttatttttcaatttctttccttcttttttcttcagggagatggaaagactctgatttcatatgatttcatgtagtcacagccagtttaaaagcggattaaaagctcccttcaatcttctgaagataagattaaaagtggacatgcaaaacaagaaaaccattaatatgtgattaattgagttttaattactataaacttgaaaaatagatatatttaatattttaaaacaactttcatataaaattttttcgcaaaaaacatgtcaatttatagtttgaaaagcgtgctaacggaaactgaggtaaaatcattatctttatgagaaaagaacggggcacactttattgagagatcattctattgagaatcttctgaagatttataagaaaactgagatcctttgtgcacactttctgaatggtgaagcatgtaacataaacaaaactctgaagttgaacatatctgcacctgcatcgacagtattgaatggtgaagcactgaacataaacaaaactttctgaatgattttctttatcatcaccagaccactctgaactgaagttgaaccaagcactgttactgcacacaatcttcaaaccaaagtccaaagagaactggaggagttacacagcctggaaccctgaagcatagattccaacctcaaaccaactgcacaagcacaccaaagcacaagcctcttcttctccaacctcactcacatcacatcctgccatgaacaacaacaacaacaactctagccaaagaccttatccacactgagatgggcacatagaagccactacacctttacagagcttccctcaggaagaaaaactgcgaaaaaagaagagctagagaactaggtgcgcagcgccatgaacaaactctgccttctcgcatgctcgggaaccagacgttcgatggcttctggagggatgccatttagctctgccaatgttgcaaatgttgtatcagtttagctgaggataaattcaaagcagcaggattcattttgacattgaggcgaacaaacaattaacggaacaattctgccatttcgggaagtggaagatcgagcattggcttcagtttgttcacctaaatgctaggtaccattttgaacataattcatgaaataattctctcagctcacataaatactgtctacatgaggtgttagacgaggcagagagatttaggaatgtttaggttgatgagaatcaaatcagcaaatgctaaggttcatatgctgttatcgctgtttcattcagctatgataccttgtgttctgaagttgaagagaggaggaagaggacgcccattaggtagacgagtgtttggatctctcaactcatcaaagaaagggtgcatgcaggcttccatctggagaataattaaataggttagatgagagagaaatctaacagtataccacatcaggctgctcaggccatcataacaaccaaaatctcatgtggccttacagcggtgcaccgaagatttggtgagtattgcagaaacctgcttacaaggtccactgcttcaggtggaagccttttttggaaaacctgggtaaaaaacaaaacttttgagttacaaaaagaacagtgagaaagtattgtttaattttccaattgaacacacacataatatggacattgctcacacacgcaggacccaactaataggaatgtcgaagcgcaaatggtaacacagaaattggatttcttttccatttggtttttaatcctttttgtcttcaacaaatatttcaaaatttaacagcatagtaatttgcgttaaaagatctccctgtcccaaaagtatgtaccaaatcggacatcgatattgcattagttttgtcaaggatgggcagaataccttgtgccatggatgagccttaatttgagggaatttgaactccgtgtagttcggattcatgcacttgatctcttcccttgttggagtacccaaaacctgcaaggcgctatgactaaacatgttattgtcaagatcaatggtcacaggagagaacagtttaggacatcatagaaaaatgttaccttgataatctcgaccagctgatcaactccactttccccagggaacagaggctgcatggatgaatgttattagaataagaaattgaacaaaagcaaaatattgtatgcatgaatgaaacctgtccaagcagaagctctgccatgacacagcctgtagaccacaaatcaatggcagtagtatattcagttgcaccaaatatgagctctggtgccctgtaatatcttgagcatatgtaggagatatttggctctcctttgacctgcacattcggcggggaaaaagctgcaatttaagactatcatgtgtaggctacctgcctaagttcacatttccttgcaagaaaacccagtgtgtccattcagaaaacagaaatgcttgtgaatttaaatttctgccaaattcagaacttaccaaaacttttgcactgccaaaatcacatattttgagctggtgtgtatgtgggttaacctacagtgcgaaggaagaccttattagtaccatcaaaacttagtgaatttcagtctgtaagtacatgcatgatcacggttttaaaataaataattgaagtactaacagtttgtctgcataaatgttcctttatatgtgcagtttataccgttttaataatcttatatatgagacttaatcttaaatcctgctgttctatatgtcaaataatttggcatcatagtcctagtagtggacctagtggtagttgatgcaatccaaatatgtggagccatggatattttctctttcaataaagaacaaaaatgactatgtataaccaaagtgctcttccatcagccaatatcatcaacaagcaaaacaatataaacagtaacatacagtttgataatatgataagttgataacatgtagcattggcaccaaacaatgcacatgggatggctcagctataggaaactaaataatgcacatgtggattgcttttttcagtttcagaatgttatatcatgtatgtggaaccaaccaataattaagatatttggatacatatgaaccagaatctcagtcccaatgagcaatatactttatgctcttcagaaatatgcaacagtaaacatatgaaagctcaatggaacaaaaggagaaaataagattgcccaagttcatttatgaattatgactaatattttcagggaaatgcagatacataaaaatgcaaagctttattaccaacattatgcaccttctctacaggatatagagtttgctgtgaatatttcatatagttaaaagtagacaatgttacatatatgcaactccttcatgtaccaattagttatgttttattttccatgatccccattaatttatatttgaggatctgtacagcaaaacatattaagcatagaaaataaaggggttaaaatctcacaagaacattctgtggttttatatcacggtggcagatgccaacacagttatgtatgtaagcaagtgctcggcatatctgcaaagacaacaggaacaacgatttagatgacttagtagttaataaataatcaaattttgtcttaagatatgatatcataaagaaaaatacaactggaagcacggtttagtgcatgttgggagaatttatttcaacagctacagagagcaaacaggtgtatagaacaactcattagctagaattctaactggagtaaatagataaatctaaccattagttaagagtatataaacaattacatgcactaatgtgaaaattttcagttaaacagtaaatgatctctgctggttcctagagagtagattgaagtcacgcaatcaaatctcagaatttttttaccggccaaaatgatgtgctacttatctcatgaaaaatgttatatttcactatcatctcaaatcatatgacagaaaaattattagataagtagatagcgcttgatgtttagctagacaaacaagaagcaagctgttgaacatacatatgaagtcaggaaaattgacaagctggcttgagtagatgtttaaatgccgattctccatggaagaaatcaatctgaatcattaatccaaaacttctaaacgttccagtgcagtcctgggctacttgaagataatactcgagtggacacaaggacaacacatgactgccaccaagtttgaaccatgcttcacatgacaggttttagaacatgcaaacaaattgggagagcatgaatgcctacattacataaaaattatggcactcagtgctcccttgcagatggttgaacatggtccattgatattttacaggaaaaaaatatgcatcaactattgataagctctagtgtggcatgcatgcccgaaggcactggataacccagctgaaaaattaagaactttgcaaatgtgcccccttgttcctcgaaaataagataaccaaaaatagattatgaccggacatccaaagagtttattctcttgaatctatagaagcaatcggtttggaatggggcatgagatggaaaattatattatttcctaaaggttactggtccaatgcaaaggcgagtcactcagaaaaatagacaacaaatcagggctgacctgataagtgtataatttgacataaatgaggggcacccgttgattcattctgctgtactgtctcgcaattcggtttactgtctctggaacatactcaaggacaagattgaggtaaagttcatccctttcagtggttgagaagaagtaatgcttaagaccaacaatattaggatgatccagcatatgcataatttgcaattccctgttcttgtaacgtttatcttgaagaacctttttaatggcaacaatttctcctgtttctcgacatttggcctaagagttgacacgaacaggttatttgcctttcacagtcacatagagaaatttttacaatgaaaaagccacaggcttacctgatatacaaccccaaaagaaccagttccgaccacatgctcagcaatataagtgacagactgttccattaccataaccactttatcagcattgtttcatggccaaacatcacaaattgcaaggatgaaagcgaaactatttttacctgtttaggtagaccatttcggccacggatcgtagtagctattatgtgaccagcttcagcgctagagccgtcgactacatctcgttcagtgttctgcaaatgaattgttggtaaaccaaagtgcagtcttggttcatatttccgtaggctttctgtgaatattcatgagccgtagaagtatgaagcagtgtcataaaaccatgcttttctagggtggacaacatgtcaaatttgcagagtagcaaattacagacaaattttttgaagttatgcagtgattatttactactttctcagaaaggcacagtggctcattgctacaggaggtgaacaaaataacaggaaccacagaaacaagagtttgattctggtgacaggtgactcttcatcctacatcaacactagttcactcagtgacaaacaaacacgaacagaaacctaccttttcatcaccaacatctggtttggaatccctcaattgcatttccagcatctcccttcctagacattcaaccgaactagccgggcccttgaatccatgtcccggccgagaggagctcccaacgccgccatgccttagtccagaataggccatcccccactacccgagattccccaggtcaggacaagaaaaacagaccagtattcactccattgcttgcagaagatcagcccgccattgcaatgccgtttcctccagcatcacttcagcaacagctgcatacacattccataaaaatgtgtcaagatcgagatgaaccttctatggcatagtaggaaatttttcttgtaaaagttgcttcatcaatttataactgatgaagaacatccaaaaaatcttcaggaagtaagtacactgcactcaagtacgaaacacataattcgtctgttagtacactactccaaaaggcatccggatttccagccacacagcgatcaagaagggccactaaataatcatcaagaaaaaccgcaaaacttgcactaaatcccgaacagatcaatctcaaaaatggcccaaagatcctccgaaaataaaccgtgcgatccatcccaaatcctataactcgataattgggtccaaaccgccgcaaaccgggtccgaaggagcattaaaaaacgacccttttttttctctctggtgggatcaaagaatctggagccacagtacctggagccaaaatcccacagagatgaaagaaaaattcttggagcaagcagatcaacaggctccagtgctcttggaataattatgggcgagcagggaatcggaagaggatgagatgagatggtttggggctctctctggtgtggagcaagtaggttaggtagggggggagagtggagtgaggtagtggagggcagctgctcttctccttccaaacttttccttttctggtaaaaaagaataggcaagggcatggaggagcagagagaaatttatggaggtgatgccatggatggaatggaaggatgggggagatgaggggggagaagcaaacaaaaaattgggttgtgagctgtggatgtgaagtgacatttgatttgaggggtttttggtgtttggctgcagtcaatttggcagtgaacatacttggattgattgacaggagtgttgacttgggagtgaactttttttgaattgtgattttgcaaggattttcattcttggggtagtgcaatttgtaattgtttaaacagatggaatcatgccaaattgccaatgttgcaattacaacaggcatcgacttttaggtgaaaataaaacattagagttaagctctgcttttaatattatggatttccgttgcttttcaaacttatataaacagtgtgtttagtaccaaaaaacctatggaggacttttctaaagtagcatttcaacttcatggcagtagtttattcattcgtaaaggctataaaaaattagataaactaccaattgatgagctatgataaaaattaaattaatatatcaatccatcattttcagctatcccagattgggcaatgttgctaaagttcagattttgccgaacaagattcagctcccttgtggttaagtgcggcttccgtcgtagcaaggcatccattcttctcttccaagcccttcctaactttttcttcgaactttcatcttttccatcacatcaaaactttcctatacacataaactttcaattttttttctttaaactttcaattttagtcaaacttttaattttagcgtagaactaaacacaccctaaccgcaaatccaactcatggagtcatgttcatctccccataccagaaaagaaatcgacaaaagcctgcatgtgccacagaactttcggtagaacgatacaacatgcatggttcgcctcaggagaccaacttgtcagcagctgcattaacaatgcgggaaaaaacaaacttcatgtagccctgcgtgtgttatcaagttcatcgttcatcagaactatggagtgtacaggatcatgcaggttttttctttaagaaaaacttctgtacataaccgtggttctcatgtactagttgtaaacgacaatcgggtcacagaaaataactcaaaattatccaatgtaaaattcctgcttatccatatgtttcttgtagtatctactgtatgttgtaatgtagtcatatactgttatccacagatctgcctgcctacctgcaaccagagagacttgatgtaatacaggaaaacaagagaaacatataacagaggcagtcacatggctatgcccgaatgaatagaaacaagaaacaagtggtagtaacaaacaggagaacccgaaaggtccaccgagatagctgttctgttcatgctcatcatgctaagagaccagggtcccgtcattcgttgaccaggtcatgggcctcacaggcggctatcacttcagtttgcatatgctactgtaaagtgctcatgtgtgctgtgagatgtggctacatcactattcaaagggggtcatctgttagctgtacctctgcatgtggggaggatgaacttagcttttaatcttcatagattaatattgatctctgtcaaaagctccacacagtagtattcttgcaaaacaaagtcatttgttccaatttcagtagccaaaatttgttccagtttccagattcttcaaaatgaaacggttatgtgaaaggaagtagatactgacctgcacgtctgcatgtcaaattccaacagcatcaagaagctctgaatgttgtgacacggagactagcgtgtttgcgacaattgcaccacttgcagcgacggccggtacaccgatgcctggaaaagtcgagtcaccacagcagaatagctggggtataggtgttgcctgcccagggaaagtggcctccccagcttttatggctggaccataggttcctctatttcttcggaggaacctcttgtgtgttaatggtgatccaaccagcttcacatcgcatttttctctgctaaatcttggaccaagggcaagctccacggctttccacatcacctgagaggtttaaattaacttatcatagaatacagcaagtttctatttacaatcagtgaataaaagagtactttataaaaagtgtgtctagcttcgataactttttacttaacttttgatcatatttgcttcctatgagtcaagaaaattgcttccttaaaattctaacatgtagtagattattgttctagcctctggagtctagacggctacacaagccacccatgtttgcacgtgtggaaaagaagggtaaagagatgaaatttctaggaaatatctgaactgataaaacggtgttaaagcgcatggatttctagggactaattcccagttatcaggggagtaacgctagaagaacaagagcacagcatttgttctatgttgtacctcagagcgttcttctttcagccttcgatactcggcgcttttcctatctagtccttcccacaaactgaaaggttctgttcctggtgtataagcatgtaggacgtgctttccaggcggtgctaagccatttccaagaacagtaggaactgatatcaatacaacgttctggtcagcatcaactcctttgttccaatcattaaccacaatatgatggattccaaggtcctctctggcattctgttccagttacgtaagtagttaccgtgagagattgcctgagttaatgtaaaaacacacatcttaatgaatatgagtgtatgacaaccaacctcgacatcaaaacccaagtggagatgcataaatgattcacattgtggagttgctttcactttgtcttgatatgatcttgggacagcatctggtggcagcaaatccaaagtatcccacatagatgcattgctaacaactgctttccttgcgcgcacaatctgcatgagaagcaaattcccgacaagatttcaacagctgctgaatcttcaaaacataggttgcatgatggaagtcaatacaagggaataggttactatctagtgacctagaataacatgtggcacaatcatgcctctcaaaaatagattgcataagacaacagggcgagaaaagatatgccatcttggcctacatgatttctatggtctgccactactgcaaatgggtggaccaaggcctaaagcccctaaactaaatgtgatatgcagtactgaagatggtactttttggagggagggagggaaaatatatagtgattatcgtggattgtacactaaagactttgatgcatccatgaggctcaaggtaatgtaagtatcatatttgatgaaatcattaccaatagtaataatatggatctgcattgctatcattggttttgtgttcataacttgtatcacacaaatcctttcctactaggtaacagtttgttttttgtttggtaataacatatccttagaagatgcttacttgtccactttgtagcttgacaccaactgctcgaccattctcaattaaaatcttttcaacatgcgaacgaagagcaagcctgccaccaaatttttttattcctcgcacaagagcatctattattgctccgcttccctcaagaggatactcaagcgagcatcctggtttataccattctgcaaacatataaacctgtggttgtagttagaccaaatgatgaaacagaaaacatcataatcatcacttttaaagtatttgtgtgaatttgaatagacacaacagatgggagctaagtatcatagaggtaaatatatggaaaactctgcactgtaacttattcagaatcgcattgttttttgatgcaatgaatcgcattgctcagtgccaaatatttcgacatccagttgctgtggagcactccaacaagataaaagtgctaagattcaggtataagtcactgccatccaccaatgggaatgcatgccatcaacctatacaatttagatccactataaatacaatcactaccatgtagactgcattgactggtttagggtcacatgagagtgactacggaatagtatagattctgaaatagtatctgctaaataaactagatgtagaatatgctacattgaggttgttccaagttcagatgacatgagaacgtgtaacaccagcacagctattttatggaaagaagaggaacattgcaccgatgtaatactaatcccatgatgtcctcaccattagggtcaatgcacccacaaatatattgatagaagttgtgcaacaaaattattctcttattcatctatatattgccataatggtattggtcggtttcaacagtgaactaaatgttgtttctggaaaccagttggaaatggtaattcactaaattatggcaaagcaaaaggtactgaaattaaaggaaaacacaaatggaaggataatgaattcaatgttaggcaaagcaacagctactgcaaatggaagtaaacctgatggaaattagtttaccatttctgcagaaagagcaccatcagatttgactccagcaagtagaaaacacaagagatcgatccaattacgaacaaaggggtttttcaggcccaatgaatcaacgatctctgagaaaggtcttagaagttttgtagcaccaagagccccttgaggtcccatttgcaggattgatttcaacagagaaggagcatatctaccagcagatgtggagagaacacctaaatcacctcgaatggaaagtggaggcaaagccattgcagctgcagagataggaataactgcatcctgagattgttttagtatggtattagctcatgctctagtggaacataaaatgtcccaaagataaaaaaaataagaaatgatcctggaaaagaaactagtatcatatcatattcaagtacggtgcttttacattttttacaaaatatgcctataaaaggatagcacaggaaaggaaagcattaataatttatggattgctcatgtgttgcttagtactccagttcagtgagtagtgagttcatctacacgactatggctgcaaaagtattttccaaagagtcacaatgcagacaaaagaaactcacaagaagctttttccactcctggactgcatcagcaccaacaaattcatcaaggtcctgaaagaattgcgagtcagaatcgtgttcagagcatccaacataaataaattgttagcatcaaaactgcataaatgggagagaacatctctaagttcaataaccagccataccatttgagaagaaataacatatctgagtgagaactgataatgtcacaggtaaagttaagtgaatggttccaacgattacatatctaatggcaaaagactgctcaccttgaggaaatcagttggacctatccgcgaaaggaactggccttcaggtacataaaccatccaggaatcatatgaggcacatggaactgattcgcctagcgcatcaaggacctgaccaattgaatgaccacatcagcttccaagctctcaccacaattaacttgctctaaacccacaatgccataatgggaagaacaatttgctgcaatcaagtatcacctgggcgaggggattggcctgggggcctctggactggaagccggagaacagggaagggcccgagtcgaagttgaagcccttgatgtcaaacgagtgcgcggcgcctccggggcggtcatggctctcgagcacgagcacgtcctggttatacctcgccaggagccccgcgcagcacagcccgccgatcccgctcccgatgacgacgacgtccgcctccggcctctccgcctccctgaccccgattcagaacgcaaaaccggctatgcctatgagcatcgatcaatcgccggagagtagtggtgcggtgcgaaacgtacccggagagcgcgccgtcctcgccctcggggatggaggggtccccggggcgct

SEQ ID NO: 25722 - DNA, 7660 bp, Oryza sativa
atctctcccgtgagacatggagaagatgggaagcgaggcccatacggcccaacccaatggcccattatgggcttactgggaagcccattttaaagcgttcttcttcctctcctcggcccgcgcgcgcttctcttcctctctgctacctcttccggccgaaagctaagaaaccaaaaacgtacgcggcgagcttccaagaaaggcaagaacacaagaatctgcgaaatatatggatcaattaagtgaaaagaaggtgcctgaaaatctccaaacttaatttcgatcgattttcatggccattaggaaagtgaggaaaaaaaaacacggcctaataggtacggtactcagtcggtttcagaataagtaaacattatttttggaacctttttttttttgcggggaagagctgggaattactattgctcaaccgacaagtccttacaaactagctgagaaataagattacatgtgtcgcctacccaaaggaaagaaagcctatcagtgcgagctatgtctgctaaagcatggctaatctggttttgagatctgtggaccttcctgatgatgaaatccctctctccatcaatcaacactttaatatgtctaacaatgaaagcaagggaagagcggtccggttccttggtctgcatcaactgggccgccgtcaaacaatccgtctccacttcaataggaagctcatcgtccattgcatcgccaggctgattccttccacacatgctagaagctccgattctaacgcatcggagcacccttatttatatgtctctcgcctctcccttgacttgaggcggaggatcgaggattactggcatcgtcgtcttccttcgttccctccacacaagagaagaccaggcaagtcctcttaatttaccttcttcataccctaacatacatatctcagtttcttctaccggctctcggtgacctcctttggtctgtgtcctccctcctgttcgttcggctgccaatccacatggattaagttagtctgaataagctcgtttcttagctcaactatgcatggactgctaccctcaaactgtttcaccctcacctatccaagtttattttgtagtacacagctagcctgtttattacttatgttttctccaaccgtatgtacgtatgtacgttagggtcaagcaagcaccatcaaccttgacataaagccactaacgtctcttctgtagtactccctatgcattttattttaatgtatgacgtcgttgatttttcaaccaacgcttgaccattcattttattcaaattttttgtgcaaatatgaaaatatttatgtcatgcttaaagaatatttgatgacaaatcaagtcacaataaaatcaatgataattacataatttttttgaatgagacgaataatcaaatgttagacaaaaagtcaacgacgtcatacattaaaatattaaaatatagaggtagtagtaatatataacctcttatgaattggatttacaatgttacttttgattctgcttcagttaacgaaaagacgcggaaaattaagaggacgtctgctacgtactcatctcacaagaagctacaatactaaatattttgcttcagtcatggaatacagcaacatagctaagaagagggagggtgttattgttaagatcgtgacatgatacaaagccccaggagtagagacaagtaataagtcattgacctcaacttcatttgttatcctcttttctgccatatcttcttgtacatgctactatatttgatgactaacacccgtgttctatggcgttttaacttatgtctgggctctaatcaagataatctcaaccaaccacgaaatttgtctaagagcgttgtctcacttgctttgtatgatggtgagtatgctgctatagttacccaatttataatttaacaacaattaatatattacccccagttataaattaatgctttaacttgctgtcttgtgtaacaattaatatatgctttgtaatggaatctgtttttaaggttcttactggtggtgtgagagattagctttttatatttgaacattctagttttgagttaacttatcatatttagtattaattgtatttcattgccgaccactccttgtgcagcaccaggacaaaggtgtgggaatgactatctaaccgaaaagaattatcccaagccaccactaaacatattatatggtgagttatttgatgatattctaccagtaaacacctttttacagttctgttttatcactaactattctaccatgcaccttctaccagatggcatgattttggctaattcttttgaagagacttttggccatctatatggtcaaggttcctggtgtgaattcacatcagaaagctttcctaacaacattcgtcgtagtgttgttgcacttacttcatggagtggtgattttacactaattaatgttttattgattgtactatttcatttttgtatattttgcaatcactaataagatataataatcaacagtatgcatggtatgcaggagggaggaggcattttgcctgcacgggtttttttattgaatggacgaacggatacagaattattctcacatcagcgagcttggttagagagtctgatgatggatggtagattgctaaaaacttggctgtaggtgctagagctcatcataatttttattctcctatacttcctccgtcccataatataaaggattttgactttttacttgcactgtttgatcactcgtcttattcataaaaaaaatgtgcaaatataaaaaacgaaaagttgtgcttaaaatactttagataataaagtaagtcacaaataaaataaataataattctaatttttttaataagacgaatggtaaataaaacaaataaaaagttaaaatcttatattatagaacggatggagtatatcgctagcttctctttcaattctcacacactttatcattactttgcagatacaggtgttgcttccaaacagtacatgcgatgtagggtatttacaacattatagcttacactacaatgttgctctagtcagtacccatcacagttggaatgctcctccagtatgtactcggcttgaccagcacaattgtactccctccgtctcaaaaaaagtcaaaccttgggtttccgtgtccaactttaactatccgtcttatatgaaattttttttataattcgtatttttattattgttagatgataaaacatgattaatattttatacatgacttgtctttttaatttttttcgtaattttttcaaataagatgaatggtcaaatattggacacgaaaaccagggtttgtcttttttttttggaacggagggagtagttgggtagcagctataggatatttcttcgattcaggcaaattaatgtttgaaagtggacatttggttccctggaccggcacacttgattgccgcttccttttacgttcgtgttgcagaatcactaaggtacatatatactgctggctagctctgtcaatttttaatttctcacctatttgatttacatggtggaaatgaatatattagttgcatgtaacttatcccatctgtttgtgatgacaaatgacaacttaattacttgcccatgtcatgttggcagggtgggattggagggcctcttgttgatttggacgggaatgttttgggcatgaacttctatgataagaagataggaaccccttacttgcgatggcatgtgattagtaagattctgggacacttaataacagaagcaagtagattcatttctctttttttttggttattcaagtgctgctcatctgaagtcttcatgtttttttttaaaaaaaaatacttggttgtatgatttgctgtaaattaaatatattcaatggtgtgtttggcagcagctctgctgaagttgacttcggtagttaccctagaggggccactcccatgctacgcaggttagtttaatgatacatcacaaaactagtaaattacgacgcctcacaaaaaatttcttatcacgttgcatatattgaactacaggagtatatctacctggctggaatggaggtgacaatgccaacctaaacagggtttttgatcagactgcatgtacttcaaaatattgtttcgtgcttccccaatctccacctgttgcgcctgactggacaatcgaaacaggtaacagtgtcacgctaaacaggttagttttatgatacaattaatactagtgagtattacaaaatgtctcccaaaattaattttgtaatcacattgcatatacattgaactgtaggtggcccgtgcccctgccatattggcgtcaacctgacgatatggaggaggaagaacccccacgtggctttgaggacatgtacacatacgtggacggagtcagattgtgtaacttttagaatcatcatgtccttgttctgctctgttgaatttcttcctccttccgatgtgttcgctggtgtgacttgtgccatgtcattgaagttaattatacaactatgcccgctgttagtcctgtaatattattacatatgctgtgtgcacttgtgttttagaccattcagctatagtggtgttggaacttggaaggtatatgagtatataagtagcttttgttaactttggagtacataaatagcgtgcctatcttggatgtgttaaaaaaaaaccctaaagtattttgcagtacggaaagtgctgaattttcaagttggacatgtttgagtttgaatttgctgtatatgttgggtgattttttttcttaaaaatcacatgattttttaaccttgatagttttgccttagattttattttggggtaattgcatatttgccactgccggaacggtgaatttaccattataaaaactataattgcacatttaccataaaaacagtcagaacttagcatacctaccattagactcacagtttgaaccaacacggttagcaatgtgtattttaactaaaataggacaatagtaccccttccaacgaaatcgcagaagtcaatcaaaaatacgcgatcaaaactggtcgcgagactgtgtggcacttcgccggccattctccttccgcggcagccgctctctcccgtgagccatggagaagacgggaaacgaggcccataaggcccaacccaatggcttattatgggcttactgggaagcccattttaaagcgttcttcttcttctccccgcgcgcgcttcccttcgtctccacccgaaagccaagaaaccaagaacgcaagaaatcaagaacctgcgacatggatcaagaattccatttcgaccctttcaccggcggcgacttcgactaccccgacggcgagtctttctccggcggtgccgcaagcggcgggtttgactaccccggatcctgcggccgctcttcttccgccggcgaggaacttcacggccatccataccgcgacggctattctttctccggcggcgccgcaagcgacgaatgccacttcttgggcaggagcggcttcccttcttcaggcggtgagcgacttctcgttcaccggcatccagaccgctaccgctgcggcgagcctttctccggcggttacgcaagaggccacggcgacttgttgggatggagcagctgccattcttcctgcagccaacttctgcaagaccctgcaaccatcgtcatcgtcatcaatgacggtgctcatgcccatggcggcggattagcacaggctgggcaagcctcctccatgagcgttccattggtacggctacttctcctgcttctgatcaacgttctgtgctgcttctgatctcgttcatggcggattgccgcattttttttcccgatcatgatgttctacatttgcataacatttttgtgcacgataactctcttcttctaatcaatattactccatttggtctaattaaatatgcctaatcatgctgttcgatttacttaattaaggagctgataagaaaactcggtctttgtctgttgaaataagagtaaactggcatacgttgtgttgcgtgtatgggtacaaatgtttaaaaagacatcgtagttatcagtgttaactgggaaacatacatacatatacatattagtattttaacaagtttcaaatatgaatcattttgtgatatgggtagcattgtggttaattatgaatcatgctgaatatataatgttattcttattttgtaaatgttacttaatctaaattatgataatgggacaggtaaaatcaaaacaaggaacatcactggtgccacagctcaagcttggtccatcagctgccccaaacttattacactggctcatggagcacatcttatgggatgcattagaattctccatcagttggaccacactacgacggcatcaaccaaaactcccgagtgaatggagttggtggatggcaatgggttcaccgttcattcagatagatggttagttactgtccatatcctctaatttagaaattttgatgaactgctgaacaaaacaaacgtgtgttgattctactgatcttgttacaggaatatgctctatagctgccagttttatgtgtgtggaagcacaacataggctagcctttgagatcctacatggaattggtaggttccccttaaaagcaaagagactcaagggtgtaaagaagaaatgcataaacaaaaaggtgtggagccctgcagacggagcatttgtagaggatgtgctgaaggtggtggcgaagggaaggggagtgagacaatacagggtatcttcttaccaataaatggatatcatatgtacaaaaatgtccagaaagacgtcagtcatgaggcagcagtgcgtctcttactcgcccatggtccactgctggcaacattgtgggtgaatgacgagtacatgatctgcacaacaaagaatgatcttgtctaccgtgggagcagcaacagtgaaaaggatcccaatcatacggtggtctgcttcgcttatcggtttgttggcgaggaattacacctcagggtcctcgacgaccataccgaagatgggccagtgagatgggtattgtacgagtgcatagatgaaatccacctgttgacactaaaggaacctttgaccaaagaactcatcgacagatacagaaagaagggacagactgagagcttcttgtcaaactctgcaaacaaagtaaaggccatgctgattcgaagactaatgactaagtactcagaattagagagcagtcagggatctagcagttgtggtaggcagagttgggaaaaatagtcaaacttgttcaggtatacacattgaacaacagatcaaggagctccatggctaggcccggaggttgaggctttgttgtattgaactcggaagcaaagtacatgagttacattgcctcaagagtagttctgacagccacggttatgcacttattcacttcaaacataatatagtgaacttaacaagttttcagatattagcacacaaactatttgaactaatgtgacctctgctcagcctctgttatacacaaccacagaaaaaaggatttctataaaaagaacctttaaaaaaatggcactgtgatgaaactgtagcaattaatcatggtgcaagcagatttattgctttcccatcactt

SEQ ID NO: 25723 - DNA, 12216 bp, Oryza sativa
agaacagggcaacagctattaacattacaatccatcatactattctagttacagcaatcaattggtgaatatgaggacaaaggattcagacaatcccatcacagatgaaagggaaagagtggaaaggaaccttcaggtgcaatattattcagaaaataaaaaagtatttttattggaggaaagcaaccaacagcatataaagggaactataaggttgaaaatcctatgcagcccatggatgttaaactgtcgtgcatatacttgcagttaaatatggcgctagggatcgttcacatattagaacatgcatatttgtagccatatatgtatgtgcacatcctggttaatcattctggtattagaccaaaaaagaagaagagagaaactgcgctgaggttgagcatccgaggttttttttggtctggacaagagttggtactgactcaatgaatgtacaagtgtacaaagtatcatcaatatgccaatatgaaacaaataccacgcaaagattatgtgatttcgcagcttgataccttgagtgatgtgagcatggatggattgagcgtttggccatttgccactctctcaatgcgtgagcttccaacaatcactccaacggcccaggggctgcagatcttcacaacatcacacccagcaaattgcgacaaagtgtttctattagtgtaatgcttaaaattggaatgctggaaaaaaacgaggaaaaaataatcaatgaataggaatcatggatcaaaccggaacaagaactgaagcgtgaatcgacgtttcgccctccctccgagtcaccgctgtcccgcctgactccccacgccggatctgaccggccgacggctaccacctgagccagatctgtgcaggcaacgtcggccctcgcgcgaaacctggctgccaagcctttctctctataagacctggccggccgacgaccgggaaccgctgcgctttccgccgccgccgccgccgccggagctcgtggtcggcctctcgagctcatcgtgtgaggcgaacagtgtgcgaggtgagcaagtgagccgcacggcccattatgaccaatggcccaacagatagtgggccaagaaggtggctatcagaacagcccaaatacggcagaaggaaatccgcttctcttttttttttttttgagaaggtggaaatccgctataggtacggttttcctagtacgtctcggattggtttcgcaatcgcattgtccgtccggtccctatatattcagtagatccccggcatcgaaagcgtactagaccattagtagcttgtttgtcgatcaatgggttctcttgtgtctcggttgatggcgacttgtgtacaagaggaaaaagaactagaggagaaagaagaagaagaagtagaagaagaagacgaaaatgaagaagaagaagaggaggaggaggaggatcctcagccttatgtgcctagccgcccgcttccatccgaagagtaagtacactagtacgactgatttgattatatcggggtatgtatccctaaactgttaaaaaaaattgtatttgacggcaaatccccgtgcattaatttacagggtgcgcgacggctattccattcgcgaggcccacgccgctcttgactactacaatgccaatcatacggtaattaagtgtatatgaatttactactagtatttaatgtttatgaatcacttgcttaattatatagatgaaaagtgaattgatatattattgatctttcgctacgtaattatttagatgtgtgtctgatcgatatgatttattttataattaatttcagggagcggagtatgaactcgtcaagccattgatggcggcctgcgttttcttcaagcgtcgcatgtggtaccacgttagcttgttggcgcgcaggaaggatcagaccactgcaccacccatcgaatacttcttcgccgagctacgcgagggcgcatccgactccttcatcgttgaagcatgcaccatgatcggtaagctttccgtgtgttaatttctttctaataacaatgcttaataatttgatgaatgtctccatcaatcaatgtgtctaagaaaatcggccaatcatcctaaattcctaattcagcttaattgatatgttttctctctgtcagaaaatccgcaaagctgctccgggaacaagtgttcactttgccctactcgctatgagatcgtgcaccctagcgaagaggagcttttgtgtggaaaggaaggagatgtcaaggactttctgcggttgaggaatttgtccccgttgccgttcacatgccccgtcacagtgcctgaaattgaaattgtggttgaaaaatagtaactactagcaaattagcaactgctcgcaaacattcttagcgacctgtttatttgcacatctgacagctggacacgatcgatacatagatcggtgtatcatgagggtgccccggctttgtggttaatctcgggcatgtagtggcctctatgatgccctttgtaatattaaaacttattttttctctcctcataagctattaacacgtcaggcaaagttctttgatatcttttcaaaaaggaatatatcaattcaaattcaggtatcatcaaacaaattctaatcgtagctgtgcttaggtgtgcccctcttcttagtaacaattcctctttttattttagctttaagatacaagtgagacgatccattaatccacctacagattgaataaatggatttgcgggtccacccacttactcccttatttgcccatctgttttgggtacgtgtctgctctccttaaaacttatttcttgtcatgctctaaaaatctttaataacccacaagtcagtacaactgtttacagtgcataagaacagctcgcaggcattcgaaagttaaaacttaaaaatgttgtgacaactcggcgattactcacagaaatctcaacatatgagctagtactagaaaacaatccatgggcgattgctaatcaggtagtgtatatcgaaaaatatatatgattcgttatacgtgttttgatataatcaatgctctaaatctccggagatttagaacactggatataatacagtacaaatgaattgcaccaatgatgaattagtagagtacagaacccctacatgaatcttgcagccgctcacgtgtgtcgggcggcggcgcagatgccagataaagggatgcctgaactcgccatccgtccccctctggctcaattgctggtgcgtatggcggtgagcccggccggcgtgtgcgtcctcccaatggtcgacgcctcgacgggtagcctagccgctgcacctcaagctagctgatcctcttgctcggcagaggcagacgtggaggaacacgctgaccccggagcgacgcacgcagcgatgatcatcgatcaagtgctagctagctgatcctcgtcggcggccacgcttcgccgtcgtttccttgaggctgtgctggtggtcgcgggaagccatgcggcggattcccatctcgatcggagcctccaactccaagttccaacacctggatcgaagccagccgccgacgcagagacgcagtcctggctggaggagataacgagagaggaggtcagagagagagaggagaataaatagctttgatgtaaaaaggtgggacccacatgtaagtcgtaggtcgagatgtatacacgaatcaaggaacataatcaaacggtggggaagcacttcttctcacgaatctccaagcatcccaaccctgtttaaagctgcttgtttccctcctcttcttcttcttcctccttccgccccttcctcctcgtctctgttttctccatcctcccgtcaacctccgcctcgtctcgtcacctcccaggatcggaggatccccacctcggcaatcgagaaagaacacgacggtgaagcaggcacctccgttccagcccatcgcgccaccggcgttgagttcttgcccccgcctgcatcttcccgtcaacctccgcctcgtcgcctcccagggccaggatcccacctccggaaccaagaaagggcacgagggtgaggcgggcgccaccggcgttgaggtattgttgctgctcgtctcccgccggcgaaccttgtgacgattccccggccggtgaattcaagaagccaagaacttgaccaagaaacacctgatgcgatggaccgggttcacggcaaggatggcgcagaggaagctcccgctggcgcttcacatcattcctcctgctactgctccttctcctcctcgtctccgacttctagcgacgatcgtccaggcgtgagagccatcccctgctccagccatcatgacgagagagaaattgcagaagcagactgctgcgctggggccggcgccggtgtacatctctccggctgctcgtcttcgccggaaaacgctcttgcccacggctacattagctggaagcttgactttcctcccgtcctcatccttgtggcctcctgccccagcgatcatgttgggttttccggcgagcagcccatccagggagcaagaatacaagtagccccgagagacacggcaagctgtgccatttcctctggcgaagaccatcccagcttcatcatgacagtcatcagcgagtctgctgagttccaatctggccatcccagacgagaggtaattccctaacccttgtcagaataatctcttaaaaagccatcccagaaaccatcatgttgccttgcaaatataagttagaagaaatatgaatagcgtcactatttctgagaagaaaatgtatactgacctcttaggaagtactatcatgtctctgaataataattcgttgattatgtatagcaccccaaaatccaattgccttagccattactttccatgtttatttcccactgtgaataaaccatatcacaatcgatgcattgcgtttatccttgaatattttatgaaataaaaacgaacatcaaattaggacgctaaattatgtgccaatgataactaatttactgaaacaaatggatattgcaggatttggaaaggaatttatattcagaaaatgatgaactgttcgactcaatttgcaatagactatagtatgacataaagaatgggcgtgaaaatcaataattagcagactgtatacagtgatacagattagttcataggcactgaaagttggtatgccttttaactaacctgtatcactgcatgtactggtacaacaaagattagccagaccaaagaaatagataaaatacctgtgtggattccagatgcgatgataagggatggatcttcatatgtgcaaataattttgccagattctatatcaaaattactcctttatcagcaaagagcctcatgtggtgtcttggacatatcatgaaaaatgtgcatgccactctattccaaaaaaaaaaaaaactgcaaattagagctaccatcgagtcaaatgcaatccagagatgcattttacctacacctggcttgagcaccaccaataactaagcacttaatcagttaatccggatcagaagcactgcaccgtcaagaatttgatgcattacagccttcttttagaatttcctctgcaggcacaatagttaaaagtttttgttaccatactgaagaaacatgttgcaaaaagtttttttcaccactatgatgccattttgtgatatgtgtagcattgtggttatttataaatcatgctaaatctacaatgatattcttactttgtaaatcttacttaatctaaattatggtaatgggacaggtaaaagcaaaacaaggaacgccacagctcaagcttggttttaatgattgtgatgaaaatttagctgccccaaacttattacacttgctcatggacaacatcctaagggatgtattggaattctccatcagttgggtcacactacgacggtatcaaccaaaacttccgagtgaatggagttggtggatggcaatgggttcactgttcattcagatagatggttggttactgtccatatcctctcattaaaaaattttgataaccgctgaacaaaacaaatgtatgttgactctattggttactgatcttgttacaggaatatgctctatagctgccagtgttatgtgtgtggaagcacaacataggctagcctttgagatcctacatggaattggtaggttccccttaaaagcaaagagactcaagggtgtaaagaagaaatgcataaacaaaaaaggtgtggagccctgcagacggagcatttgtagaggatgtgctgaaggtggtggcgaagggaaggggagtggagacaatacagggtatcttcttaccaataaatggatatcatatgtacaaaaatgtccagaaagacgtcagtcatgaggcagcaggtgcttctcttacttgcccatggtccactgctggcaacattgtgggtgaatgacgagtacatgatctgcacaacaaagaatgatcttgtctaccgtgggagcagcaacagggaaaaggatcccaatcatacggtggtctgcttcgcttatcggtttgttggcgaggaattacgagtgcatagatgaaatccacctgttgacactaaaggaacctttaaccaaagaactcatcgacagatacagaaagaagggacagactgagagcttcttgtcaaactctgcaaacaaagtaaaggccatgctgattcgaagactaatgactaagtactcagaattagagagcagtcagggatctagcagttgtggtaggcagagttgggaaaaatagtcaaacttgttcaggtatacacattgaacaacggatcttgtattgaactcggaagcaaagtacatgagttacattgcctcaagagtagttctgaaagccacggttatgcacttatttgtcgttcagtctcttccagatgaaacttagttttattattattatttcttttgtgttgtttccacgatcaagttgttctgcttctttttattctctggactctttatagatttctcctttacccatatgctggaccattcacttcaaacataatatagtgaacttaacaagttttcagatattagcacacaaactatttgaactaacgtgacctctgctcagcctctgttatacacaaccacagaaaaaaggatttctataaaaagaacctttaaaaaaaatggctctgtaatgaaactgtagcaactaatcatggtgcaagcagatttattgctttcccatcacttaattcagaaacacttgctattctgaacatattacagtatataacaacataactatttgtatgttctataggttgattttccatcttggtggtatttatatatattgaaagaaaacaccatatgtttatagtacacgcaacataatcgatttaatgtgatacgcacctcttgttgcagcaagatcatccttcctaccttccaattatatcaccaatccaggtagttaggtactgtctttaactctttataactaatctgaaaattcaaaaatcaggtcaagtgtttttttaaatcaccaccagaagcaaaagatatgttatatgttcaatcagaacagggcaacagctattaacattacaatccatcatactattctagttacagcaatcaattggtgaatatgaggacaaaggattcagacaatcccatcacagatgaaagggaaagagtggaaaggaaccttcaggtgcaatattattcagaaaataaaaatgtacttttattggaggaaagcaaccaacagcatataaagggaactataaggtggaaaatctatgcagcccatggatgttaaactgtcgtgcatatactttttttgccgggttggccgaaagttcggtcgaccaatttcattaagattgggagaaaggatcattacaatagaagcttacaacgacgaaatgattggggaaaaaaccccaaccatgtaagctatagttgtatgctacagggattacaaattaatcattatcgccattacaagtggtgaaaattcctgccgacttccaaatgaggatctcctccttgatgtcgctcactagctgctctgtgcttcaaaatttctgctcgaacactcgcgcattacgctccttccacaggaaccagcaggttagtgcgaagacgccgtcgaaaatgtccctatagcccgtccaaaaattcagtctcgccgccatccaccattcagttaggcttgtatcgttgattgttggtggcgcaaagccgatgccaatccatctttgcatcaaagtccagactctcctggataaatcgcaggttaggaaaagatgcaaacagctctcctcctctcgctgacataagtggcaagaatcgtcgtgcaaccaccctctcttctcaagattatcagctgttaaacaacgacctttggccgccagccacaggaagaatcacacccaggagggagccttgatatgccagataagttcactgaatgggcagatcttccttgccatgtagaagagctcatatgccgaagaggctgagagctggccatcggcagagaacttccaccgaatggtatcatcttcccgattgagaaccacctcctgaatctcgtcccatagctgaaagaactgcgctatagcttcatttgagagtgcacctcgcaggtctcgcacccatctattgttgctcagcgcctgagatattgtaatttgggaccggcccacataagtgtaaagggtcggccatctccaagaaatgctgtgtccattcaaccagtttgctgtccagaattttgtgtctttgccattgccaacacaaaactcggcggcagaactgaaaattcgctccacatctaatcccaggcgatatcctgccatggcccaaggacggtttttctgttctatacttttgactagccacttgagtctcagcgcctgtccaaaagcatccaggtttcacttgagtccccagtcctccatttgtcaccggcacacaaacatttttccaggccacgagaatatatatatatagttaatttaaacatgcatatttgtagccatatatatatgtgcacatcctggttaatcattctggtattagaacaaaaaaaaaagaagagagaaactgcgctgaggtttgagcatcggagggtttttttttttttggtctggacaagagtttgtactgactcaatgaatgtacaagtgtacaaagtatcatcaatatggcaatatgaaacaaatactacgcaaagattatgtgatttcgcagcttgataccttgagtgatgtgagcatggatggattgagcgtttggccatttgccactctctcaatgcgtgaccttccaacaatcactccaacggcccaggggctgcagatcttcagttcttcacaccatcacacccagcaaactgcgacaaaatgtttctattagtaatgcttaaaattggaatgctggaaaaaaacgaggaaaaaataatcaatgaataggaataatggatcaaaccggaacaagaactgaagcgtgaatcgacgtttcgccctccctccgagtcaccgccgtcccgcctgactccccacgcctgatctgaccggccgacggctaccacctgagccagatctgtgcaggaaacgtcggcccccgcgcgaaacctggctgccaagcctttctctctataagacctggccggccgacgaccgggaaccgctgcgctttccgccgccgccggagctcgtggtcggcctctcgagctcatcgtgtgaggcgaacagtgtgcgaggtgagcaagtgagccgcacggcccattatgaccaatggcccaacagatagtgggccaagaaggtgactatcagaacagcccaaatacggcagaaggaaatccgcttcttcatcatgatacttaacgcctgttcactttgatgtcatttttaaccttatcaagttttggtaaagttgcaaaaaaaagtgtctatatttagtttgctgccaaattttggtaactatataagaaatcattacagaattttagcaagttaccaaaattttgacaactatgccaaaatttggtaaggttttttttggcatcaaagtgaacaggcccttacttttcatcaagtccactttgcgtcccccaactttacgtcgaatctataagtactagaaatctctatccctcaagtgttcaaaaccgtataaaataggtcatgcaagtatgcatgagtagtttcgctgacgtggcatcctagtcaacaaggagagaattaaaataatgtggaacccacatgtaagtcacacgaaaaacatataaaataaaaacttatctcccacctctccccaagcgcacggcggcaacgacgcacctttctctccatcccgagcttcagccgcgggcgcagggaggcagaggttgaggcggggcgcaaggaggccgaggacagcgctgccgacgaggtcaagacggacctatcactcgctgcaacacaggaataggcggcggatgcatcctcctcactctcctcctgccatcaccgttgagcccaaccccaccgagccggtcccaacggcattcacctccatatccggagtggcggcagcccaggaggacagaatcgacggtcgtaggttctccatagtgaggaagtggtggtgttgaggacggatatcgaggtggaggctatcgagccggtaacatcaaatttggtaaagatactcgaagttgaagtccagatcgaagcggatttgaaggagataagattgtttccaaacagaatagcgtatcgtctggaggctgtatcagttgatacggaatcagattcagttagccgataggggtaggaaagccaatacaagcagtgttcaagatcaagttggattcagattaaaagcttcagaggtattgccgaataagagttgattttgtaatgggtaattatatctattaattagggataagagttagttgtttccattaagaaatttgtgggaggaatccgcctagggattcatttgtttatcgtactttagcaagtttgagtcttgtccgatatggacatggtttgtatgttacgggtataaatatatgcctaggggcttgtaaaaaaacaatagttcaatacacgttttcggcacatcgcctcacctttgttttacttttctcgacgagttcttgtttcgaattgggctacattggtttcgctctccaggaagaggtatagcttatcatagcggtttgtatcggcggattagcacgtcgttttagatgttttaatatatcttttctaattgttggttatcatatatcttagttaatttagtccaattattcgatttatttgtattaacggaacctttcttaaggttttaagattgtacaatatctcataataaaagcacagtgaaatgatatggttctcctaattttgtgtattttcaagtggtagtgctgtgagaatgggaaaaaaaaatacacatgtgattttctacatatgtcaaagcaatttttttcaatcataggtaacatgtcatatgtacaaggtatgctcatgtggatagttagatgaacaagtaactcacttgactcattagtgacctacttgatgcacccaatgaccctccatgcattttactcaattaaactgcactacagaaaaggggtggtaagtgaacttattcttttattatttttacatactcttttggtgggccttctgtcggcccactaacgtcgtcttcccttccggctggctgcgtctcctgccatcgacgacgacatggatcaaatcggattggaaaggaaggatataggaccgaatcggagagcgtttcggattctttctcctccttatatactactggtccgcagccaaggcgccacttcgatcggaaataagagatcgatcagacgccaccagaattatatatattgtgcgaagaaatttgatcagtccagttatcatattcgaaaaaaagtagtaataatctgttctgcccgatccatgggtgctctcgtgtctcgagctgccgctgccatgctaggcgatgcctcggatgaagcggagttgaggagatggatggaggaggatgctagacgtcaggccaggaagaggaagattatctgtgcacccgcccgctaccatccgaggagtacgtataaattgaaattgatctgaatagtaccggcttaaataggatggcaacggggcggggcggggacgggttggataagaacaccc

SEQ ID NO: 25724 - DNA, 19743 bp, Oryza sativa
  unsure (1)..(19743): unsure at all n locations
ggggggtgagggggagctcacccccgcatcacccggggtgcacaaggctgccaatgttgaacggcaactcagaaagaatgaaagatggcatggggtgtaactactccactactccagtcagtaatcaatatatcacaaatgcacaattagtagtaatatgcattctagggagccggatgcccaaatacacataaacacaagtactaatgtagttaagtcctatgtatgacaaatacacaacaaccaactcacaagcaaagcagcagccagccaattagcagtatactagtagctttgctcgaggttgaggagctggccgcaggagtcaagctttgctcgagattgaggagctggtcgcaggagtcaagcactcggacagtcggacggcatgcctgcaacgcgcggcgatggcgctccactccggctcgatgttgcgggctccggcgctctggtcgccagcgtcgcgctccgcttcgccgccacgccgccgccgcacgcaatgggcgcccgggagctaccaaactaatttagggttaggtattcttcagatttttcttttatactatgctggttgggctgttgggctgacctttgtgggcttctttctcataatttttatcgactgggctacatacctcggggccccgcaggtacccgcgggtgggaatagccacccgcccccgcccccgcataattccggggccccgccccgatggacccgcggggtgaaatttgtacccgcccccagccccgtaggggcgggtactcggcgggtccccggccccgcggggcaaattgccatccctaggcttaaactgtttttttatacctttggtttatacttgatgatttgtattgtattgtactaactactatcgtccttcaatcaaaaaaaccagatgcaacaggtccctcaactattaaaactggtgtagataagatccctcgacagtttagatggtggttttggctgacgtggcgcctacgtggcaaattcgacttggtcttcatctgacgtggcgcttacgtggcaatttgatccgaaaaaataataaaccatgtgggacccacatgtctgtttcacatacaaaataataaaaatggtgggacccacgtgggccccacatgtcatcctcctacccctcatcttcttcccgttatcctctctctcttcttcacgatgtgcactagggcagcgggcgaagtggggcgaccgcggcccggagcggtggcgcgcgaagaccacctccaactgcgacgagctcgaagaccacctctacgttgccgccgccgccgcggcagccagcacacccactgcctcatccactccgaccacgaccccgccgtcctccaactccaacctcctcctccacccgccggccggcgccgcgccctccaagtccaaccgcatcagcctccctaccaatcccaatcgcaaccccaaaccctagccttccctctcctccatgcctcccgtgatggaggtcgagatcaagctccgtctccccgacgccgctgcgcaccgtcgcctctcctcattccttgtgccccgcctccaccgcgcaccgccgcctctcctccttcctcgcgccccgcctccgccgcaccaccgccgcgcgccccctctgcgccgccaccgccgtgctccgcgtccgtctctacggcctcgaagaccgggccgtcgtcgcactcaagcgccgcccgcgcatcgacgccggcgtcagccgcgtcgaggaggtcgaggagcctctcgagcccgccatcgccctcgaggatgaggaggcgttggtggcgagtgggggaggcagtggttgacgcgcgtgacgaggtaggtggtgaatcggtgggggcgcggggcgccgtgacagagcatgtggacgcggagcgcgtcgcggatttctcccgctcccctcggcctccgcccgtggctcctatacttccgccggccgagcacacgcgccactcctctcctccctccggccggtgcccacgcccgcgcctgcgcaccgctcctctcctccctccggctgacgctcgtgtgctgcttctttcccagcggccgccggcgataggctcgagggggtggaagcggaggaggtcacgcctctccaggccgtcgttatctccgccggctggcgagactgcgagaggagggaggagaggggagagagatggagagaggaggaagaagaggaaggctgggagtatgacatgtgggccccacatgggtcccaccattttttaatgtgaaactgacatgtgggtcccatgggttttattattttttccgatcgaattgtcacgtaagcgccacgtcaatgccacgtcagacgaagaccgagtccaattggccacgtagacgccacgtctgccaaaaccacccttaaaaccgctaagggacctaatctgcgccggttttgatagttgagggactcgttgtgtctggttttccgtttgagggatgaaaatcagattcattgacaagttgagggacctcagatggactttattcctttccgcgcagcgagcggtaaatcgttaattaacttgagtgctgggccggcggaagtcaaaatagtttctttaggccgtggtgctgtggtgggttaaatgtggccgagcggacgctttcggcaccgagtacgagtgcacgcctcacgaaacaacggaacggagggactctacgattggtcactcgatttaaaatggagtcggttcacattagatcccttaatttgtcaccgagtcggaaattcattgctaaaccaaattatcatatataaccgatctctcaatttataaaactggatcacctgagatctaggtagtattgtgtaaggttttaactgacgtgacaagctgacttagcatgggacccacgtgggccccacatgccagtgggtagcactttcattctcctctttctctccccttctccctcttcccaatcgttctggacgtcggctgcccgccagccaacgttttcgtcgtcgtctccttagctcctgctggtacatacgcatcaagacaactagatgaaactccgcacattgttgcgggagcttagtatgataacaataagtaaaaataatgtgtaacataggtacataacataagattacgtaagttaacgtggtttatgataatttaattttaatagtatatagaatgatgattaaatgtaaaagtaaggtgatatgattttatgaaagaagaaaaatattgagatagtttgggcctatttgaaagtagaaagacttatttggaaatcatggatatacacggtgatgtaataactttgtaaattctatctctctccctatttgtaaatattatttatatatatatatatatatatgcgcgcgcgcacatggtggcgctacgaaggaagtagcgcgcctctcagcgctcgccttcctggcttttagttttttctgggtccaacttcggatttctcgcttttctcatgtgccgcatcctcatggaccgcttttactactaccaccgcctgcaaaggcttttcccatcccatttgtcccgagttaaaaagttactcgtctggtgatgtgaacgcttaatgagtaaaaaaattatacggcaagtaaaaaaatcactggatcatctctcctctaatttgcctgtacaccactcctagtatatattaattgcagggtgcgcgacggctattccatttggaaagctcgcgccgctcttcaccattacaatgccaatcatccggtaagcagcttatatgtgtgtgcatcactttcttcgctctttacttatacgtagatgtgtgcttatgttgttcacggattaaattaaattaaattcagggagcggagtatgatctcgtcaagcctttgatggccgcctgcgtcattttcagaggtaaactgtggcatcatgtcagcttcttggctcacaggagggatcagctggttgcaccacccgttgaatacttcttcgcagagctacgcgatggctgctccgacgacgactccatcgtcgaagcttgcaccatgatcggtaagtaaaattaccctattcttacaaaagtcatctacattcagattcagaattattcttattcaccagtctaaaagcaattattcttattcagctttctttctttcttactttcgatcttcccatttcagaaaatccacagagctgctccggaaacaagtgttcgttttgccctgaacaatatcaaattgcgcacccgagcgagcaggagcttttatgtggaaaagaagaacatgccaaggactttatcagactgatgaatatgtccccgatgcccttcacatgctccaccgaaacgcctgagattggaattgtgattgaacaatagcaatatgcatgaaggcattattatggagcatgccttcatattagggtccataatataataaaagccttcatgcatcatcaagtgtacatattatggtcatgatgtaacaaatgcatatgttattggtttgatgctattcataagagaacagaaacggcacctgacctgcttgcacaaaagctgacgttgaacctcgttgcagatgcacaaacatcgatatgatcaaatttccacataatattttttttaaaaaaagagaaggtcgatcattcattctccttttactactagagaaaaatattatcagataattaatcagaaacaaaaatgcatttttttccctttaatcatgttggaggcagccattaaagtggctcgctgttatttcagtttgttcagactattggatgatctgttccatgctttttttttaaaaaaaaagaaaagaaaaacgtactatcttcaactgtgtagtgtagctgtgtagatcacttattataggctatttcttaggtttcaaaatatttaacttatacatgtaacctaatcagtaatccgtagcaataatctcaatcaatcaagatctgtttaactattcttcttttggttagcagcgatgtggttttcattgatatggagcgagcagtagcaaaaatgagatctttcgtttagacagaagagagatcctttccttcctttctataggaaatgactgatattgctaagtcatcttcggctgctcttgcattatcccttttccaattctttttgtatggctcggttgcatccgactgatcgatccctagtcactgattacatacatgagtattggctttggcaagcaagtcaaggaaagaagaggaaattaagggcctgttcactttaatgccatttttaaccttaccaaattttggtaaaattgtcaaaaaagtggctacatttagtttactgtcaaattttggtaactatataaaaaatccggccaaaaatttggtaaggtttttttggcatcaaagtgaacaggccctaaaagttctcttgagtttgatggtactaagttagatgtcacaaatagaaattcatggtctactgtatgcatgtatgtgctaaaagaatataaaaaatcggggaatcacttaataagaaattctaactattgttcaaaactcaaagtaccactgaagaaatagaattaaatggttaactaagatttttttttgactggctatatggagcggatttaacgtccctctacacaccatcaatagaaagacacgagagatgaggtaagaagagggagagaagaaaatagtagaggtctgaaatttagataagtctcctctaaattttattctcgatccgctctatgcatgtgatttcttatgttcagcaacatggttttatacaatttatattttacgaaatgaaaagctataccgtcatttatattttgaaaaagatcttttttttaagaaaaaactaaacgacagagatagagaagggagacacgtgttggtgggattgggattccacatcctctccttgtcgattccaaatccccttcttcgattgcagtgttgcgcctcgcgaattccaaccccgatcgctcgcacggccggccgccatggagagccccacgtcgccggcgtcgcggctggacttctacgacttcatcggccgcatgcgccgccccgccgccgccgacctcttccactccatcaggaggtccgtcgcttcgcccccctccctgctcccctcctcgtaggcccttgccccgcgtcaattctgacctgagattcaactgcagcttcctcgcgtccctctcccagggcggcgagcccaacgccgaggtcgacggcggcagggtccagaccttcttcgcggagatggagaccgccatcagggaccacccgctttgggccaatgccaccaatcaggaaatcgacaacgcgctcgaggtgaccccgccctaacccttgcgcttgatttgctttctgattcaattgaacatcttgcgtctctcttgttatgcgcgattaggggcttgagaagtatatcatgaccaaattgttcgatcgagccttcgcttcatccgcggaggatgtgaaatccgacatggagatttcggagaagattggtctcttgcagcactttgtcaggcctcatcacttggacatacccaagcttctgcacaatgaggcagcgtggctggtaagacaacaatgacagatctttgagtcattatttcattgttccgggtgttagcccaaaattcagaacttcccatgtgatttttattgttcctgcacgcggcctgtacaagttcacaacgcattgttacctaatgctaatggtcaatagtctgcgactgtaacattgtgaacaatgaacttatgagttatacttataccccctagtaatatttttagatgcactctgaaagctttgtatattgatcacggtgtaaggtaaattgcaaattatcgtgttgggttactttgaattatctcttatataaaaccagcattagcttgcattttggtcaccatgtagaatatatgataaaaatgcatggggtcaacatttaagcgattatctttccctgtattcttcctatgattggttcattgctgtaattttacatctgcttgacataaaagaaatactgccacctgccatcaacacaccaatgcccaagttaactctgaccttgggatgtttatgccattctagcttgcagttaaagagttgcaaaagattaattccttcaaatcaccacgagaaaagcttagttgcatcatgagctgttgccaagtcatcaataacttgctgctaaatgtgtcaatgtcaaatgatcgaacactatcaggggctgatgattttcttcctattcttatttacattacaatcaaggtaagcttacttttgttcctatttattctttctctaatttttctcatccagattgacatgattacatgctgacagatcattgagtacttatgggggaaactattttgattcctcgaggggatgtcacctcgtttgcttaaaaaaacatctaaatgattatgaaaaattctggaaaaatttgacaacactcatataacatatctatacaactccacaaaatcttaggttgaaactcaactcacgtcgagatataaaaaaggacaaattcaacgtatgaacagagaacagtagcgtactgttcacatctaaatttatcttttttgtttctcaatgtgtagatcgaattagaacttgatttttggtagaccgatagatatcactatactctacggtctacattgtcaatttttttcagaatttttcgtaactatttatatcgaatttggaagaaaaaggtatacgaggggacatcccctcgagggattagaatccaatccctacttatggttcaagttttacaatcataaattttatgaatctcgtatcatatgtacagttaacattagggtgtttttacctttattctgtacagctaaattgggtaacattactgataaattgcattttgttacttgctaatgtgacaatgcctattttttacaatgtaactagtatagatgtttggtgtattaatgggatctaatggtcttatggtgtaaatttgattgtttctgtttgttattagttaatattactcttatatgccgcattgttaccaaagcttattttctttttggttcattaaggaatatgagtttctctagagagcatatgatactagtcagttgaaagctgttagttgtcaccaatgtctctgtgttactttgtgcattctacttagggaatcctatccctaatatatgcaactttttactatatggagttcaactgaccaagcacctaaaaaattgatgtaggccaatcctcctcagttgcactcaaatctaaagtttattcagctcttcagaagagaaacaaggcttatctctgaagtcgaatactatctcacgaacctcatttcagcaaagatgtttataatgaatgttaatggacactcactgtccatggaggaaagtgtgttccagacacatatggagtctgcaagacttggtaaccacatatctgttgctagcactaatagttcacaaggattgggtacatccacaccaggacagaacgaggaatctggtgatacagaaggtctgtttttaacattagtggatcagtttgtttcagaataaagtttcacctcaattaaagtattagtcttttttgcacgttcatggtaagtttccttctggacttcttgtctcgtctaagaatcagtttagttagcagctatacaagagcattctgtcaaagtatttgaggtgtctaccgtacctatgatgttcctcaatccatctaaggttgggtttagatttagttttcctggcttcagctgcataatcacgatgcttagttcatatttaacaggattgaaattcccattcatggactctgaaactgaaagcttgactccagcggaagtcaagcaattgcacgagctctacaggcaagtagtcaccagatatacgctgctgtctaaagctttaagaaagttatcggtagatgaggatcagctccttaattcagtagatgattgatgaagccatgtaaaaatgctgaccagagatgacatgtcctattaaccacataattgatcgagattgtacacgcacgcaaagttttccattgactgtaggaaagcaaacgagttccaggcatctgcaacatggttccagggattccaggatacactacaggtatggccaaatgatcatcagagttgagaatggattcttgtgcctttgcattgcaacttgcaagccctctgtaatagcgtccacttctgtaatttttagttcctgtctgccccactccttggagctagcgtagtctctaggtgtgcgtgaggaactgcatatggcacatgttgctgttgctgatcatgttcaaccgttctacctcgtacttcgtatgttatacagcaaatcttctgtgctgaaaggtatctgtttgccttggtgcaatggtgggtgaacgtggtgacattgtgagacatatgcatgatttgctcatgaagtcattatggctgtgttttgcaaaaagtttctatgggaagttgttcttaaaaagcatattaatctatttttcaagttttttattattaaaacttaattaatcaagcgttaatctatcgctccgttttacgtgtgttcccaaccccttcaaaagaacacagcctattatatccgagttctctgcttcattgttgagcagaacagtatactgatgctgccacaatctgctagtgcttgtgtaattaactgacaactggaagcatggggcaaccaatcatacatggcttctcttgctagaatagtaatatgcaaatatgactaattcagaatattcggtgatcaattctgagggttgagcttgaaggttttcttgtactcgtgaaagagtgattatacagtatcatgacaaaaaaaaaacagagacagtttgcttctgtcatgacagaacaaaagttcaaaaaaacgtggtcggcaggattcgaacctgcgcgggcaaagcccacatgatttctagtcatgcccgataaccactccggcacgaccaccttggggttgcaatcacatactttttttactaattgtttcatacaacaacactgcaatttgattcatattcgctacagatatcgtatcttttattcaaacaccgaccaaatcagttcatagatatcacagtcaccaccagatatcacacagcaatatcatgcgatggcgcgaactcatgttcatacatatatcactgcatcgtgtcatctgcgcacagctgcacataacgcacgcagctagcactgtcgcccaaacttgtcgtcactccagcttgtgctgctgggcggcgcgcccggggctccgagccgacgggtactcgagcagcgggtggagcggcggagccggcagcgcggcgagctggtggcgacgggcgctcgccggcggcgacggcgatggcgtggacagcaggaggcggaacgtccaggcgaggacgtcgggcgcgaaggcgcggaagacaaggaagacgtcgtaccagttggggtgcttcacgtgggcgtcgccgcggcacgcgccggcgaccaccatcctcgcgtacgcctccacttgcccgccggcgagcggcacctaattacatatgattaatcaatggcaagttaattaatcgacgagcagctatagcatttgattgttgaactaatctttacctctcgctcctcccctttccattgcatctctgcgccttcctcgagcatgaacttgccgccgctggcctcgccgccgatccagccgtgggtcgccacgctgatgcccacctcatcgcccacctcgtaccggagcgactcgtagaaatcgatcaccgccgccttggccgcctgcaggcacacacatgacagttttcagatgattctgaagaacttgctggtgaattttgagtagaagagagatgggttattacagagtagagggtcatcctgggcatgggcagccagatctcgacggcggcgttgacgacgacacggccatggctccgccgcaggtaggggagcgcggcgtacgtcgggtacacgttcccccagaagttgacgtcctgcacggcacggccggatcgaacacagttattgcagcagcagctgatgaaatttgatcaagaaatcgtaggcgtaccatgaggtgagggaacgcgaccgtgtcgccggcctcctcgaagcagaaatcgtggcccaagctcaccgtgttcaccagatggtttactgcatgcatcaatattaataagaaattcagaggtttgattaattgcaagtgatgcgtggtacaggtgactgacactggccgaagaagctgatggtgtcgccgacgagcctccggcagtcgtcctccttgacgacgtcggcggcgatgacgaggacctggccggcgccgagggcccgcgcgttctcccgcaccgcgaacagccggtgctcccgcctcgccaccagcaccaggttcgcgttcctccgcgcgtactcgtacgcgatttgctgcatgcaaacaccacaccgatgatctttgacgttcgccgaccgggcactggttatatgcttagcttaattacctctccgatggcggaggaggcgccggtgatgaggacgaccttgttgtgcatgttctccacggtgagcgtcttgacgacccactccacgccgcgcaggaaggagagcgtcggccacgcgaacgccagcatcaccatgctcgccggcggcaccaccaggtccagcaccgcgttcaccacctgctccatctcgatcgatcaatcaatcgatctctcccacactatacagttcctcttccgatccacagctcaatccaatccaattgaaagaatggatcaaccagcccgcctctggtttctggggttcttgggaggtgaagaaccgaggaggaggaagaagagggatcaaagatcgagtctctcaatgagtttgccaatttggtgaggacgatgagcagataaggacaggagaggacggacgggtgcaggcgtgcatggatggcagctgcgcaggcatgccgccatagacacacgtcgagcaggacgggaggcgccacggtgagaccacggggggaagaggcaagctttggccgctttcaaagccttgttccatatgcctttctcctccgatcggctgcatatattactcctccaccttaatccgcgcctactacaacatttacagttctgatcagatacaatatgcatcttgatgtgaaatcagagaaagggcctgtagcctatggttaatctccataatttgccttagaagatgttgtactgtgtaatttttttttttaaaaaagtcaatctccaggatttgacacagtgacgaagacctgctgagcggtgagtgactcatgcatgttagtcctccctcctttttttttaaaatagacgatgccgtttatcattcggtctaatttaaaatttttgtgcaaatacatatgatatcaattatgcttaaagtatttttagtgataaaatatctcacaacaaatatttttttaataagacgaataatcaaacgtgtgcttaaaagtcaaagtgtcctttattaaaaaacaatggtagtagtatttgcatgtgactaaaataataataaaaagaaattggtaatatcaattaggatgatacagacaaatatacaccaataaatttgatctacaaataaagaaataaaagtaataagatcagacattgaacaatacctatacaacgtaaataaaatttattatttttaattttttatgtatagatcgaatttagacttgtatatttatacaatatcttatatcttatatcgcgtgcaggcgataacagttagacgtagaaaatatttccctgtttacacagtgtgtaaactgtaaagtaattttgcacagcaacccttcgtttaccccgtattattattttcacgcccgtattctggatcgctaccactcgtcccgtttaaccgttggattttacatgggcggcctggatcgagaaggaggagggcggcccacgcgtatttctacgtgagcccttcccttttggaataactattatctttcacgctcctcccaagctttcgattctgaaccagaattccacggtgaatcgatcttccgacgccagatcgacgcgagttgagagacggccgtgctcaggacggcggagcgccggcgagatgcggaggcggcggcgccgccaccacgcgcgctcctaggttactttcctcttttttttttctctctttttgatgcttgtcttcagatgttcagagttcagaggagttagccaggtagggctcttgtgctacgtctgtgagagcttgtgtttagaactttagatcaaccattttatgtttttttttgggtgaaacaattgttgtagcagggagacaacgccctctctcctatccggtcgaaacatctaagatggtttatggaaagttcctaagtgtaaaacaaggaaaacactctcgagttggaaaacactctcgagtggaaaaacactatcgagttggaaaacattctcgggtggtttcttatcacttatatgtaactcatcttgtttggagatgatttctgaatacatggcaggtgaatctggcgatcgggaagttgttgaaggatgtgcaaaccctcaatcatagaagacattcggctaagagagctcgaaggaaaaaacctgctcgagtaaagatccggtcgaatggaagattctgtgggggccgtttctcaaccactcttgccagctggagccaaaagactagaatgaccctgagaatgtactaaaatacccctagggttgctgacatggcaagggcattataggaagatcactaaagcccatgagggtagaaatgtaacatcacatgtaagaccgtaggctataaaagccggtcaagtccctatagctagaggagacattttttaatacaaaaagtaatcctctaaagtggtgtttgctgtttgagcttatttctaaggataggtaggaaaatacttctttccggcctatccccaatcttgttcgtgacctaaggtcacaacaacaatcaatctctttttgattggagaagaaaaaaagaacatcgttttcttataaggcattgctgtatcataatccatacaaattggtctggcaagcctgaacaaattcttcttccgagcaaagcctgaaactgagaatatggacacatagcaagacttactttatgttgtaccacagtttcacagtagtaggacaaaatatttcaattttggcaatagtataacagcaactgcatcacccatgcatagcacgagtttatgatattcagatccaaattgtcgaagcggctgtactatgttactcttatgtacagaatgaaaaatcttcatctcctgaatgtaatcctttattcttgttgcatgacaccacattttgacaattacaaataggatcacctcaagcaatccaatggaaacgatatcgatggccactagaaagagcaacatcttgatgtaaaactgctggaatctgtcgcggagacttggatagattggccctctctgacagcaccagcaccagctccagcctcatctgcagccaatgccttcttgctgatgatccggtagatctcagtgagcactgtctgaaaagctttatccacattcgtcgcgtcgagcgccgaggtctcgacgaaggataggccctccctctctgcaaagcttgttgcgtcctccaaggacactgaccggagatgcttgaggtcgatcttgttgccgatgagcatgacgacgatgttggagtcggcatggtcacggagctccttgagccacctcttcacattctcaaaagttgtggcctttgtgacatcatagactagcaatgctcccactgcgccgcggtagtatgcgcttgtgatggcccggtaccgttcttgcccggctgtgtcccatatctgtgcctttacaatctttccttcaacctgggtcacaaaattgaagcaatttaacaatggacctttggggaaacaatagtactgaacataaaaataaaaatctgtgatatcatggataacagcctaacaggatcataataaaaatctgtgatatcatggataacagcctaacaggatcatgtattcatttgttgtatgcagctaattaggttctctgattatgctttaaagcaagtgagccactagccagtgttagtttcctgtcaatctaaattcgcgtgtactgcaattcagtttgtacaaaatttcaacaaagaaagaactatcctttggccattttatttttttttttaaaaaagaattctgctttggcgtaagcaattgcactgtacccatcgatgaaaaccaaaaggagggactgatttccaagagaaagcgaacaatagttagcaaatcaaatagagaaacttgctgaattcctctgtcttctactagctctgaattctactgtcaagcatgggtgtcaaactatcaggtcagtcggcgatcgtggtcaagcccgccggcagcacgcatgcacaagggcatcatccaattcgagcaactcaagaaacattcagagaaagcagtaacagcgaagcaccgaagcagaacacaaacagagcaagcactagtaagcagaggagatcaggagaagcagaggagaagctagcactagcaggcatggtgacctggatggtgcgggtggcgaactcgacgccgatggtggacttggagtcgagggagaagctgttgcgggtgaagcgggagaggaggttcgacttccccacgccggagtccccgatcagcacgatcttgaacaggtagtcgtactcgtcgccgccctgctcccacggcgccggccgccgagccatcgatcgatcgattcaacctcccttctccttcctcctcagattttcgcactttcttgctgctttcttggagcctccgcctccgatctccgttccctcctccttcccgagaagctagctagcttcttcttcttcttcctctggctggctacttgcagctttggtttcttggctttggacgggaagacgcggaggctgatggcgacctgatcgatttttattggggaagagagagagagagagagagagtgcgcgtgcaaattggtaaggccacacttgggttcaacgctaatcttttgttttgtgtacgatttgtaattggatttgcaaaggtggagcatgttgtctagtcgttggctgctatagaatttttctggagtggtcatgagtacacaggcacgtacccaagaatgtcactagaacagtggattatgtcactagaacagtggattaagggctcatttggtttggtgccctaccaaatcattggtagtgtcaaatcatgggcaagatttgatactaccaatattttggtatagttggtttataggagttgtattaactttgttaaattttgacatcaatccaaacatctataaggtactattcaaagtgctaattatttggtagggcaaattttggcatcaaaccaaaacagccctaagtactactccttccattccaaaatgatcaaatttgaactaaaagagtgtacttatttcaagacggagggagtagatcagtaaccaaataaattttaaatcgtaaggtttattagcgataaaaaaatactttgtaagtaaaacttttatatatgtattattagcgtcttaaaagctaatgttaaaaaataaattatgatgataaaaacatcaaaatcaatttaaagttaagttttaaaatataaatgttagtgcggctagcaagccgaagagcaaacgctggtgttattgtgtgaatcaaaatgatcaaaatacagtggcggagccagaatttttccaaacctagggcccaattagttgagtgtatatgattttgcctttatcttctagtttttgaagttttaaaatggaatttcaatgaatatttagaatcaggagtagggagtagggctgcagccctagctgccctactcctgtctccgccccctgtcaatatagcaattaaaatgactagagatatgaaaaaaactatatataggtactgtcataatggccatatgttgaaaatatttatctcgggtgcatgtaacattttttttctagaaaaagatgtagttactatataacaatttacacctatggtataatgtgttttcagagtagtttcgcaactttctaattcaattttaactcccaaatagcattgttgacacggttatcccttgcaccagtaccatcaaccttccgcactaatggcaaccatggtaattggatgtggacacatcagtgtaatcctaccaatattccactatgaaaaagaaaaaaaaagattccaaaaccaaaggcacaattttgagaccaccctatcaaggataattctgccattctgctgagctgggaagaagatttgatcagttggaatagggaagatggtattggaatcattctaacttccaaacagaaacacacaggctctataatattaacttcaatcatgacttgacctcaaactaacaattaaacaaactcccttctgcctttgtttccgtgattgaaagagttatggatggtcgatgaacaggcaggaagaaagaaagcaatggaaaagagcaagagaattaacggctggactggaagagaacttttaaagacacgctttcgatgagaaccacacaaattgcccggcttctcacgagttaacaatctgcagcttgcgtgtaaataaaaaggggaaaaatggaaataagaagaggggaagatgccaccgtgtcaacccaagtatgcataaaaatggcgagggctatcatgcacatgaaaagtcaaaaacacacttgcaatagcattatccgacacaactcatcactgattattcgttcaataatagcatcactcacaagcatacaagcatacgtttgttcctttaataatgtttgcataatcatagggtatgtttggctagccaatagagccgctgcacgcagccataactgttgcagctacagacacaaacagtacactgtttgtgttggctgcacaacagtgaagttaagtgcagccgaacagagccaaaatcaacaattaatagtatcattttttaaaagacccaattactccgtcagacagacagtagcatgaaacggaccaaaggaagcagacttgcagaatagtgacattagattgatgaaggccaggagcagaagtgcgtgtgcgtctgtggtccgtccgatcgggcatcggacggtccagatggcgcgggaggttatggctggcgtcttcgtgcggcggccgcaccacacccacccgttgcgttgcggcggcctctctctctctttctctcctctctctctgcggctgcgcggtctccacggcgcggcgaggcaccggcggagggatggtgggctcggccgcgtactccgcggcgtcggccatcgtcgtggtgatggccaagggcaaggggcggggcggcagaggcggcccctctggcgccaacaaggtcagctcattcctcctcccctcaggtaccaacagtttgggtaatgggtacagtatgatcgaattcagcgcggggagtttggattgaactgaatgtgcctgtgaatgaacattgctgcaagggattagaggaattatcagttacgaatcattgcttcacaaaattctggggcacccacatggaaggggaaaaacggctgctgtgcgtgctcaaccatgcaaaaaaaaaagagttattcatgaggattgagttatgttttttttgttgttgtattaatcagaacatttagtgtggtacattctcaatttaatagcacatttgttggattatcaacaaatggaagatcttgtattggacccatgggtaacaggtcggctttatggctttgcgtcctcacacatgacacgctgcctatttatgtgtaggtttctgagcgacggcctcctaggataacttccaatgtgaagcagagcttgaggattctaaaattttggaaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25725 - DNA, 618 bp, Oryza sativa
aaatattctggatctaagtacccaaatgtcccctgtactattgtaactacgcgagtttgatcaatggaaatggacctagaagcaccgaaatctgaaaccttagtagtgaaggtaccatccaagagtatattagttgatttcacatctctatggaagattggcattgcagcagaggaatggagataagcaagtgcccctgcagcctctagagcaatcctcattcgatcatcccatgtcaacaaacaattggtgctcagatcaccatgaagaagaccatgaagtgtgccattagaaatgaattcatacactagaagaggcacctcagattcaaggcaacaaccaaaaagtttcaccacattacgatgaataatctgggaaaggatggcaacctcattaacaaattggtcaatctcactctgctccacaattttggacctctttatggcaaccactcgttgatcggataaaatccccttgtaaacagtaccatggcctccatatccaaggatacgtgttgggtcaaagttgttggttgctttctctaaatcttccaaagaaaatattcttgtgttaggagtaacattgttactggatgagatcagctgctccaagagaagg

SEQ ID NO: 25726 - DNA, 420 bp, Oryza sativa
ggcggggcggcgcatgcggccgatgaagtcgtagaagtccagccgcgacgccggcgacgtggggctctccatggcgcccgccgtgcgagcgatcggggttggaattcgcgaggcgcaacactgcaatcgaagaaggggatttggaatcgacaaggagaggatgtggaatcccaatcccaccaacacgtgtctcccttctctatctctgtcgtttagttttttcttaaaaaaaagatctttttcaaaatataaatgacggtatagcttttcatttcgtaaaatataaattgtataaaaccatgttgctgaacataagaaatcacatgcatagagcggatcgagaataaaatttagaggagacttatctaaatttcagacctctactattttcttctctccctcttcttacctcatctctcg

SEQ ID NO: 25727 - DNA, 1724 bp, Oryza sativa
aacatttttgttagtctccaaaataagtacacgatagccacgagtatgtgcggggtaaccaagaaacaatccatcggtagaacgtgcctcaaatttgtccaaatttccagatttcaagacaaagcatttgcaaccaaaaacacacaaatgtgaaactttgggttgatgaccaaatcgaagttcataagaagtttttccaagtttagatcgcaagaaaacttgatttgaaatataacatgcagtgttaatagcctcagcccaaaattttctaggagttttatattcatccaacatcgttctagtcatctcaaccaaaaacacggtttttcctttcaacaacaccgttttgttgaggaacacgaggagaagaaaattcatgtttaagatctctttcattgccaaattgttcaaaagaagcatttttaaactctccaccattatcacttcgaattctattcaaagaaccaggaaattcaagatttaatcgaagaaacaaaccacgaaagtgttgaaaagctttgtgcttagttgccataaagaaaacccaagaatattgagacaaatcatcaacaataccaacacataccacttttcttcaacatattgcactctagctggaccaacagtgtccatatataatagctatcccggtgcatccgtcatcacagaaacaataggagcatgtgaagtagaaaccatcttagcataacgacacggtgtacaaaccaaatcaaagtttaggcaaactacgaacaagatccaaaccacttaacctagtgagatgatcaaaatcaacatgtccaagtctacgatgccaaaacatcacatctttatcaaacttagcaaccaaacattttatcacaggtgaaacaggatgttcaaaatcagctttaaacactcttccatatcgagaaatattcagcacaaaatcaccacgagaatcaaaaactttacttccagttttcttaaagtgaacctcaaactcttcatcaacaatttgtgaaaccgaaagcaaattgtactttaaatcctcaaccaaagttacatttttcaaatcaaaattttcatttaccttaaccaaacctgtagcgagaacggtacttatagaagcatcaccaaagataatcgattcagtcttggatgcctttttaagggaggagaaccaatttttatcaccggtcatgtgctgcgaacaaccggaatctacgatccacacgttctccttccttgccaccaaagcctacacacaagcagaagtcgaagcctcagtactggggttagatgataataaaaatttaggagtccagtactgagacacacgaccagaagatccaataggcatatatccacgagcaaaatcaattttagaattttcagaaaaattcctccgatgccagtctgaccgtagtacagtggccggtctgaccgggggccggtctgaccgccgctgcaccgacggtctaaccggtgtccggtctgagcgaggctctgcagccggtcggacccgtcgccggtctaaccgcggacccactgcggtctgactggttttctcgagggaaaaactagatttcgccactttggttttgcaaaagcatctctctctcctttttctgtttctgagctaatctgaaacaaaaaccaacaatatgtccatctttgctaaaaaaaaacaagtatatttttcacgatgattagacacattgatagcactagaagacttagca

SEQ ID NO: 25728 - DNA, 4237 bp, Oryza sativa
atttcacaacatcttccatatgctcagcgcaacctaaagcatcttttagttccatcttattcaaggtacatgttgaacaatccaaaacatcatgaggttgttttaactttttagcagaaatcatgttaaacatcaaactagcatgaaaaacaatttgatatttttgcaacaactttttagttaaaaacaactcatccaaagtgcgtgtgtgcaaagcaaaactacaagcaagagaagatctatttttcaaatcatgtgcagcattaacatctctaatttttgaaatctcattcattaaaacctcacaatttgagcaatcatcatcattagaaataagagattttaatctagcaatttcagatttaagagattcaatgataaattcctgttttctatacatcttctcacacttcatattttttgcactcaaaatattaatagcttcctcaaaagcacttacctcatgatcttcatactcaatatccgattcaccacgcgccatgaagcaaacaccggagatgttctttcccttatcatcatcaccactctcaccatctacatcacttgatggctcaaatgcagcatagacttgatcaaaagccctcctaagattctccttgaacttcctcgcttgagatgaaccctgcgacttgttgttgcttgtcttctcaccatctttgtcttctcttttgcctctcccaagcttaggacaatgcgaacgaagatgatcaattgaaccacattcaaagcaacgatttggacctcctcttttcctgttcctggtattattcatagctcgagcaatacggttagcaaccaaagccaaatcctcctcctcgatttgttcgagttgatcatcggatgtggcattaaaagcagcaagaaaagaaggcatagatgaagaagcatcaacatccaaggaagaagtagaagaaaccaaagcagtcgacttagaatcaacttttcaagaaagaacattcatctcatgtgttttcaattttgtctaaagtgaatccaaagtcaaagtagacatgtcaacagactcctgaatagatgtaactttcatctcccaaatagacatattaagaccattcaaaaagtgacgagaaatctcagatcgtggataattagtatcataagaagaatcaacagatctaagatcactcaaaattttattaaacctagagagatagtcatccaaagcttctccaggtttcatctcaaatttaatatactcctttttgaaaatatcacgacgaagttcttttatgttatttgttccttgatgaaagttactcaaagcattccaaatctcatgagcagttcgaagatgcgcaacacgatcataatcagaacgagaaataccactcaaaagaatgttgcgggctttgcaattttgttcaaaagcaactttttcagcagcagtattaatagcttcaggaatcaaataaggatgagaaacttttcttcaaagatcataattttcagccataatgtaagattgcatcctactacaccaatgagaaaaatccgttccattgaaaatatgaggcttagttgtaaacttagcaggagtagccatggcaaaaactctagatcaataaaaatccaaagaagaaaacaaggctctgataccacttgtaggatcgaatagcaagaactaagccaaccagaggggggggggtgaatggttggtatagccaaaaaccgaaaacttttagcggaaataaaagttaccctcgaaatcgatggagatcggtctgaccgagattgatctgccggtctgaccgagtggatgccgccagtctgaccggtatagatcacccggtctgaccgccgatgtcgcctgccgcgcctgtcgccgccgccggtctgaccgccgtgctcccgccggtctgaccgccgccttaccgtcggtctgaccgctggtgagtcgccggttggaccgtcgaaacccggtgaaacacaaatcgaagaactcttaaagtggatgacgactttattacttctctctatgtttacaaagtgcaccaacagcactccttacaaaaatttcgactaaactcaaaaccctaacttaaaactcaagtcaattgctctcaaaagcgataccgggaagcctcacactccccctctatttatacatgaggtaggcagcctaaagccacgaaccaaactcatactaggagttctaaacaccttaggaaaccctctagtacaagaaacaaactttacataaccaatcgtaccaaattcggactccttccaaattcgactccgcatacgcacacaataactccatcgtatgccatatggaatctccatcaaccacgtacatcaactctagcctaagtatcccgcatgatctctgaccaccacggacgtcgtcttatccccaagccgactcccggtccatcaccgcaaatactctcccgagacatcgagtcacctacacatgaaacaaacaaagaaaccatattccgagaccaagctatctccaacttgacttattagtagcaaacaacagtattacatacgtatagtatccatatagaagtcataatcatgaaataatcacggatatccaaataaacaacccgaaactgaaaccgacacagcgtcggccggtcagaccgcgggctggccggtccgaccgctcgatcaccgccggtctgaccggcaacacctgcccggtttgaccggtcacatgaaataacagcgatgtcctgtatattcacctgtgaaatccaatcatctccaaaaccactttgaaaataaattccaaataacaaaaccaataatctccaatacccaatgttcatcacagaataataataaaaacacctttgattttacaatgtcccccttgatgaacacattggcaaacccttaaaaatgttttgatgtttggaaaaataaaaacaaaagtggtaaaaagcacacttcgtacaaacaacatctcctttctcaacatgatccctcaaaaagtgaaagcgaatgtcaatgtgctttgtgcgtgagtgttgaacatgattcttagcaatattaatagcacttgtattgtcacaaaagagaggtactttctcaaaagtaagaccataatctttcaaagtaaataaaagccaaagaatctgtgaacaacaactagcagcagcaatatattcagattcagcagttgattgagcaacactagattgtttcctagaagaccatgcaatcaatgatgtaccaagaaaatgacatgttccactagtacttttcctatcaattctacaaccaccaaaatcagcatcggaatatccacttaagcatatagaagatgaagtagaataccaaattccaaactcaagtgtatgatttaaatacctcattattcgcttgaccgcttgacgatgtgaagcacgaggagaagcttgaaaacatgcacacaaacacacagcaaattgtatgtctggcctagaagcagttagatacaacaaagatccaatcatacttctatattccttttgatcaacagcttcaccatcttcatcaggatccaacacagctgtagaactaattggtgttgaaattggcttgcaactctccatcttgaatcgtctcaaaagatccttcgtatacttcatttgatgcacaaaagtaccttaaggtgtttgcttaatttgcaatcccaaaaagtacgataactcacacatcatgctcatctcaaattccctgtgcatagtctcagcaaaatctacaaccaaagcgtgagttgaacaaccaaagatgatatcatccacataaatctgaacgaacagttgattatcaccatgtttaagaacaaaaagcgttttgtcaacctttcccattgtaaaacctttcgcaagaaaaaagttcttaagcctatcataccatgccctaggagcttgtttcaaaccatacaaagctttagacaatctaaaaacatggttaggaaaatcaggattttcaaaacctgatggttgtttgacataaacttcctcctgtataaaaccatttagaaaagcatttttcacatccatttgatataatttaaaaccttttgaagcagcaaaagccaacaaaagtctaattgcttcaattctagcaacatgagccaaagtttcatcaaaatccaaaccctccacctgggtaaaaccttgaggaacaattcagctttatttctcacaatccaaccatcctcaatttgtttatttttgaaaacccaattgggtcc

SEQ ID NO: 25729 - DNA, 3657 bp, Oryza sativa
ggaatttgtactttttccttttacagattaggttttttatatatgcaattccatctattaaaacgcacccagctgtcaaaacaatgacaataagtagcgctgatagatgaatttacacacaacccggatagtgtttttttttttgaatacgagagatattttatcatttgttatttgaaactctattgtgtatttcacggtatagatattccttccatgaatataaatagtgaaatatgacatcttttagtttttttaaaaaataataaataagtagaccgtgggacttcttcctagttgtaagaaaatgagcaaattattctcacggcatatgaactggcaaggtggatacaaatagataaaacaagttgtgttccgtcacaataacttatctggtccatgctaacctaaaccaaaatagagaaaattatgtgagggcgtgaggcagtggcagggtaagctccctaagcaggccgggcggctgcccgggcttcacaccgtgtagctgttaattcctagcgacctattatactccaaattagtgtttaaacatctgatgtgatagagaataaagtttagtccctgtatacaaactacctttgagctggattcccgagcaacttagttgtgggtgcatggcaccaagccttatgaggttgtgtcctaccgcttgaagacagtgaatttattttgaaaatattattattttagtggaaaatcgaaaaaatggtggttgcccagataatttttccaaaatagggtcatgtcgatctgttgtagtttgaccggaccctatcgaatggtggttgttcgacaggtggaggctatcgaacaatgggagtagcgggcagggcctgtcaaactgcggctgttcaacatgtcccagccaccgtccctgtcaaacaatgggcgttcaatagggcccgtttataccccccacccccccccccacacacccttcgcctgggtttattttcggagtaggcgaggaccacatcgccacttccgtcgccggggcaccatgtccgttgcatgggagagagctgcgcggccggaaagaaaggtgggtgcaggaaagagcaccacccagaaaattacaacgatagtgatttaataatcatttctcattgttgaatgctaaatttttagcacgttgaagttagtattaggttagtacgtattactttgaggtgagtagcaatgcattttcaagtagtgaactagtgatcactaagtagaaataaaaatagagtattagtagaaattcataaggagtgacgaattaagttattttatgttagagtaagaacgtaaccaaagggtgaagttattgggtagtaacatagtaagataatttgtcatgttttattaggtgtcatgtgatgtggtcgttcgtatatattatagcaatgctcctatacaaatttgtgatagcagggtggattgaccgtatatgcctttgtttatactagcctaaatgtacactggagcagttggttttgaacgacatgtttgggttgttgtataatatgttactagcgtgaatacactggagcagttggtgtcgaaagacatgttagggtggttgtataatatgttccaggtagatgcagcgttggaaaaaattatcataaaagttgtgtgctagtaagaggagaatatggatggcaggggagagtagtagatcttgcatctaccagaagttggagaaaatttgtggctaaagtaaggagaatgggtatagtctggtaatatggtgtagaagaaaacatatgtttttggaatcagatagacaaacatatggaggtgaaacaaactccaatggaggttgcgcaacacaataatgtttgctggagcagtcaaagtgaagctccagaagaggttattgtgacgataaaggtcattgcgtgtgacagtaattatttagaacgacgatgaaatggaatcacctttggtaactgaatatgtacaatagaaacacataattcatgttaatttgctaggtcctgaccaactaaaaccctacttaaaaaatatttagcggaacagatctcataacattagcaattgaagagcttttccttcgatcattaagcttttcccgtgcatagaatagtctagtagtaaaagttaaaagtatttttgggttaccacccgtacgtccctaacgtacagatgaattattgtgtggtagcatgcaggtgtgcagtacgtagctagtggggtcattgagtatatatgacctaagtgttgagaaagctctccagctcaaccgagaacctccccatgacgagcgatggcaatgaaacaacggtacccacgacattgctgctgcccttgacgttgaccagcaagctcaccgtgggaagcgcccgagctgggccgccgtacaccgggtcgccccacccaaaatccacgcggtcgaaccccacgcgtcggacgtcggtaacgacgaagaggttggtcctggctaaacgcgggcgccgccgcagaaccagacattcggccgtggatcgcacgtactcggcggtgacggccgccttcgcctcctgcaccagcctcaccacgtcttccagcgtgcaaccgcggagcagctccccggcggtcatcaccaccgtggggtacgcgcatgtgttgccgtagtagccggatggtaggcccagcgcggcgatcctgctgaagccaacgacggcgacgaggcgcacctcctcgtccgccgggacctccagcgccgcattgcgagcgcgccagaggaacgccgcgaggacctcgaagctcgtcgccgtgctgctgccgccgcggaggcggtgctcggggtgtggcagtagtgcttcctccttaagcgcggcgatgtcggtggagctgaacaggaaggatcgaacgatgttgtcggcctccctgccgcctccagggaggatgtcgatcatgtcgtactcgcgatgtgggaacgccggcgccggagggctgcgtgcatcgagcagctcacgcgaccatgtcgcgtggacggccggcgcagggaggccaccggcgatgtcggcgacggcgttgaggaactggacgatacccatagcatcgcacacgctgtggttgacggcggtccccacgatgaagccaccacagaggaggcgtgtcacctggattcccaccagcgggcagctgagcacgctgcctcctcggcctgatgatcgcacgtcggggacgagctgatccacgcaggggaatgacggcctgagcccgtgaccaccagcggcggcggcctccatctcttccagccggacgtccgcgtccgcctccacgaacaccaccccctcgccgctgcagtcgatcaccagcttccgtccttccacctctctcagcctgccggcgagcgggtagtagtgcaccagcgcccgcgacagcgccgcgcggatgatgcccgacgggtcattgtcgcggacacatggcgccggaggctgaccaccacggtatacgaggaggccgggaacgtggtagcgcagggactcttggtcgtcgatatcggagaggcgcttggtttcgcacggtgtcgaaaccgatgggccgacgagtaccgcctcgcggcggtgcacggtgaaggacagttccatggccatcgaccgtcgttacggtagtgcgttactcaactcacaacacatgcat

SEQ ID NO: 25730 - DNA, 1248 bp, Oryza sativa
tgtgtgtgtgtgtgtgtgtgtgtgtgtgtgtgtgtgtgtgtgtgtgtgtgtattcatgatatcctataataattaagaacctttgcaagatatcagtgttaaggaggtagattccctcaaagtcgactttgtatcaaccacatgcgatggtgcttggtgtgcctacattaagtctcctgagattttaattctaaacttgtcgtatgtcaagtacaaatggactaacacatgtgaagtatgtacgctaacatatgggactccatgcgtaccatttgaaaaaacagaaatataatacttaatgtatgtacatcaaacttgtcgtatgtcaagtacaaatggactaacatatgtcaagtatgtacactaacaagaatataataataaaaatgaagaggattcggacgaatagtggtcatatcatatcttaaaccatattttttaagcgggtgcatatagtgtacagatgcggattgtttcggatgtcggaaatagtgcagagtctgttaggaaacggattaaatttatcggatattacgtgcgtataaaatcaatacaacatcaagttagcaagcaaggaacaataatataataatcaataaacaacccatcataataattatgtgtttaagtgctaaacaatatgaatacatcatgtccataatataaaaatacagctacacaagggtgacatgagacagtaaaagcctcggactgagaaatctatgttaattgatgaattaggctattggatggaccaacttatgttatatgcaatagatagagtggttacatgttttgataatttcggattatctggcaaacgacctatcggataatttgatagaaaggtcggataatccgcatccgccggattttagagataccgtatcctcatctgcgtctgcatcatactatccacatctacatgcatatccgccggatttctgaaaccccataccatattcttatttcgaacggattcaaagcggatcaaatcagatcggatcggatattacccaatccgttttcacccctacacattactcagagattgcatcattaccgattttttttaatctgcaaatagccattccagctagcactgtatggccgcaatcacagatacaataatatattttattttcctttccacacacacatacacacacgcatatatatatatgtatatatatatatgtatatgtatatgtatatgtgtatatgtatatgtatatgtatatgtgtata

SEQ ID NO: 25731 - DNA, 347 bp, Oryza sativa
cacctcttgagctaccttttggggtgtagcgaggctttctcccggttgggccaatgtctcccgattttgggctaacaagtggtatcaaagccaaacccacaatctctagtgcttgtgcacactcagggtggagtaagcccaaagcccactggaccagtgcttgtgcacactcagggtggagtaagcccaaaacccagtggaccacgggtgtgaggcccgtatgtgcccgtgtgtgggcccggtcagtgctgtgagggcccccaatgtgtgacgtgacggggagattgttaggaatagtcccacattgctaatttagttagagttgaaccaacttaaaagtgggcacc

SEQ ID NO: 25732 - DNA, 1436 bp, Oryza sativa
tcgactttacgcctaccatggggacagatatttttgcacgtgcattaatcgttagcaaacatattatcagttaatattggttttgatttcattttcttgtaatatttgatggaacattatatgctgtcaaatttcatttttctaattttcaagagtatttaatttggatgagaataatataaaaaaagggatagaatatatatggtttaatgtgatatttttttaatcaaaatatcgttgacatattcatatttgtaaattttctatgaaaaggcgagagggtggaccgatcgtttgtatatcaatttaattttttatttaagaattaggcgggaaggattaatattttcgttagtggtacgtagtctttacaaagtacgtacaaaattacctcctgccgattctgaccttcttctcctatgtacgcatgttcgtgtcatcatgctctggtactggccatgttcaccacgttcgtacttaggcaggagattaggaggaaggggttgactttaaaacaaatataatttaatggttaaaataattagtccatatttaaaagtgttggatgtattttttttctaagaatacaccagtaataaattaacggatgcgttaggatggttgtataggagtgtcaatatatatagggcgtgttcgattgctcgtatctaggttggctcgcatcgtgggagcagagagatgcatgtttggttgcctgctcatgtgtgagagcctgcacccgtgggtgcaaaaagcatcgcccagcaaggatgaggagggaagcttaaatcaaccaaacaaaatctccaataaaaagtatatgtaatacaatcaatcaaacaacatctgaccatagcgaggttgatttcatacagataaccaaacagttgcatgtgtatgtccttagccaggcccaactctacctggatgagggagatgaaccaggctacgtggatacgagcaaccaaacagccccatagtgacttaggttctgtttggcatagttctaactcttaactccaagttatctagatatggagctatgtcaaactatacagattctttattttttggaacgcaactagcacagctcctccacaaaattatactacaggggtagaactgaatttttgctgctccactctatttcaaaagacccactaccctttaatttttttcatgtatttacacgatataccactgaactaccccttcacacccctctcctcatgttctctatcctccccgtcttcctcccttgagccctagagcggtgactggcggcagcggtgttgatacgaaaaacacacactggcctgggagatctgcttagctcctgtgcaggtccaaaggttgatgagatgcgagcgtgccagtcagtttgatcctgcaactgacaagatatgtaaacagtagatcaaatagccgatcggctg

SEQ ID NO: 25733 - DNA, 558 bp, Oryza sativa
ttctatgggttggctatggcaccgtaggctagcccatgttggaatgaggaatttggcatctcttctaaaaggggaacacattcttggtctatctaatgtttcttttgagaaagatcgtgtgtgtagtgcttgccaagccgggaagcaagttgggagtccacatgccataaaaaacatcatgactacaacaagaccactcgagcttgttcatatggatttatttgggcccatggcgtacataagcattggaggtagcaagtatggcttcgttattggtgatgatttttcacgcttcacttgggtgtactttctccatgacaaaagcgaagctcaagatgtcttcaagcgcttcgcaaagcaagctcaaaacctctatgatctcactatcaagaaggtgcgaagcgacaatggaggagaattctagaacactcaagtggaggaatttcttgatgaagaaggaatcaagcacgagttctccgccccctatgatcctccccagaacggcattgttgagaggaagaaccaaaccctcattgaagccgcaagggcaatgcttga

SEQ ID NO: 25734 - DNA, 627 bp, Oryza sativa
tcactctgtctcctctctcattatcctctcgcgctcgagtgtgtgtggcgagtgccgccggcggtggccatgaacagtggtgggcgcggatggcagcactgagcggctcggcagcggacgccgacggcggtgggtgtagcccgcggactgagctgttcgggggcgggcggatccacctcggccagccttgcaatgggcggggggcggcccggttgaccgtgaaagcggaggatccctcaaccttcccatgaagcttcgatggcggcctgaagcgaccacgatgatgaggaggcggccgggaggggcgccaccggtcccgagcgcacgccgggcggaaccgcaccgttctggccaacgacgatgaccaggaggaggcggacggtgccgcaagcccccgggcatggatctacgcccgtccgctgccgacaacgaggaggcaacggcggtcgggagcggggccgtccgtttcgggcacacgcgcgccgggcggattcacaccggtgccgtcggattctaggggtcctttttttcgaaattttattttttttgaaatctatttttccatgccggcgacataacccgaccgcacaccaaaatcgaataatcccgcgtgggctacttaaactg

SEQ ID NO: 25735 - DNA, 1601 bp, Oryza sativa
aaataaacaaccggaagttgaaaccgacacagggtcggccggtcagaccgcggacggccgggtccgaccgctcgatcaccgccggtctgaccggcaacacctgcccggtttgaccggtcacatgaaataacagcgatgtcctgtatattcacctgtgaaatccaatcatctccaaaaccactttgaaaataaattccaaataacaaaaccaataatctccaatacccaatgttcatcacagaataataataaaaaacacctttgattttacagaggaaaaagtacgaattacacccccgaactatcgcggtcgaccgaattacccccctgaaccacaaaaccggacattgctcaccctaaactttgaataccggacgaaataccccctcgaccaaatccagagcggttttggcctacgtggcgtacgcgtgggcatccagtcagcattttctcttttttttaatggtggggccctcctgtcatctaactctctcatctcccctctcccctcttcccctctctgttctctctctctcgctattcctctatccgtcgcgggtcttgcggcgacatccgttaggcgatgatggcaggctcacgtgcggcagcgttggcgcggtcttgcgtgcgcgcggcggcctcgcaacggcagcggctgtgtttgcaccacggcgtgcgcgtcctcccccagatgtgttctggcgtggcgggcttatccttggacagggccgtccacaccgtccgcgccgctgttcgcggtgccatgcacgccgtccgcggcgaccacctccttccgttgggggcttcttgctccctcctccactacctgcagctacggcggagatggacagaagaatttgttttttagagatttaattaaggacggaaaaaatcatttgaaaaatcaatcagatagtagggttaatatatatcacaggatattctcctagctactactactacatatatttgttcatcatgcatatatatgatcgggcgcacatatcataagcaaataaatgatcatgcggtgcaagtgcaagtgcaatataggacgtttaaacgaatgcaaggaagcagagagatgcattaacaaatttaaacgaacgcacgaaccgcaggagcgagagctccgtggcgagctcgaacgcgcgcgcgaacggcgtgcacaggggagggggggtgcacaccgagcggcggcgggcgcgctggcccggctgggtagatcaagtcggcggcagacgcgggcgcgggagagggaaccggctggcagcggggaggtggcgaccacgatgacggcggatcaagcggcgccggtgacgggagtttccggattgaggtcacgacggaccggacagctgccatcgcgagtctcccttacatccttctcgtcaggtccaacattgagccgcctcctggccgtccccctccgcggtagccgtccacctcgacctcctcagcgccggccgccgtctgccgtcgcccacgccaaggccaccgccaacgccgccttctcccccggcgccaagcccgtttaccgcgccagcgcgctgtcttcccgcgtcccctcccgaccgccgccacgcgctgctgtgcacgcc

SEQ ID NO: 25736 - DNA, 254 bp, Oryza sativa
acacttagcattacgcttaatatacgccctggctcagtgtgcgtgttaattagaaggccgtctgtgcacatccaccgagtgagagctataaatatgagcctcccatgcccagtagactcaccaaaccatagtaacaattcaacaaccattccatataaagaagcatcgacatcgagtactacacaaaacggtaacaaatactacatgtatatgtagttgtattcgtatttgtattctgtgctttaattggtaac

SEQ ID NO: 25737 - DNA, 4627 bp, Oryza sativa
atactccctttatttctttgatcaatatgatttagctccattttcggttttccccacccaacccctccattttttttattctggtttgacgtcataggcactctaaatgctggcccacacaaaagcccaaaatagattcaaacgaacggcccatagaaagcccaaaacacaaaattgattcggcgtttcaattgtgtttttgcttctatttttatcttgaggagcaatgcagtattttttttttcttacacaggggatggaggcccaaaggacttgtaaaataaaggaaaatgcccacccaaggtctctcaacttgtcatcgagttacaaaatcgtctcccaaccataaaaccagatataaaacatccctcaacttacaaaaccgttcactttagatccttcggtagttttgaccccggttttacctgacgtggttagcgtgggacccacatgtcatgatgccacgtcatcaccctcatccttcctcctttctctctctctctcacatttctcctctgggcaagccgaccggcggatgggaggagatcgccggaggtgagtcaggagaggaggaggttcggcggccagcgacgaggtggaggtagcggcggtggctgcgacgcagaagctggccaccgcgcccgtgtcggacgtccggggtgaagacggcggcggaggcggccggaggagagccctctcctctagtcctcttgaggagcacagccggcaggggaggagtgttgacgcggtgggtgcaccggtggctagtgggggaggagggttgacaaaccaagccatggcgatttgacggtgaggtgccggatagcttaagttgtttgttcagacttcagagcgccttgagcatctcctcgatgctgctggtggtgaaggcgacgccttccttgaggttgagcaccttgaccacgccgtcctctaccaggaacgcgtagcagcgagaccggacgtcgtgcccagcaggcttgtcggggaggtcgagctcgacgcccaaggcgtgggcgagctccccgttgctgtgagagaggaggagcaccctcatcacggcggcgaagaaggcgagccacttgaggaaggtggtgccgaatccgacttggggcggtgaggtcggaggcaagagacgaagaggcgttgagttgcgatccaagttcatttgcacttaataaagtccagcttctgccggagcgaagtggagaccctgccggacatatatatatctcttataagccgccgtgcggcgttgtaacctcaactcaatatagtgaagatattttgctggctggcacccgtggttttttctttcttactttgaaagggttttccacattaaatctcgtgtcttatgtgattgatctattgttatttatcatttgtttgcctatcgtttgctaacaagagggaggactttgttggcaactttttgtgacaagtcgacaagcacgatcgcaacacctaaacgccttgcggtgatatggagtcgccaaccaccttgatctagccaaagggccaaatcaagatgggttttgtgaaaacagctaaaccggctagcgaagccgatttagagatcaaaatcagcctctaggccgatttagatcgatatgaggataactacccgtctcgtgggcaaaacggaaggttttcaggacaaacctacaaagaggtgtcgcactctcgcagcggcggtggacggtttacggtgcaaaccgacaaagatggactaaactagggtaaaatagaaaaacatggtaaaagaacgattcaagtagattgtatgcagggggtttacaatataatgaaccggccttgtcccttaaatagaggttggtcttgccctctacaggcccttctccatgtccaactcaggatagaaaccaaagaaaacacgaaacctgccttcccgagcaaggaaacccgagacccgacgaaaacagactcggactcagaccctgacggtctgtccgcccacatacctgcggtcagaccggccctactagccggtcagaccgcccacacacttgtggtctgaccggccctgtgaaggaaacccgtcactttccaaactttgacaattttttcctatttcgtccataggtgtcaaatttgggtgtaaacagacttcacacttggagccagatctgacgacacttcacacatggagctcgtgattcagcgtcgctggaccagcgagacaagaagcggtgggcgacaatggcgcacgcgagcggcgttgcttctcatggcatacgcgatgaagtacagcacaccggagcgagcaagccaagggcatggtccttcccaagctagagaatcagaaaatgccgctccttgtcctgattttcttccttgtcctcggtgtactttaccccgcggcagcggccaaagagtagttcatcttcaacgagttcaccagcacaaatctcatcttcgatggcatggtgatggtgactctgaatgggctgctcatgttgaccaacaacacaaacaagcaaaggccatgccttgtactagtgcctgccacttcagttccacaagatgcccaatagcacggggaatgcagtccttctccaaggccttcgtcatcatgttcgaggaaatgagcaaccacggcatggcgttcatcatcggcgctcggctccaatgccgcgcggctgctgctcgtggtggagtccgcaaccgctgctcccctccagctcccctgacgacggcatcttggtgcagctcgtcggagttcatcggcgggaagataagagagggggaatgaagacggagagggaggaggcagggccagcgagctcgcccactctgcctgacgcagtgtggggaggaaaaaggagaaggagaaaggaggaagtagacgaggatggcatgtgggcccacatgggccatcaatttttttaattattttctagtgtgactgacaagtgggcctcatgttttttttttagcaaatgccacgtacgtgccacatcaatgacacataggacaaagacctagtcaaaggagccacgtagacgccacgccagccaaaaccaggaacaaaaccacacagggacctcatttgtaccggttttaaaaattgaaggatgcgttatacctgtttttttttcagggacgattttgtaactcggtgacaagataaggaatcttgggtatactttttcttaaaactaggtgaaaccccgtgcattgctgcgggactttagtatgataacaataaaaaaaataacgtgtaagatagctagataatatcagattaagtaaattaatgtggtttatgataatttaaatttaaatagtatgtagaatggtgattcaaatgtaaaaagtaaggtggtatgtctttatggaagaagaaaagtagggagatagtttggaccatagattaatcatctaaaggctaaaaacaattgatgtgatatgacttaattagaggaaaaaagaagaaagataatttggaccatagattaatcatttaagcactaactaagtgaggatgaactatataagtatgtaggatatcataaaacattataaagatatacattgaaacattatgtgaattatgttggatgataatttaacatgtttgtatttgaaaagcgcttaaattataaaaactataaagatatagcatatttgcatgatgtttaaatgtgatgattgttagtggatgatgatgtggcatcttgttaattagtggatgatgatgtggcatcttgttagtggataatgatatggaatatttacatgttaagcttaaagagttagtgggggataattttatagtaagataggataaagcataagcaaaccagtcaaaaggatcacacgggggcttttttttttttcacagtcaaaagatccacacagtggcccattttattgcacaaggtccatataaataagcccaaaatattaacaagagcccgaaacacatatatgcaaaggaaaaagtacaccgaagttccctcaacttgacatcgagttacaaaatcgtcccccaaccgtaaaaccgaatacaacgtatcccccaacttacaaaaccagtgcaaattaggtccctcggcggttttgaccctggttttgttcgacatggcagctgagtcagcgtgggacccacgtgggccccacgtgtcagtgtgccacgtcagcaggccggccactctctttctctcctttcctcctctctctctctccctctctctatcagccttctctctggactgggccggctggcaggcggatggagaggaggcgtcggcagccggtgacgcagcggcggcggccggggcagcggcgacgacgacgcgagagaaggtggtggcgtccctgcgtgtgcgagctcgggaacggagcagcccaggaggcgggagaaggaggccgacgacgggcggggaaaaccgaacgagctccctctcgcctccgacgacgacgagctccgccaagaacgtcatccctccctatcggcggctgcgatgaggtgcgcggcgtcggggacggaccacgctgagcggcggaggccggggcggtcgcctagccaccgcgagacgtccaccgccacgggcattctggcggcgccatgagcccacaatgaccagcaagaggatgggag

SEQ ID NO: 25738 - DNA, 3951 bp, Oryza sativa
gccgcccacctcaccgtctccacgcccgacttcgacaccgcggcgggagccctcttcgcgcgccacggctgccgcatgcgtcacgcggttgaggagggtggggccgccacgctcgttttcgacgaggcgacgaggccgatgccgtgtcgcccgccgccgtattgtcgctgccgttcctctgcctcgtgggcggtggccggtgggggagcccgcgcgccgcttctccccccaccgtctgcgcgctgctcctcgccgccctgcgcgccacccctccccgccgaccatccgcgcgctgctcctcagcgcccacgcgccgcctctccccgccgcccgctcgcccgtagctcctccccccaccgctgtcgcgtcgcccatggccgccatcaccgccgtcgcgtcgtccgtcgccggccgccgacgcccttcttctcccgccggttgaggaagggagagaagaggggaaaagggagagggatgaggctgatgtggtagcctgacatgtggggcccacgtgggtgccacgctgactcagccaccacgtagaacaaaaccgggtcattaccaccaaaggactatttgtgaccggttttggttagttaagggacgttggataccaggttttgtggttgggggacgattttgtaactcgatgacaagttgagggaccttcggtatactttttcctatatgcaaactagtaaaaaagaacatggagccatttatcccacttggatcagatattagccctaaacactagacaaagcctaaagaggtgttgatgtgaaatttcatcgtgacacatgaagacctcggagatcttcttagctctaatgcaggtcctaaactttgatgagatacaaacgtgtcagttactttgattctataactgacaagaagtaaagctgatcggcaaaaaagccgatgtctatcaaacaatgccttggtcctactgaccgatccaaaagatacgtgtcagctgatagccgatagcttgatgtagaatcggctgaagatccaatgttaaatccaaatgattaaataatcaataaaacttttactactatcagctaaaaccaacttgtatataatccttataagccgatgcaacacttaaacaatatccagatgactcatcgactaaaaccccgataaaacaatgattgatgcctactgacttaaataaatctaacttacgaaagcaatcgcataggtcgaatccaacctatcgatgttgtatatcacgactatggtatttgcatggtatggggatcgttgatactaggatatatgcaagattgagataaaagagacagagacaagtatttttatacaggttcgggccccttatccgcaaggtaatagccctactcctattggccgaagccagtgttgctcttattcatcagaatcacacgagtacaatatttgggataacctatctagctgtcatcgacctgacggcatggatctccaacacgtagtcaacgacagggttgtcttcctactcgaatacgaacccaacgagatcagagattgcgctagatccctcttgttggcctccgcggcactagattgggtatgtctaggcttatctctaatgttggcatttggcggtgtgcattggtgtctattctgattgttttctctcctgggttgtactggcatcccctagggggtcttgtatttatacccatagatgtccccttatccaagtgttggcaactttttgtgaaaatttacgtgtaaacaccaagtagaactagggagacaagtatagatacgatcggagtggtccttatagtttccatatagaactctacttgtccttccttatccggaactcattctatatacgacgtatgattccgtataagacttggtataagatggaccccaccgagcttagtcgactattattgcgtatgtgttatccataaccttgacaatagcccccgacttcgatgcaaatgaacgagttgatgttctcggacgaccgagaaggtgcggagtatgcgactaaattccctgcccagccttgatcgagaatttgggttgaagtcaagaaatttcgtcttggcgggcaaaccgttgttttattccataatccttgtcgaactccaccaaccattcttggataatcgagaagctgtagagcctgcgacaaagccctaaaatctgagttgactgttctgatatctgacttttctgaaatcaatactcagaatagattgttagatagaaagagcccccgagcgaacgctcaagggtaacatgatataatgtgaatttgaaaattgaaaataaattgaatttgcacgtgacaataaaaaagtactctcgcggtcttgctagagctgccctcagtaatcggagtatggtactcttcctagtccatagctgtctttatggaaaagtcgtttttccacataggcggcttaaaatcttataataaaccaagctaaagctgcgattacctacccctagttgtgacgttgggaaaaccaattcccggttatgcggcttagttagtacggtgccatgcaccactctgacgtgaccaaatatgacatggtcatttggctctgcaatgcctgacatcaccttatccactctggcgtgtcaaactagcgtaaaaggacagtaggatcgacttcgagacaagatgatataagaaaaagagaatcaatggacaaatattgcacatttatatgcataaatacttacagaaaatgatgcaaatggggtgatgagatggctaccaccaggggccaaaaccaggtgtgtagttgtactcaatcacttcgcggaagcagtaggagaaccgctacaattgttggtcgcagaccaggtacgtaaacatactcgaccacttgaagacgtggagcgaggactgctacgccgctggttgaagaccagttgtagtcgtaactcgactattagaagttgaggtgcgaggacaactatgccgctgtcgaagaccagatgtccataacgctgccacaaccgatgcatcataaggttgataattgcctgatagattcaagcaagccaatatgaaccaaccaaagcggtcatgtattaaatttacccaagacagtaaaaccatgaaagagaaatttaacacatcagatgagattggcaagatattatgtttaaagaaacattaacttgatcagaatatcggaactaaccgagaaggtcctaactaacccaatgtgcctataaacagtaatggaactaatgatagagatgatattaccatataggcagcacttgggtcggcccgattagccggaggttgaactcaatcgatgcagcccatgcacgaaaataagaactcgtcgaaataaaacctcgcgagagggtggcgatgcgccgaaagtaaatatgttgatttgtcgagatagtttacaatgactccagatgtacatatttatattttatacccatagaccgataagagtcctaatcggacacgactcaatttgttctaaagataaacgaagagatataagttctgatcggatcctaaacgctctttcctaaagataaaaaggcagttactaaaccttgcctaattaatagataaaccaagttgccatatcatggtcttcatgatttctttttgaactcggtctattatggataagctttccatccgttaattgtgatttttccttaacagaatccaatcttaccaaattttaacattaacatgaggtgaaaacaaaatggtgggcttgttctagaccttcgaaagtggttcccaaaatagcactatggactcgacacccccttttgtttccttttggaataagttcacctaccgtccaacaactttacgtcgagtctgtatgacatgtcgacatccctaatatccaatacaagaaatcttcacccttcaaatgttcaaaaccatgcaatcaaggtcccaaagcagtatatatgggt

SEQ ID NO: 25739 - DNA, 1034 bp, Oryza sativa
tcctttcctctccaatcttctcgatgcgcagccagcggcagatggcctggtcgccgccgctctgctgcgccagccacgcgctcgcttgcaagctccggccgccgcgcgctcgcccgctagccgcttgtcaccgctgctccgctccaccggctgcacgctcgcagctgcgctgctctggccacctgctccggagccggattaatttggagtcggggcatgtcatgatgtcgttgaattgatggagttgacatgggcaagtaagcaagcgcatggcgcggtggcctagagacacggaggcgcgcccccctcgccagccgccgcagccgcgctcgctcgcctgctccgtacgcttgccgcgatgccgccgccagttgccgctccctcgtttgcggcaaagagaagaacaaaaggagtagagaaaaaaagaaaagagaagatgaaaaaataaaaagaagaaaatggtggatagaagggatgcggacccatgttatttttttcacttacacgtgggaccagattgctgattaggatgccacgtcagcaaaaccacccatacatattgtcatgagatcttgattgcactgttttgaacatttgagaggagaaaatttctgacattagaaattagggatgtcatacagactcgacgtaaagtttagtgacggtagtttaacttattcctttccttttccttttgcacaagctccttttctttttttcagcattgccgttggatgtagatctgatggcgcacagaatcgactgaaaaaaaaaatccaaaattttaagtgattgcagaataggtggtcccaattaataattaagggagtcaatcaatcatggtggaatggggcatgagtccagcttgtgacgtgtccaggaaacaagaatattatgagtttcagtgtaggaattaagggagtcaatcaatcatggtagcaccgcgtaacccgatggatggcgtgtaggaattctccaattggccagaaaagagaatagtcattcatccgtgcacgtcatagtttcagtgccta

SEQ ID NO: 25740 - DNA, 368 bp, Oryza sativa
gtgctcaactcctttggatgaaacaaaccctaaaagactttggctacaacttcaccaagatcccactcctatgtgacaatgagagtgcgaacaaaatagccaataatcccattcaacattcaagaaccaagtaaatagatatttgccatcactttttgagagatcatgagactaaaggagacatttgccttacccatgtgagaaccgagacccaattagccgacattttcaccaagcctttacatgagaaaagattttgtgagcttacgagtgagctcaatatcttacactctcgtaacattaggtgatgggtggttggctacttcatatccaaacatgtatcactaaaatgtaaattaaaaaaaatg

SEQ ID NO: 25741 - DNA, 8425 bp, Oryza sativa
atttctcttttttgtttcaccccatataagttgtattttcactggaatttggtaggatggtgatagatatattacaacttatgtctcaacattttcatttttttctaaatgtttacctagactgaaagcacctaggattgatttgaatatcgagattataaagttcatgcaaacagttatgcaaatggtgtcatccatgactctacaaaattgtagttgaaaatatagcttatataaaaagaaacaaaaaaaaggagaaatgctattagggggtgtaaaatgagcttaaaaatagtttatgggattaaatgatccgacgaaatagtttgagggagtaaaatagacttctttcatatttaaacgcagaggtagtatgaatgaatttaatgcccctcgtccaaaatggctgttgttttagctccacacatacaaaagcaaaaaaaaaaaaaaaaaagcaaaaacacacatttacatagtttgctcctatgtagccatatatataatataatactcaaccaacaagcattcaatggggacacttacgaaacaaaaccagctcacactagacatttagatttaaattcacagtcatcagctcggactactaagcaatcaatcacatgatacaatatgattggcgtattaggacaagtcattggtgcattgtacaaagggaggcacaacagtgcccacaggttgatctgtccaggtgaacagtagcattttgttaattgctaataagctagtacactacctaatgacaaaattcttaatatgctggacatcaattgctatgttacaatcagaaaggagatcatttttggcagtggcacaaattatgtcaggaaaggaccataagaaggatgaagtgaacaaaacacacaaaaaattgtgaaatatcaatgagacataggatggaaaataatcaaatgccaatttgggaatggaagatcctcaatttctctcctatctagttcattattttttaaaaaaagcaaatagtttgatacagatgacaagaaacttataaagaacacaaaatggcacaactgtgtaaaccaaatatagacacagtacatccaaataacatcaggctcatcataatatcaagaaccagacttcagcatgtccaggaaaaatgcagtagtgatcaataacaaaatcaccatcaaatagctgtattttttcccaacacatcaaatcgcatttaggtgatagattatcgtacatttttccttgattatatatatcacatattcctactacattgcaaagttaaacatgtttggtccagctctcaagaaaaatcttcaaacttccagccattaagtttgcccaaattcatttttaagaaaatttaacattgtaaaaaaaagttgtatgtacctaccaaatcccttagtccaatttgtaaaaaagatctatcaagaacctaccaaaccacaactaccagcaaactgacacatgcatagctttctaatatctatatagcttacaaaaaggttacccttggcaccaaagtatgcacataagtaaatgaacatcaagtgccctaacgatcacacaagtatataaaaaacataaacatattcctgtaagtgcactgaacttcataatctccggcttctatcatcaagataccaattctccccataagtctgatcctatgcaaaaacacaaaagagaaatggaggtaccaagttccaacacaatatcgaagcacaatgaaaagtttcaaatcgacatataattacaccaagctcatcaccagtccgaaacagtgaagatacgacaaaagtgacaacttatgcttttcttgcaacatgggaaccctttggaacagcttcaccactaagtgctgccaaatagcaggattctatacctgcttatgagtaagcaaaagatgatattgcactgaagcaagctgccaaagggggctgcagcattcatattattcaattcaacaacgaaaggtgcaatgtttctccttaggacacataattcttgtagtgaagcacatagaacatatacttgcacaaagattgcagaatatggtgcggaatgcactaaatcccatcccaaaatctccttttccaaattacaaaccttaattacaaaatcgagcatatactggccatataacttccataaatcccaagagtacgcaactcaaatacagaaattcttatattttctaaagagtaaatcttatgaagttaccatatttgaaatatgtggtcgaatcattacgtacacacacactgatcatctccccgaacctaatccattcccaaaattccacctttccgaattgtaataccggtaatagaagaatccctaattacccctttccaagaattcacgaccattgtttcatccactaaatttctaacgccccaagaaacaagaaacgtcgctttataacaactcttattattatgaagaagaagcggggggagatctcgaggcagaaagccactcaccgaggtggaactcgtggccgcactgcagcctcgccgtggacctgtccccgccgccggcgaccaccgcgtcgaggcagatcgagcacgggaccaccgccgcggcgctctccccgctgtcgtcgtcgtcggcggtgtcgccccccgcccccgcccccgcggccctcgccccgcctcctcctcctcccccctccctcccgacggccgacgccggctcctcctcctcctgggcgcccatcccggctgcgctcgcggcgttccccaccactccccgccccgcggatccctcccggtagagcgcgaacggggtgcccccgacgaagaacacgcgcccacctgcgcctgcgcctcgcctccccggagctccgatctcgcgcgcgggcgcggcaaccgtctcgttcccaccaacggcgacggactcctgctggctatctgctccgtgtccgtccaccagaaatattaggcaaaaataatactagacgagaataaaaaaggaaaaggaaagaaaaagaaaaagaaaacggcaggaaataaaaagttggggtttttttcgtcggggtacctgggggaatgtttatttgcagcaccatgccctgcccgttttcccttacagtccctggcagtatagaatttggattgggcaagcccaacctatggttgtaaaaaagaaaaaaaaaaggaaggctgatttagataaaccataattttcattcgtcctaaaatatagcagtatttgagtggatgggacacatcctaatactgtgaatctggacaaacacatgtccagattcgtagtagcagaaagtgtcccatccactcaaaggttataatattttcgggcggatagagtacacatttgtggatctaacacttttgagcttaaaggttgcagaagactctagatctagggtgaatcgcaaaatgaatagatctggaatgaacttacacatagccggttatcggagattctgatttgagtataaccactatagatctgctgttgttggtatgccgctgaggaggaggcgccgtcgtgactcgagggctttcatccattcgatggaagttgcctgtgtgggtcgccgacgatgacctgagagttgagctatgttcaaaaggggcacctccggggattgagaataacggcaaggcatagagagatctgcttaccgttgtaaggtggtaggtggcgacggatagcactggcaacggcccggagagtggcggatgcagtaagccatcaaaacgtagcctgagagatcgaggaatcaccgagagaagggacagcgtaacgctagagaagaaatgtgaaggcttagtcggagtgggcaaggtactatgtggtgagagtcttatttatagcgacgacattcataaaaaaaaagtgtgactgctattgaaactaatgctaggaaaaagtgagaaaaatataaaagtaattacaatcatcggattcatagatatttatgatatattctttgttttacaatgttagaaaacaattatcaatatttaatagtgcgataatcaattgccgtacaacttatgcgaaaattgatacaacgcacaaagttaacacaataacattactactattcaatgtcaaagaatactaataatcatttactactatgactttagtaatcgtttttatttacttgaatttgtactccctccgtccaaaaaaaaaatcccaggggcggagccacgtgtggggcaacctgggcttgggccccacacatggcaaaaattttcaatggagaaacactaaaatttacatagaatctgcacaaaaaatttatagctatatggttcagctctactcttgctaaaatgctgcctccgcccctgaagaatccaatactgggtttgaggtttgaatctagatagtgtatgtgcagaacctaactaagattgttttttttatagaggaagtattattttagaattgttaaaaattagaataagagttagggtagtgaaaaaaagagagacgatatgcttaatgtcgaattaccaaaatttgcatcccgtatgttttaattatgtttgtgatgtgaatttcaatatatcaatatgaagataatatgtcccagttagaaaatcaacagaacaagtaggttaacattggaaaaatcgaattcctttatatttttccccttttggttttttagcatcacgagaggaacgacccctgccaaccaccaaaggtaaatctgaaccgttcagggtccaaacccgacgacgctttttgataccttcatctctttgtgtagcgtaagctgttcgcagtgtgagctcacactctccgtccagggatgccgtggcgtggcagggtccctctccagctcagcacccacgcgccccgcgccgcacgccgcgtgtatgacatgcggggcccccctgccgcagccagctcgctcggcgagggtgccacaccaggtgtatgacatgcggggcccacgcgtcgactcgtggggttgcctcggtgctgtgcggtgcggtgcggtgcggttgggttttgcttttgtgagtttctgacgcgaggaggaggagatgccgtgacgacctcgcgatttcctcttttttggtttaaaaaggcccttttcagtttcgaaaactgggtgcagcaaatcttttactacttttcttttcttttcacggtgatgacgccaagaaacgaggtttgcattttgcctggatggctgtggcccacggcacgggactccttttcttcttttttttttcttcttgttttaccttgtttggaggaggctgaacccaatttctgttgatgaccacagggcccatctgctacggtggaaagtgattacgcgaggaggcgtcctccaaagggcgcctaaccgagcggcgcggtgtgcttacgttgggcggcgaaacacctggcaggtgccaccgccccgcgcggcgcacctgcacacaccgcccgcgaggcgaggctgctgctgtggctgcaggggtatgacgtacggggtttcatccggtctctagtggggtggagcggagcgctgatgtgcgacaaagggagggaggtgtgcgagacggatggcgatgtgggtggctgccgcttttgcccaggttgactctgggcgagagagaaccgaggtcgggtcgggtggggtaacgcgcgccgcgccgcgacgcggggggctggcggttgggggttgagacttgagagagagagagtcggtggattgtgggcctccgctcattgggctcaccaactcctttcatattcccgacgtgggccgtgtgatgggctgcgaaggagcgatatagtgaatttttttcatttttaaatttttatttttttaatatttacataaatattataccatccaaaatatttacagaaatggcccctgtcgtccaagtggaggacagcaaggtgtatgcatttttcactgaggtcccttgccactctctgcaagggctaaagggggcaaatgcaattttcgccctgccaaaattgtatttttcaagtttttattttcctcttgtcatccctcacgtcaccctacttctgtaaattttttttgtcgatacaatatttctgtaaatattaaaaaataaaattttaaaatggaaaaaattcgtgatatagtcagctccgtctcagttggcaggacagaccggccatttttcaaaaaaaaaattaaaataaagtctacatcatcaagtataggtcgagtttcatttatatccctcaatcgagaaaccaggtatagatcatcccctcaactattaaaaccagtataaatcgaatccctttgtggtttggatggtggttttatcctcgtgctccttggagtagtgttgcttcagcgagcacaaaagggtcaccactgaacgcgctgatgaagcctagaggggggggtgaataggttgtccctaaaaacttaaaaacaaatcgcagcggtaaaattcaagcagacccggaacttcctggtaaggaacttaaaaacttccagcttgcctggcccggaacttccggtgttctaagacaggaactttcggtaacagaacagagatgaaattcaaattttgaaataggagaataagccaatcttcacaagatggtgcacaggtattctaagcagaggatatatcacagaatcatccacagaaacatcacagaaagagacaagagcgattttttcccaaagttcggatcttgcgatcctactctccgttgaggagctccaaagagctgggtctcgattaaccccttgcctcacttgtgcaaaaaccccagagaaaatccacagccttcaaccccaaacacccctaggaaaatttctagaattgagtgaccactaagatccaacttaacctacttctagaaatccaccacaagtgtggttgctctacttggaaagtctctagaagctcagcacaagaacttcactaacttacttcgttccctttcggaggagaggaaatccttcacaaacttacccggtacatccacaatatgcaacggattctcgcgggcgacacctaaccatctaggagatcatttccaagagtaataagcaccaagatgacagcccacgagatattccaagtgctcacccaagatcctaggcttcacacctctccaaatcttcttctctccctctcaatctctctatctcacaagaattaggctctagattgagtggagaaggcaagaaacacttgggagaggctagcaacagttttaggtttgaaaagtgaaagtgaatagccaagaacgagcttgaaacgagctgaatatgtataccggattggggacgtcatctagccattagtcacaattttgaactgggaactagacagaaagttccggacctggaagacaggaacttccggactacacttaggaaaaactttttcacaagaccggaacttccagacctggaagacaggaagttccggagttgcacttttggacaaatggagtatatgcaaaaatgactcctagggaaacttgacacttggttcacactaagagcacttgacatatctcagagcatcacctggaacccctcttaatagtacggttttttctaaaaacccgattccaaaagataaactatcctatgcacttctcgagttccggtccgctttgattttgtacttttggggggtctccaagcatccatctttcacaccttggactaatgcacctgaaagtcattcaatgaactcattagtcccttaaccacatttgtcattaatcaccagaacccactagggagattaatgcactttcaatctccccctttttggtgattgatgacaacatggttaaagcttacaaaagattgataagaattttgttttggatggttagaggtgaatgaaactcctccttagtgtatgcatatataatatatgagagaagctcatatgcatatattaatgggagcaaccgaagagagtttccttcatctctactcattcgtgggatgcaaataagcagtaagaatagatatgatatgcaaaagatacgacatgatgagcactcaaaaggataaaatcaacatcacatcacaaacaacaaataagacactcatagcataaatgaagtgctgtataaataaagagcagctaagagcatctaacagttattacatccacacaaatagagaattattacatgtccataagatcttaagagtagaggccaaaggactgccaggtccggaacttttggataaaatacccggaacttccggataagctgacatgaatataaagcgagggagctgccaggtccggaatttccggataagaggatccggaacttccggattaaacagacagagcaggcagcaagcatcaaaaacaaaattttgacccccttcgattgcaattttctccccctttggcatcaaggcaccaaaaagagacaaaatcacaaggaaagaagaggatca

SEQ ID NO: 25742 - DNA, 16173 bp, Oryza sativa
  unsure (1)..(16173): unsure at all n locations
tgcacagagatatcatcgttgcaggtatttaaaaacatttttttccaaccagcgtacaaccactatcactgctaatttctactcaaaccaggggtgataatgggattccaaattttggtatattttttctgcaatataacttaagaaatattttgtattttcctggatgtataaattgtctcacatgattgtatatctctctctccacatttagctttctacttccttggtcctaaactgagcacctctaattttggagaagtcaacatatataaatttgactaataaagaaactagcagcatataattttagtgattagatttgtatttatgatgatctttaccttcttataattttattaagaaagcagagaaaaaggggaaacggtgaagggagcagtgcccacccttaccagaaccaccaacagaacttaacctttacataaaaaacacgcacaactaaaaaaaatgggcctagcaatctactcttttcattccaaaatgataatcatataacttttttgaggctacttctaaataatcatcatatttatgttcattcatttagtgtattcgttatttatgcgttagagtaaatagagattgatgcatatacacatgcacacaagtattttataatcagtatgcaatatcttgatttgctataggctagaaaatagtgggtatggtgcatgcatcgggtttattgtcggagtaaatataatatgagagagttaattattagatttttttactagtgtatgattattttggaatagaaggagtattaaaaaactcaatggccatgatctaaatggtacattcactggccattgtttgctagggttcaaattttttttgggtctatcgaaccaccaccccaccccctatacaaaatttccggggccaaatttttttggtttttttccctctttttgttaatttggcaaaaaataatgttcaaatttcacaaaattatgttcaaaaattcaaattacccaaatagaaatagcgaaaacgaaaatttgaaccctaccatttggatgaagtttagttgtaaagaaataactatggagcaaatcaaacaatttgaggtatgccaatagctgagatttagttaagcccacgtcattaagaaatattcaggcactggattatatcctaattatattaattattagcaatttgatcatcccattcccacggcctttcctaacatacgatcgagtaacgcatgaggtaactcagcccggatccttcgttggcccaacttgcccagcccatcggaaagaaggaaataaacaagtctggaacaagttcaccggagtttgcctggggtcccttaaacccaaaaccagaaatgtatatcctaaactttatgaaaccgtgcaaaaaaaatgtcccaggcagtatggatctctggtttcactggcgtgacatcctagtcagcaataaataaataaataaaattatggggcccacatgtaagtgaggtgaaaaaatgtggacccacacttctttttccttttcttttctcttttctttcttctcttgatgagggatgtgggtcccgatcttccgataggtactaataaacaatcgatttgggcggagtcgtgacacaacttgatccggcttctgaacgaataccctactgacccccgcaatcgtaccaccacgtctcatctggttatcaaccgtgccgaaacccggttgacctcgttgaaaaggctaatccctgcatgcgaattgaataacagaagcaagattaagatagattgcaatacaatggcatatgaatgattaggcactccaatttggggttccacaaacaatctagcggcgaaactgttctcgacaaaataatctaagcaaaacccgactctaaacgatgaaggctactaaattaatatgattaggagcgttctagggttgccctagggcgcacacccccttgggctaagcccacgacacaattacaaggcccaaaacacaaatcagattcggactggatgagatacgtggcttgttttgcagtttcccgatagctcggtaggaattttgacgtgggatcaaaaccatctgaaagtagactccataagctttccaacaagtactcatgggccccgaaattccttctggatcagcggctaggtccgtttgaagttgatgctgtcaggaggcccaaatctaaatccaaaacgtgtacaacttaatttcttgtcttctatgggccaaaagtgacgtggtgaggtagaagtagacttggagaaggtcttggtttggtccacaatcaacttctttaatcatccatgtatttgttatgctcggtctcttttccttcgcccaagcaagtatctctgcaaatgaaaacacaaaactcattgtgtagcaacgtttgttcaaatatataacaagtaaatctaatgtagaacatatgcacctttatttaattaatacataaggtagtcatggttatatccgagctagttatgtcctcatcacctcttctcttctcttctccggaggccggcggcagcagagggagcctcggagagagggggcggcggcgggcagggctgcggcgtgcggagcggccgctggcgagcgtggcagtgggcggctggagagggggaggggagagcggccggtgagcctgggagggaggagagggggcagcgacgggtggaggagccgcgagagaggagagagagggggccgagtaggtcgagcttcactcgtgagtcgtcggcggcaatggcgtccctccgcgcggtccccctcctcgtcctaggcatggcgctgtgcgtactcgcgttgttccactcagccgcctccgcatcctgttacctccgccgccattgcgcgagcttcgtcttctgcgggatagggtagagagggggctgagccacctgagcttcactcgtcggcgacaatggcgtccctccggccaactgctgctattgttgctgatgcggcgtcctacatctcaaccctgctcgcgccaccatctcaggcagctccacggcacagtccggcacccacagcaacgacgtcagcagcgccctcgccgtgcgctgccccagctcctctccctccccctccccgtttttccccccgtcgaagcagcacgagaggcaccaaatgcggcgacctcgcctccctccgagcggcagtggcgaccttgtgttcctccgcgctcgcccatccccgcctgcctgcttntgccagcaccgnncgcacccccccccccccccccccgcgccggcctctcaggctcggggggggggaagaagagaagaggagaagagagaacaaagaaaagagaagaagaaaaaaaaagaggagaagagaggatgctgacatgtgggtcccaccatatgccacatcagcgaaaccggagaaaaattagggcaatacttcctagggaccttttttgcacggttgtgtatatatactaggggtggagatgtctggttttggggttatgggaccacagacaaactcgacgttaagttgagggacctccagtgaacttattccaacacgtctcaatcttcatcagtatccatgagcgcagccgttctctctcgtacttatatatagttgtaatccaccaagtttaaagctcaacatgcaaacataattacttatgaaaagatcatgtaagaatggcatatcatatataatttattgaattctacaaatcaacatgcaagcatatccaatcatcacatctcacatcatttccacaatatttcaacatatattcattcatatattctgcattaaagcgtagggtatcatttagtttgttttatgattagtactataaaccctggcttttcatcacttttttccgttcttccatcttgtgatgcaaatcttggccaacaatcttatattttaactacaatctcctatagagtctattaaatttatatatgttctacaatctcctacatagtctattacatttatatatgttcaaatatagcttgacaaaccagtttttttttgttaatagctaatatcctttttattctatcctcaaccattgaaaaaaaaacaatattgatgattttcagtatttccatagcaaagtgcgggacatcaactagtacttgatatatattcaaatccaataattaagtcgtaaaaaaataccatgatgcaaatcaaacaatttaacgccaaattgtatgcatgtaagccaagtgtggcaccaagatatacttgaaagttgaaactgggaaaatgttccctgaatctgcttgttctacttaacaatagctgaaacaggtattctaaacaactttctgttggcccgtcatctctagtttgctatctggcaggttacttgtccatctttcagcgtttggagtttgttctgcaaaaatccaaaggttcagacagatctgctaatgagctgatgcagacactgagatgccctgtcatgttccggggcttgtaatggtccaacagatgcaacttcccaactaattatatccagataattttatttggcaagaagggaacagataaataaaattacatgtcacagatattagttaccattaattttctgctcccttgcgtttcccatccacagagaaaagttgctagatgtattcttagctttgtttttcctgcagtggcaaaaaattggaggtagggtgtataaacttatgcattctaattaacattataattggagcattgtgtagcattgcactgatctgttttcaaataacagacaactttgactagctcactactactaaaaggatttttttcgtgcggtcaaaaagttttttttccatgcggaggtcttgcccgtctacaccctacaccctggtgtctgtgaaaataaatatttccgcatacgggcagcctaaccgcacggaaaaaataatcttcacatgcggtcagtttaagtagaccacacgggataatcggatttcgtgtgcggtcgggttatgtcgcccgcatggaaaaataaaattccaaaaaaataaaaattcgaaaaaaaggaaccctagaatccgacggcagcggtgtggatccggccggcgcgcgtgtgcgcggagcgggcggcgccgctcccggccgccgttgcctcctcgttgtcggcagcgggacggcgtagatccatgcgcggggggctggcggcgccgtccgcctcctcctcgtcatcgtcgttggccaggacggtgcggatccggccggcgtgcgcgcggggccggtggcgcccctcccggccgcctcctcatcatcgtcgtcgcttcaggccgccatcgaagcttcatggggaggttgagggagccgccgccttcaccgtcaaccgggccgcccaccgcccattgcgaggctggccgaggtggatccgcccgccaccgaacagctcagtgccgcgggctacacccaccgccgtccgcgtccgctgccgagccgctcagtgctgccatccgcgcccaccactgttcatggccaccgccggccgcactcgccacacacactcgagcgcgagaggataatgagagaggagacagagtgagagagtgagggagaggtgagagagcgagagaggagagagtgaggataaggatgaggatgggtggatgaggataaaattttgaagtgttgagaagggaaaaaaggaggaatgatagactcataggcggacctttaaaaggcctcttaagggtccgcacacgaaaatgggttcccgatttttgcagatacacgcgaaacggtgtgtctacaatctaaagagcttgtaaaaaaatcgttttcgtagtagtggctttattatttaaactttgatcactaattgctttaacatggttagactaaagtgtacgaaagttttaagcttatatttggttggactgtggcttttgaaaaagtagctgtgggctgtgacttttgaaaagtagttttagaatagtagctgtgaggaagctaaaagctcgtttggttacacacaagtggtttttgaaaaagtttcttccctaacgagtagaccccacgtatcatgcacaggtatctttctcctttctcttgagtcttgacacaggaaggcaggggcgccaacaccttcgccatccacggcgagcctcgccttcgggtgcgccatggacagcaacatcaagcaactgtggtgagcttccggggtcgtcaggctagggaggacgccacaatgccgcgccgggaagaagagcacgttgctcctcggcgactccgagaaacacgctggcgtcgggtgcgccatggacagcatgagttggttctcctccacgagattcagatcggggaactcgataatctcgtactccttgccgttcgccgcgcctccggcactaatgccagaaaaaaattaaaatttgattcaatttttcttccgaatgtttcctgtctgtgtgatctgtagaacttatgctgctggggttcatctcgctgctgctcgtcgtgttccaagaccgaggatacgcatcgccgagagcctcatgggccactggctgccttgccggagcgacgggaaggcgtcgtcgaactcgcatcacggcgtcaccgccccgtcggctgccgtcgtctccggcactggcgcgaggaggctgctcggagaagggacagccggatctgggcaccgttcgacgtccccggtgcgcacgccgaggcggagcgactgggcggcggcgacggctcgtcgaggcggcgcggcatcaggcggggtctgcggggaggagaaggggcggtgccggggagaggagctgggccggcgtcgggcagggagggcgcgcgtgtgagaagccggaggagacgggaatagattagcgaaccgttttctttaataatatcagaggtgggtaatttttttccctaaaagcaagtgaaaggacggagcagaggtgtgatgaatcacaagcgaaaaatggaagtaattgtgaagcaaactggaatcggagaacagtaccgttctattgtaagaacactacaatttctcctcaattctctctgtacttctatgtgtactagctagccagccaattgttgatccgtcattcatcaatttagggcatgtttagggggagcttatagctgctgtagcttctctcagaatcagaaactctatacaaatgcatttacaatactatagatgtattttaaaaaatatctaataagtgtcttatagtgaattgtctctattaacgaagagacattttataaaatatctataagatagtagaggcattttctagagacattaaactgtagtgaaaccagtaaaaaaaagtataaaatatctataagatagtagtggcattttctagagacattaaactgtagtgaaaccagtcaaaaaaaaaaggaaagtaaaatagttttcttgcttttgttgagccttgaacttgagatctcttggacaatcattttttatctttaatgcactaaccaactcaactccatctttaatagtttaatgcactaaccaactcaactccatctttactagtgtgtttgtatctttagttacttatatttagtcatttagtacacattatcattttaaaaagtatctcagcatagtttaaaatgtctcaggaaaatgcctttacatatcagacgcattttacagtgcccaaagaatacctctacaagataaagtctaataaactgagctaaaaatgtctctagagttaaagttttctaggcaaactttaaagagcctctgtaaagtgtctctacactataataattctgatcttggaagcaatttgcaaaacgcctctagaaaagtgcctctataggaggtttttgttgtacccacacagtccagcttttagtctagattctaagaagttgtagttgtagaatccagaaaataaactagaagtcagaagctgggaaatctagcttttccagattcttagaaactggctaccatacagctgcttctaagaatcttaagcccctaccaaacaggttgttagtgtctgaaaaatcatgattttaatcacaccgccaaaacaaaatagtaaccgttccagggacagggcatagtacaactttatacctgccttcatttgttaaacatataaaaagttcagaaatttccatactcatactcaaactcaggggcaatcttatctttttttaatttctctcctcttttttccatgaaattattaaataatgccatggttgtcctataaccaattacacaattttttggtgtccttagtaatgacacgattttacaatgtcttctagccaattagaaaatttcacatgtcctgtagcaaatttttcctattaaatacgtactaatttagaaggaaaatgagactgactagaatcagctggaacttactggtcttacaaagagaatgagagacctgcatgaatataatcaatggaccttcaaaaggttgttgaaaatttgagaagcagtaatttggagacaaagttagccttgaaatgcaggttgtgattattgtactgactttatattgtttggatcatcgtacaacttggtagtcagagctgatgctgagttagttaaaaatgaaaaatgtgaaggtaggcactgcttaaacaatgaaataaaaaaaattattgcaagacaaaaaggaaattaaaaattaatatgctcaaccaaacatggcaccaattaggtaggagactattacatgtttgaccgtgcattttgtctaattgtaggctggaagacgtaccatccttttcgagctgcatggtttggatgcatccgcacgaattatatttaatccaacctgttgtctaacctaagtagtttaattccccaaaaagcgatccatggctatatatctgaggcaacaaagaattacttcaatcagccattctgtgtattcgaacacattgtcgtctgcgtaatcaaaaaataattcttttaatgatatgaaaggtccgaatactttgcttaaatatcatatggtcataaaaatatgtaattagcgtgaaacaaagtaggtccacaaagaatgagcctatgaatcatgagaagctagtacataaggatgaaaaaggagcacataggaacggataatgcttacaccatatttgtttttgcaatttttagccggacaaaaatggaatataaatagcttgaatatgaaaaccaaatatgaattatctcaaataaaaataagtatcaaatatgatctgacacgaatacataatcagatttgtctcgaaacacgaaaattaactgaatttctaatagaaacgaatacatcacacataattacctcattttatagaaaagttttgtcatagactaaataataccatttaagttcaacatgaatagcattagtggtataaatgcatgcctaactaatattataacatataatatacatcataatttatgaaaatatttaaaagttcaaataatattaatagtgtgaactaatattctgtgatgggctactattaaaatctaaagagatagaccgaatttaaggactaaagttagcaacaaaagagttatgtttcatgcctttggtatatatctgaatcacttcaccagatattcgtattattattcatattttacattaccatattcctaatcttatccagcaaaaaatatgtgtatatgtatttgtatccaaattatctgatgaggaactaagtgtcgatcttctggtaggtattgataaatctcgatttggtggaaacttgacatacacgatctggcttccgattaacacgacacgaaccttacaatcacaacaccacgtttattttggttatcagctctgtcaaaacctaattgacctcatcgagaaggctaattgttgcatccgaatcgaagaatacaagtaagaacaaggtagattttttttagataatggaacaataataaggtagattgcaactcaatttgcggatgaataattaagcactataatttggggttacacaaattgaactagcggcgaaaatgcaatgagaaaaataatctaaccaaaacccgactataaactatgatgactactgaataaatatgattagtaacgtcttaggattagccctaaggcgtccaccccttgggcttagcccacgacacaattacaagacctagagcctaaatcagactcagactggataatttacgtggcttgttttgcatattaccgatagcttagaaggaattttgatgcaagaccgaagtcatatgaaagtagactcgataagttttccaacaagtactcatgggccttaagatttctcttagatcagcggctaggtgcgtttgaagttgatgttatcaagaggcatgaattcgaattcaaaatgtgcagaacttcgtctcttgtcttctatggaccaaaagtggtgtggtgatatagaagtataattggggaagatctcgatttggtcctcaatcaacttaatttttgttatcaactttacaaaatttattatgtcatccatgtcacatgttttttaataaattttaaggcatagtgaagcaatcgatagtattaggttatgtagctattcatattttcacggatacttgttattgttgatacagtagaattactatcgaatactcattggtgattattttataaggataattttgaagaaatttttttattctcatatttttgttaccacacattttatgggatgtgcttgaagtgtctagaacatcccaggacactatttgctttttttctacttatttttctctcttttaatcgaacggttctcttcattcaaatcgtgcatctaacggttcatatttatttgatgacgtggctcttcctggtgggatcatgggatacccttttcactaatgtaaattggtgcgtaattaaataagagatttcaagaggcctagtacgaggttgccttttttttttttacggagggagtatattagctgtgtacttttgaggagttgggaacccctttccttcgcacacaaaacataccaacagataaacgcatagttaattatgtgttagcttaaaaaattgaaaactgaattaaaatgatttttatatcattttttctattttttcaaaagaatacactgtttagtcacacatagagtactattcatgttttatcatctaatagcaataaaaatactaatcataaaaaattttcaaataagacggacggtcaaacgttgaacgtgaatagtgtaaaactacacttattttgggacggagggagtagtttaggaaatatgcgcgtactaaactagggagtgaggttgggaacctcaaatcaagaacacaggtcttaaaaaatgcaaaggttccggatctgtagttctgtactttttttcctgtactgtgaataatgattagcaggttgtattgggaacgaagcgatttgccatcaaggtacttttctctgaaaggtttagttccaggtgtactgtgtaattaaccaagctgattttttgcctatttgaagttgaaggcttgatcgttgcattcgacctgtcaatcatactttaatgcctttagtcccagcaaattgaccatctgtttgtacacagttttgaaccaagcttggatggttaaggtggtggttgacaggttgttgtactctaccctggtttgacgtcttgtgtgtcacattgatacaacgaattctttcagaggttcagggtatatatgtggaaaaaaatgtttatagtgactgttaatcttaaaatctgattatgtaatctatttattcattggttttcatatggagtggtcgagtgtcccgtgtctaaactgactttatattcgttttaggaaaaaggaactgcttgtatgtttttattggtttaaatagttaatctcaatattctgtagaatacatcatagtaacacgaatctaaacaatcaatatttaattatacttcctctagattttttatatgacgttggctaattcaaatttataccagctaacgtcatacatatacgtatggagatagtatttttagaacggatatattatagctcaaatggcacggcagaattctcctaaatcggaacttgattatgcatttttgagtttatgacagacactttgacaaattcaaccaatgtgaaacaaagaaacagtcttccagtcccatcgtttggcctaaacagccaaagaataagccaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttgggtaaaatggcaaccgatgggagccttccatcgggcagctgctgcgttgggtcagctataccgtttgtgaaagtagtatagggtagtaaaaattcaacgaaacgatattttttttcctcccttacccgacaaaacggccaaacccaaccgcttaccataaaagaaagccccccgatcccccgcaacatccatccgtccatccccgatccaacggccgatccagcttcacgcgctttcgatcgccataattacgcaggccgccatcgtcgtcgtcgtcttcgtcgtcgccattatccccatttctcccgtatcctctctctcctctcctctcttttcgagcgcggcggcggtggtggggaggaggagggccagcggcagcaagcggcggcggcgacgcgatgatgatgacgcgggcgtcgatgggggcgatggaaggcgcggcggtggacgaggtggtgcggcgcctcttggagggcgggcgcggggggaggcaggtgcagctgtcggaggcggagatccggcagctctgcgtcgaggcgaagcgggtgctcctgtcgcagccgaacctcctgggcatccacgcccccgtcaagatctgcggtgagcgacgccccctccccttcccaactctagccctgattcgtgttcgatttggcgcgtgagggtttgcgcatttccggggcggaattccgcgattccgattgctgaggttgggtttgtttttggggttgttgcgtctgcgccgccgccgcgttcgtggggtgggcgattaggggcaaatgctgcgtacatgcctctccggttcgttagcaaattagctgtttcctaggaagacctggtaaaagtaattattcagaagaaaaattgaaagaaagaaccggtactgtaattttgcccaattcaaatggttgaattgttcctggttggtgcttgttcgtggtggtcaatggtcggaattggtacggtctttatacacttttggtgcacttgttgttctcttcttttacatttctggaagagaggaaaccacgtattttttttgttagcctgccggccctttcactggatttgtgctgactggttactgaaggtttgaaatgttagcatttcagcaaactgtcggaccatctgttactttgggcattgagagagaatcctgttggcgaagtctgttgattggtgttggaggtggtagtgttccttcattgtaaggaacaccacattccttttttttcccctttggctttttatagattattattaacttcagaaagtccagagacgtggctgaattgatgggtagagatttgtttgaaccatagaataaggtaatggtgaccaaagtaaaggttggagacttggcatgtacgcagtatatgagtgtaaattgtgagatgcaaagaagatctgggaattgcattttatgcacaatatgttgtttgagtccaatcttttgagttatgttctgtgtcacgtcaatcttcagagtgttatatcattgttcttcagattaaggaagaagtagtctgacatgaggttccttgcataaattaaatttgctcactgctatatccaaggtgaggaaaaaaagtgcaaaattacccaataaaaacaatttgtgcttgcttgcatagtgtggatatgacccaagctctttgggttgctggtctggaacatgaattagttcccaatccaaagggattgggttaaagccctccttacatgaaaaagcctaatggtttagggcccctttgatttgtaggaaaaacctaggaattttagaggatttcagtcctatagaaaaatttcctatgaaggcctttgaaacaaaagattgaatcctatcctatcctttgaaattcctatggaatggacgatcttataaatattttggaggaaacttagcaagaggtccaacctcttggaaaatttcctttgagtctatctctctcatccaatttctgtgtttttcttgcggtccaatcaaacgatatttcctgtgtttttcatgcgttttgcagtcctttgttttgcatttgcatgcctatcagcatattgtgtttttcctgttcctccattttttcattcctactcaaagggccctactgtgtgtggctttgttaagttcgacatcgttatttagatgttctatacctggggggggctcagattaattttttcctctactaaagtgcaacttctaatatagttccatgctgcatcctttcttttcaattttcatgcaacccagtttaacagcttatttaagattcataatgttaatttggtttcaaaatggtcaagcttttttggtgatgctacaacagtaacagtaatgtagtcttattcacaggcaaaagctataaatgctatgtttcattcagacaaatgaaattgcaaaaacactcatcgattcatggactgttatagtttacatctttgagatttggcaatagcttgtgtagctgaattagtaatgttgtaccatagggatggtgaatacaaatgtcaaattggaaaaactgaccctttgacaacctacagcatgtaattagctccatttcattctaagtttattatgttctgaggtgtttttattgatattctatatcgtttgctttgaagtcctcactaaagtgatctggaattctacatgcatacgtacggttgaattctttgtatcttttgcacactagcaccatgtcgatgtgttgcaaaggataccacctaaagatacaaataagtctaagatgtaaaatgccataaataattccactatactcaaaatcggatacttacattactatatggtactcatctatatacaatttttttatataaacatactatgatacgaacgacacatccatacgtacatagttacagtcagaaaacatctaatattctaatgagtagaacctacatcatcctccaattccctcttgtaatgagtaaaataagatctattgacattttattatcattggtcgtatgtgcatatttagacttaccgcagtacataatttaccatatttttaactcgtgttgtggttcagattgtgctattaaaggaacattcatttgcatgcaggtgatatccatgggcaatttgttgatcttctgaggctgtttgatttgggcggttatcctccaacttccacttatcttttccttggagattatgtggacagaggcaagcaaagcttggaaaccatatgcttgcttctggcatacaaagtgaagtatcctgataagattttcctgttaaggggaaaccatgaagatgcgaaaattaacagagtgtatggtttctatgatgaatgtaagaggccgattcaatgttcgactgtggaagattttctgtgattgcttcaactgcttgcctatggcagcactcattgacgataagatactctgcatgcatggtggcctctcacctgaactgaatagcttggatcaaataaaggatatcgagaggcccactgagattcctgactatggtcttttgtgtgatttagtttggtctgatcctagtcctgactcagaagggtggggagagagtgacagaggtgtttcctgcacttttggtgcagataagcttgtagaatttttggagaagaatgatcttgatcttatatgccgcgctcatcaggtaagcactaattattttgatctttattttgtctgttgagatctatataacaatttcagcatgaatgtctttaggttgttgaggatggctacgagttctttgcgcaaaggagattagtgacaatcttttcagctccaaactattgtggggaatttgataatgcgggtgctctgttgagcatagatgaaa

SEQ ID NO: 25743 - DNA, 13399 bp, Oryza sativa
gcaacgtctagataacttatcggctagcaccccgataaaacattagcatgaacctatcggcttaacaagacttatattatcaacaacaatctagtaggtcgaacctaaccgatgcagcacgagattgtatatgataatctaatactcgatgagccgatagatctgtctaatgtgatggatataacaaatctatttataacagcattgtgattgtagagatatatcggctaaggcagaagatcagacctaaccgagacattcccaactaaaccgatgcgttctctaaatacaatgcaactagatatagaattgagatatcaggtaggcaaatatatcaaccaaaccagagcgatccaagagatggaagcgatgtagccttgaacaacaccaatgcagccgatagattcaccagggccagcgaaacgtaggacttaccccttcgtcgaagatcgaaatccgatgcagccccgtgtcaggtgccaaattccgccggttgataagtaaaacctcggtaaagagggtggcgatgcgccgagagtagttgtattgatctatgtgataatttacaatgacctcgggtgtacatatttatacccattgggagatactagtccttgtcggacaagaaagaaactctcctaaagataaaaggaaaacagaaagtccttatcggacactaaacacactttcctaaagataaaagaaaacaaactattcctaattaatagataacttgccatgccgcattctctttaaactcggtctcttctggataaacatcctttagtagatcaatttccttaaccgaatatagcaagaatctaacaactgacgacttgataactctcatcggctaatctcaggacttcgaagccgatgctgactctaagccgatgattactccggacttaccaaattatactgttaacaggcggcaacggttacgagtggtggctgtggcgggtgggtggcgcacggggttctcaggcggcatgctgggtcagcgtcggcaaaggcggcaacgcggggggggggggggggagcggcgttggtgtcagcatctacaggggatcgagagccgcgtgtggtggtacgggttgagcagcaacggcggcgtgcgggctatatgcatggttattaccatcattttctatatgcatggtctcttcatgctctcatatagtttctgtttttatatttgtttctgacttgtgaactatttaatcccacacgatttattttatcctttccacaaaatataggaagttaatggtaaggctagttgacatgtgaaccctttgtctcatatgttatttaatttttacttttaaaacggtagagttagtggggaagttttaaagtagtataacaaagtagctggttggactccgcaatagcgtggctagcacccaaacaaaatcatatattcttttagtatgattttacttaaaatttattacatagctacctcattgtgttaaggctttgaaagaccaaacctcatcatcatcgtgtttgtaatcatatagtttttaaaagtcacaaaagttgctaccccttatgtcatatccttctttatttgcttactcgatctatcactatttttattcattcttcttggaacctttaaaaattggattttatagtttttagagtttatttcacattgggttttgtttttataatttatagatgtcccatcgaacatttacattatactcctatacggcctgttcactgcctcttctctttattgtcattaatattttaaaaatcaaagataattatcatttgagttcatttttactttctaaaagtcccgccaaaccgtcagcagctttgccattgtactcctctacggttcgcccactgcctcccttctttattatcattgagattttaaatcaaacatgattatcgttgttttttttttactttttaaaagttctgaacctttaaaaattggacttatagttttattttttataatttttagaagtcccatcaaacgatgccactgtgctcctctacagcccgtctcctgcccactctttattgccactgtgattctaaaaatcaaacataactatcgctggaatttattttttattttctagaagtcccatcaaccgtcggcggctctacaactatactcttatgcaccctgcccgctgcttctctttttattgtcactgagattttctaaatcgaatatgattatcaatgggtttttttttactttctaaaagtctcggcaaccgctttacttgtttgctttatggcatgcctgacgtccctcctattaatcgtcattagaattctatttggtgttttattaacaaattttatatgtcatatcaaccgccaccactttactcctttataggcccgttacttaattttatctcatcatgtgttttagatggtattttttttcaatactttatttttatcacaatttttatttatttattaattgtattcctaattgaaatcttatttttcttttttctaattttagaatttattttttttgaaaaaaattagttaataccgtattgtgttcttttaatgtttttattttttattttcaactagaaaaatgcccgtgcgttgcaacaggtgaaggctattttaattttattatggtttagctaaggttaaattcactgttggaatttgtttggatattctttttacaaaatcatgagccgcaattaagggtccgatcatctcaagttagcatgcaagttttttaaagagatttcttatacgactccttctgtatttctaaaaacgaacaaaattaaaaaccgactcaaacacggatatgtatttccaaaagcgattgaatttaaaaaccgattcaatttaaacacggatgacgtaccaaaagtaccggcaaaaacatcttcaatttttataataattgagatttcagttgtttcaaagttgtattcctacttgaactctcttttaatttttctaattttggatattattttattttttattcgaaattttaattaatctcgtattgggttcttatatggattcttctttcaatattgcttatttttaattccgtatttcagctaattttaaattgtattcctacttgaactcttcttttattttctttttctaatttcggatttatttttaattttattctgaattttaattaatttcgtattgggttcttatatggactcttcttttaatattccttatttttaattccgcatttcagctatttttaaattgtattcctacttagactctcctttcgttttctaattttggattttattttttttatttcgaattttaattaattattgggttcttatatagaaacttcttccaatattgcttatttttaattccgaattttagctatttttaaaatcgtatttctacttggactctcttttccttttctacttttggattttattttattttttttcgaattttgattaatctcatattgggtttttatatggaaacttttttaatattgcttatttttaattctaaatttcagctatttttaaatcgtatttctatttggactctccttttctttttttctttttctccgattaatgtgggaatttctagccccacagcgaacgtggtgcttcctttcaaagctgttttaataatataactagcatggtggcccgcgcagattgcgcggctagcatcattatattttctctcatataatagcatatttgttttctcattatattattcaaatatattaaaatgacaacctaattttaaattttgtaataactttataaaactactaatgtgtaatattcatattgtattttatatacgtgttagttattaattatttttaatatcaaattttagttatttgtaaattataaatattcttatatggactctagactcgtcttttaatatttcttttttttaattccgatttttttgtaaattatatttctatataaactctatgctcttttttcaatattatttatttttatttctgaatttttattatttctaattgtatttctatgtggactctaaactcatctttcaatattctttaatttttaatttcgaatttcagttacttctaaattgtattcctatattgactttaaactcttcttcccatgtttttcttaatttcgaattttatttatttgtaaattgtatttttatacggactctaaactctacttttaattttattttgtttatttcaaattttagttagttttaaattcctatatggactttatactctacttctaatattccttattttttaatttcgaatttctattttttttcttaattcttaattgtatttctatatggattctatactctacttctaatattccttatttttaattctaaatttctattatttcctaattgtatttctaacctagactctatactctacttctaatatttcttatttttaattccgaatttcaggtatttcctaattatatttctatatagactctatactctacttctaatattccttatttttaattcctaatttcagttatttcctaattatatttctatatggactctatactctacttctaatattccttatttttaattctaaattttagttattttctaattgtatttctatatggactctagactcctcttctaatattccttgtttttaattccgaatttcagttatttcctaattgtatttctatatggactctagtctcctcttctaatattccttatttttttaattccgaatttcaactatttctaaattgtatttctgtatggactctagtctcctcttctaatatttcttattttttaattccaaatttcagctatttctaaattgtatttctatatgaattctgttttttctttttctccgattaatgtgagaatttctaggccatgagagcgaacgtggaggctcatttttctattcctttaataatataataatagatagatagatagatagattgttatcaaaacactatgaagtctgaaaatgtatcactacaattatacaacttatacacacaggggctaacatatactccctccgttttttaataaaatgcgttgagtttcaagaaaactgttttaccattcatattattatatgttaaagtataagttgtccaaataaataaaaataacatttataatttttaaataaaacaaatgattaaacgtggtactaaaaaatttaacggcgtaatgtatttaaaaaacaaaggaagtatatatataaatatatatacatgtgaaaagactgaagagtagtcaggtcagaagagggaggctgcggaaatggaagtgatcttgttgcctctggttgtcatcatcacatccaccatgcttctcctattgatcatctccacggcgaagaagagacaccatggcacggcaaaccttccgctgcccccagcgccgccctctgtccccgtcgtcggcccgcttctctggctcgtgcgcgcgcgctccaacctcgagccagccatccgtgagctgcacaggcggcacggccccatcctcagcctcaccttcctctccccgcgcgccgccatcttcgtctccagccgcgaggtgacccaccgcgccctcgtccagcgcggccacacgttcgccagccgcccgccggccatcgcgccgttcgccgtcctcaccagcggccagtgcaccgtcagctctgcgccgtatggtccgctctggcgctccttgcgccgcaacctcacctccggtgtcctcggccacggctctcgcgccccactctacgcgcctgcacggcggtgggcgctccatcttttgacgtctgacctcgcggcggcctcgggaaacacgggtggcggcgtggccgtggccgtggtggactgcctccagttcgccatgttctcgctgctcacgtacatgtgctttggtaagaggctcgatcgtcgtggtgtccgggagatcgaggccgtgcaaagggagctcttctcctcgtacatcagcttccaggtgttcgccttctgcccgacggtcaccaagcgactgttcttccggcggtggcagaaggtgctctccattcggaggaggcaagaagacatattccttcctctgatcgaagaaaggagaaaacgcatcaagatcagcagcatggacaacgacggcagcatggtttgctgctacgtggacacaatcatctcccacaagctccccaaggaggccggcgatcgccggctcaccgacggcgagttggtgagcctctgcacggagttcctcaccgcgagcgtcgacacgattgtcaccgcgctgcagtggatcatggctcgtgtcgtcgagcagccggagattcaggcgaagctgctggacgagatcaaccgcgtggtgtcgagcgacaaggagcacgtcgacgaggaagacatcaagtccatggcgtacctcaaggcactagtcctagaggggctacgtcgacacccgccggcacacttcctgctgtcgcacgccgcggtggaggagacgtcgctggacgggcaccgcatcccggcgggcaggtcggtgaatttctcggtggccgacgtggcgcacgacgagaacgtgtggagccggccggaggagttcctgccggagaggttcctggacggaggggaaggtgccgggactgacctgactggaagccgggagatcaagatgatgccgttcggagttgggaggaggatctgccctggacttggcctcgcgctgctgcagctggagtacttcgtggcgaacatggtccgggagttcgaatgggggatggtggatggtgattgtggtggtggcatcaaccttgccgagaggccggagttcaccgtgataatggagcagccgcttcgtgcgctggttgtgccgaggaggagagagtgaccgccacgcacgggtgtgcatgccttgatcgtcgtcgctgcatggtgtgcagctgcacccaattggagagttgcgtatcttctcattacttgggagatacctctcctatccacatatacatatatatatattacaagtagaagtaaaataaataaattcaactttgtatctgttcatgagttttcttcagtctatacgtatatattcaattagcattttagcaagagacttatatatctctgactgacaggcaccataagtattaaatcgttgacatattagacacatagaacagatgccaccgaaggatattaggtacgtggaatggagctttgtaccttagtcatcatcgtcgaaacgcatgagctcttccccatatgttcatatcaaagttggcatggttaggatgtgtgtcagctgcatgtttcactgccccctctgcttcctctgcctcaggttcggtggcctccttacagttgatgtaaacggtggcttcctcgaggcaaccaaggtttgccaatccaaagtcgaagccattgccgagatccttggtctgccttaccccgaagcagaactcgatgatccgaagcctcggcatggctccccgctggatcaccggcccgtggtccgagttccggaaccggcattccttcagacacgggaacgcgtctcgaccaatcacaatcatctccttcatctcgtatggctccacgcgaagtgtccgaagaacaggcagcttcccaagggcgtcgatgtccacctgcctgagctccctcacctggatgagcagcacggcgaggcgcggcacgacggaggcggcgatccacgctggcagcagccgcagtgggctacaggagatgtacgtcgccaacgcgctgaatgatcggaggcgcggaggcggcgtccagctgccatcctggagaagatcgagcagcctcttgtgcccattcccgctagcggcgtagatgtgaagatcctgcaatttacgcaggtttcgcagggactccaccagggcttcctcggtgctctgcgtcggctgcctcagcgtgatcttgaggaccctcagctttgtcaggttcctcagctcgttcacaagatccggtgaatcgcgagtcgaaatgtccgagagctcctccagtgacaccagattccctatcccactcggaatccttgtctggaattcaacacgaaggcacatgagctttccaaggcgaaagactgttgccggcagttctttcacccttgtgtccgcgaggtccagcgtctgcagaaactgcagctttcctacatcttctgtaagttcagtgatccgtgtatttctcagtccaaggtaccgtaggtggatcaaactaccaagatgatcgttgaggacgtggtggctttgtgaaatatcacaaccttctagatccaatacacgaagaactttgaactctgaaagattgatgctaccaatagcagggctgaagacagaaagcgaccgcgcttgaagcatgctcatcatggtagcctgatttgtagtgtctactgatgccttgcttcctcggatggataaccggcaacccttgtttgatgaacatgtctgctgctcatcgttcaatatagtcacaaagttttcttcgcttgacaaggagctgataagatccatcaccgagaaatgtacacggcagcagtattcttccctgataccatcttcgctataatctatgtctaataatttgaccatgcttctatttacaagctcattgaaataactctctccaagctcaaataagctctcttcgtgatttccatcttggataaaaccttcagctatccacctccatataagtcggtctcacctgacctcataatcttccgggaatatgcttagatacaataagcaagcccttagatttgcaggtaaacggtaatatccaacggaaattgtcattctcatattcttcacgtcagcaccattctctagtgttgaaccgatagagttgtggaccttataccattccttcttgtctcctattttaccagccaataaactggctagtgcaagaatagcaataggaacaccgtcacatttctttaaaattttatcagctacttcagcaaactcatcgtcgagacagattttgttgtcatggccaaatattctttgaaggaacaatatcttcgagttttctgcagaaagtggctttagttcatatggcattccagcttgatcagcaacactgaaatttcgggttgttgtgattattctacttccacaataattctcaaccagagcatgcttgatcatttcccaagatggcttatcccataaatcatcaataacaatgagatacctatacatgtacaataacactggatgagaaatgtagttacacaaagtaaaatgtattatacatcatagactatttcagaagcaccctttccacgaatgtaaaaataggattgtcaactgcaaaaaagggaagcaccatgtgcttgacaagttaaagttcatctttaagctaaatggcactatggctggcagccttttgagcttttatgataacctgaaggtgtactaataatgaattacatttttcaaccgtaggaggttgtggcattgtcatgtttaatttggattattgagcactgagaaataaacttaataaatagcttaaaatgtattttaaacatagtgatatccttagggagtaataatgatgtctaagcaatgtagttgaagaaagtattctttgagaaaacgttttttttttcaaaaactggagcatgtaatccattttaataatctgatgaataagctgaaaagaacggggcctattcaagccaaataaagattttgtgagttgtattactgtatgagcatgtatcaccatctagttctgcgaaccaccttggccgcggctactagattcatcatgcaggtcaaacattttgtattaaacaaaccatctgaactcaactataaatatcaattagtataccattatgggccttagtgaaattttatttgattttgggagaaatgagaagtgagtttagttctcccaatgtcaaacatgcttgaggcacgctttctttgcactcaagatcatgtggagaggattccatcataccatctgtgtacacaacagctgggtaatcgcatttccttttccttgggttcccctgttttcctctgttttcccctgttcttccccttgttctctctgctttcccctgttctacccatttttttcctattcccctgttcactgttatttttacagctaaagttgccacagaaacgtactcaaataaactctaattcgatcgtgcacatggcgagctccactgctctaggtatcatgtcctttcgagttcgagatagaaccatttggaaatccaagaccaatcaatcattagttgatgctaatttctacgtgaagcagtaacttactgtacatacctcctgtctcgtaggaacttgctcagttgatcgacgagctgcgcctcgccgctgacgctcggttcctcgccgccgacgctctcgtgcttgtcgtcgtcgtcaagctggcggagcatcctcatgaaaaccatggccatgtcgggattgatggcggacaccgacacgaaggctccgcagtcgaaccgcggccggagcgtgtcgtacaccatcttggcgagcgtcgtcttgcccagacctgcggctccgacgatggacacggtcttcagccgctgctccgattgctcgtcgccgtcgacgtcgtcgcagagcttcttgatcaggtcgtccttggcggcgtccaagccgacgatctccgtcgccggcgggccagcgtcgacggcagcggccggccggcgagggtcgacggccgcggttgggcgaggcctcctcctggacaggtcggcggccctctcgagaagcgccttgaccgtcgccgccgacgccgcgtcaggggagccgtccgcgcgacgagccaagagcgccgcgtcgcacgcgagctccctggcgtggccggaccaggccttggcctgctcgtcgaaccgcgctgggggcacgtcggcgaggtagtcgtcccggagcgcggcgtgcacggccgtcagctccgccgcgaggagctcgacggcgccgccctcgcgtgtttcttcttcctcctccctgaccaccagcatgatgtcgcccaggctggagagggcgctgcacgtcgcggccatcgccgtctccattgctctgccgtctgcaccgcaggctgttgccgccggccagctttgtccttcctcgtgactggtgtggtggtggagccggaggcagtggcaatcagaccaagcaagtgtcagcaagtgtcattgcgatggcgattgtgcagcgccgacggatttgtttagatttgagcgcgggacacctggtgtgtttggttggagggatatccctagatggaagatgacgattcagtttttaaatgtgtttggttggtgggcgaggatggatagggtggtccagagagggaatatttcacgaagatgctggatgagtgtatccgaccaaattggccggacgaggatatcaacctttactaatctttgatcattagttcttaattagcaataattaaagtatattattgttaattagtaattaacttgttaaaattagtgttgattagatatagttactctattttattgttaattagtataaattatggctatattaatgataattaacatattttattattaattattacgttgttgttttcattcaatccattctcatccacccaaccaaacaaaaaaactggatgattatatccacctaaccaaacaaaaaactataccattatatttaagatagccatattctgtcttgaccacgaaacaaaatatagaaggacgcagcgtcccctcacggttccacagaagcgtctagttttagcaacacgtgtaagtgccactgccaccgatttgacgtcgatcagtcaatcaacatttcagctgtatcggcagcaataagaattaaaagtatagccaacgccaattcatataataattatatataaatatatactactctttcttcacagggtaagactttctagtattgtccatattcataaagattaaaatgaatctaaatattcatatgtgcctacattcattaacatccatatgaatataggcaatgctagaaagtcttatattgtgatattaatatttggtcacatttatcataaatacattacgtcttagagtctatgcggcagctggctataaatatatatagcccaccgctcatctctgtcttcttttatcttctcgatatgtgtttataactggcttatactactatgtccaaaaaatcaaacctggatttgaatctagacacatttgatttttttagacggaaggggtagaatgctactgtacctgctctgagcgaagccgtcttcacagcatctccaacagactctccaagttaaaatttacccattttagcaaaaaaatctcacttcaacagcctctctactagaatggctaagccaaatgactagccaaactcctcccctcaatggctaaatttggccagcccaaattgccttgccattcgtgggcccgatgttggagatgcttttctctcaccccgtactacctgctcgagtctgctcccacgccatctgcgcaactaccgccagcgatggctgcgacggatggggacggagcccaagcggcagaggatggcggtgatgagcccggatggcagcggatagcggcggagcccgagcagcggtggacgcggcgaccaacccaagtccctccgcctatcaccgccgtgtcctttctccctccgctcgtgcctgccactgccatgggaaggaggcgcgtcgtcgctcgctcgcatcctccacccgagctcgccgtcaacggctcgcccgcgctcaagatcggcggcaatgggatgtcggcatcgcacctccctgaggagaggattccggcatcgctcctccccaccttccacctcctcccaacgccggtgctgcccctctcaacctcctcgtgccgccgcatgtgccccagccacatccacctccacccccggccatccggcgcagcttgccatctattgctgccatgccacgggaaggtggggaaagaaaagaaatgaaagggagaagagtgccaagacactggcatgtggggcccaataaaaatggagagtgtggaatggacagtctgttggagcgtgtaggagatacaaagagaaatgtttttagcaagttggccaaatggatgaatggagaggcaaaaatagccatgctattggagatactctagggacacgaaaaatgacatgctctgtcctctatgaataccacctccgtcccaaaaaaattggacattctcctgtccaactaatgtcccagaaaattgaactcactagaagtaagttatacagaggtactcccttcggcacacaaaaaaaatccat

SEQ ID NO: 25744 - DNA, 740 bp, Oryza sativa
agctcgacggcgccgccctcgcgtgtttcttcttcctcctccctgaccaccagcatgatgtcgcccaggctggagagggcgctgcacgtcgcggccatcgccgtctccattgctctgccgtctgcaccgcaggctgttgccgccggccagctttgtccttcctcgtgactggtgtggtggtggagccggaggcagtggcaatcagaccaagcaagtgtcagcaagtgtcattgcgatggcgattgtgcagcgccgacggatttgtttagatttgagcgcgggacacctggtgtgtttggttggagggatatccctagatggaagatgacgattcagtttttaaatgtgtttggttggtgggcgaggatggatagggtggtccagagagggaatatttcacgaagatgctggatgagtgtatccgaccaaattggccggacgaggatatcaacctttactaatctttgatcattagttcttaattagcaataattaaagtatattattgttaattagtaattaacttgttaaaattagtgttgattagaaaaaggtactctattttaatggtaattaggaataaataaggctataataattaatatttaccaaatttaataataaataatacggtggtggtttccatccaatccattttcttccccccacccaaccaaaaaacttgaatgttaatatccccctacccaaccaaaaaactataccattgatgagctactgta

SEQ ID NO: 25745 - DNA, 653 bp, Oryza sativa
ttgaaatcatttagtatttaaaaatgttgtttgaacttggggaggaattatggactatttggatgggcctttttaacttcggaaattccgacaaactttccggaatttttccgaccgattccaagttccgacggaaactgatattatcatattcgattccgtttccgaaaaaatatttccgttttcgattccgtttccgcgaaattccgaaaaaattccgaccggctgattccgttttcgaaaacaggtccggaatccggaaaaattccgaaccgttttcacccctagttgctctgcataattgcctaaaactttgcactccttcaaatgttgacccttcatcgggagccccaattgcgacaatgaattcattatgttctgatgccttgatgtttgaagccgtagatctttcatattcattttgaaaattttcaaatatacaaggtgtgtaaatgttattttttatgaagaatgaatcaatttaccatctaccatctatcatctatttctggattgttatttttctagatttctttggagatccatacagttcttatttggattatatcctccacatagtatatctcacatgtttgggaattgggttatgggtgttaataaaaaaaataaggaacttattcttgtagaagctt

SEQ ID NO: 25746 - DNA, 2293 bp, Oryza sativa
gaactattttctggtgggaccgttggttccggagcaaccacaacagcaagggactgctcttgctcccctaaacccttatcttcagtccctttagtactatcggccatcgtatcaaacctttaacataaaataaaatgttatcctccacattttaaattactcaaattagtacaaacaactttaaattgcgaaaattaattactactccctccgtcccataatataagggattttgagtttttgtttgcactctttgattactcgtcttattcaaaaaaaattttgaattattatttatttttttgtgacttgctttattatccaaagtactttaagcacaacttttcgatttttatatttgcacaaattttttgaataagacgagtggtcaaacagtgcaatcaaaacctcaaaattccttatattatgggacggagggagtacttactattatgctagaatagatatgttattaattagtacttatgctattaattagtacttactattatgctaaattaattagtaaaaacaaaattaacttgcggaatgaataaagtatacttactattatgctaaattaatgagtacaaacgaaatgaaaatgcgagaatgtatgaattatacttactactatgctaaatgaattaggacgaacaaatttgaattgcgaacatgtgttaattagtacttactattatgctcaatgaagtagtacaaacaaaattaaattgcgaaattaattactacttactattatgctaaattaagtagtataaacaaatttgtacaaaatttgaaaagttattatcaagtagtgcactaattcacaattacatttcctcgacatgttgtttaaaaaaaattaaaaaggcaaacatatcctccacatttttttaaaaaaaaatgttaacataccctcctacatgctatttaaaaaatttgacaaattcacatatcctgcaaaattgaacataccctcccaatttcattcacatatcacccacattcccaaattcacattcacaatcacatataacccctcattcacatatcacccacccctcattcccattcatacccacatgcacacacatatataccccctcacacccacatgcacacacatataaaaaggaacacccacatgcacacacgtctgtggacgacgaacggccgatgacgagcttcggtcgtggacgacgaaggaaggaccgacgacgaggttcggccgtggacgacgaaccggccgacgaagccgttcggccgaggacgtcttcgctcgtggacgatgaaaggccgataatgaagccgctcatggacgactgcgagagagggagagagatggcggcggcggctgtggagcggccggcagcggtggagaggtcggcggcgcggtggaggggccggcggggtagcggtcagtggcagcggagcggtggagcggccctcgtgtcggggcacaggtactccaattgcatattcatctttgaggtaatcgatacagcactcgacaacctcttcagtactataaccctcaaccattgatccctctggatgtgcacgatttcggacgtaacccttcaaaaccgtcatgtaacgctcgtatgaccacatttgatggaggtacaatgggccaagcgcaaccatctacggcactatgtgaacaatgaggtgctccatcgtatcaaaaaatgacggagggaaacacatctcaagttggcactgtgtctcatgtgcgaatgtagggagatttcctaactcttcgagactaatgaccttctgtgacactgcgttgaaaaagtagcacaaccttgtgatagcaacctttaaatgctctgattttatggcccttattgaaattgcaagaaacacggtgagcaagacatgacagtcgtgtgaattataaccagataccaaaatctttcattgaaactagtcgactgatgtttgatgagaaacctatgggcactctgacatcacggagtgagttgcaaaatgacttcttctcctcaggtgtcagtgtgaaacaggctggtggaagatatactttgccattcttctctccttcttgagggtgtaactcttccctgattcccatctcgactaggtccatccttgattgcagaccatctttagtcttgtttggcatgtccaacaatgttccaactatgttgccaaacacattcttctctacatgcaagacgtctatggcaagccgaacctccagatttttccaggacgggaggactttaaaaaatatggaaggcttcttgaatggggaagggagtta

SEQ ID NO: 25747 - DNA, 612 bp, Oryza sativa
gatcggtatggaaagcacagttcccttgggaatttttaggttgccaagatcgatatctgaaccagcaatcctccttatgattactactgggctgtacagcctcagtgattccaagagaaccatgttaacctgaaggccaaatgataaattctcatgcaaaatgagggcaaaaacaacaaattaaaatgaatcgatagatggatggagtaaatgaagggtgagtttgtttgggcatactccttttaattttgtacacataactatgtaaatatctttttttttatagtagggtaggagcctctcctgttgtttcctaaaaaaaaaagattgtttgggcggttcattcaggatttttgttggaatgggaaacgagacaaaccgaaaggcgtatgactaattgagactggaataatggatttatttcattttttctgaaaaaacttttgtataaaaaacatttagcagtttgaaagcgtgctcgtgcaaaacgaataaattgccgcagcaagttatccgaacgaactcagagtaggtttgcaatttccgtttgaaattttagaaatttcgataatttcgccccctgcaaaaaaatccaatttcgaaattgaaaac

SEQ ID NO: 25748 - DNA, 1689 bp, Oryza sativa
tcataaaatcaccctagtgttttattttagttatcttttatacatgcattgtctttctttcataatgacgttagtctcttggttgtaccgaggtgctgctatgagtactttggtcaatggctaccaaattctagcaccatagttatctgtagtggctctttaactgtgagcttattagataaacatgcatgctcatgtgggaatggcaagcaatcgccagtgctatgaaattgcatatatttatttagaatcaacgggtttgtctattgctttgtacacccctatattaataagagaatggccatgtttataatccatatttgaaataattcatcagttcaccgttttgactatacattgaagcattctgtttggtaccataatgttgtttctggcttacactaaatttaatgccaagtatggcttcaatgtttttgttcccactcttagtttgctgtttgtattagcaatcactggttagctggatttataaatttattatccattctgagttttgtgatgcttgcaatcttcagattaaggccaagacaatcagtgaaattcatgatgaggctatgaagacacttggactacggccaggggcaacaggactcacgaggaatggccgtaatgcaccaggtggtcctctttcccctggtggattcccaatgaatcgaccaggaacaggagggatgatgcctgggatgcctggaacacctggtatgcctggatcaagaaagatgcctggaatgcctgggttagataatgataactgggaagttccacgttctaaatcaatgccaagaggcgactctcttcgtaaccagggtccgttgcttaataagccatcatctattaacaagccatcatctattaactccaggcttcttcctcatggaagtggagcactaattggtaagagtgctcttttgggcagtggtggtccaccatctcgcccttccagccttatggctagtctcactcatacaccagctcaaactgcaccatcaccaaaacctgtaagtgcagctccagctgttgtgcctgtcacagacaaagcagccggttcttcccatgagatgccagctgcagttcagaagaagacggtatcccttcttgaagagtattttggcatacgtattctggatgaagcacaacaatgtatcgaggagcttcagtgtcctgagtactactctgagattgtgaaagaagctatcaatcttgctttggataagggtcccaacttcattgatcctcttgttaggctgctggagcatctgcacgccaagaaaattttcaagactgaggacctgaaaactggatgcttactgtatgcagccctgctggaagatattggtattgaccttcctctagctccagccttgtttggtgaagttgttgcacgactgagtttgtcgtgtggcttgagctttgaagttggtgaggagattctaaaagcagtggaggatacatacttccgcaaaggaatttttgatgctgtcatgaaaaccatgggcggaaactcttcaggtcaggctatattgagctcgcatgctgtggtaatcgacgcctgcaacaaacttttgaaataatagccccttggcagccttggcatatcaaccttttggatgctgtgcctagccaaaacagcatcgcgtattctctatagctcaggtgtctcaccccaga

SEQ ID NO: 25749 - DNA, 4189 bp, Oryza sativa
catggattttgctatcgggtgacagcttaattcgctggagcctgagatgaacaaggcttaatgtggtatttttgtgtccctttattagttcttttctgtgcgtacacattttgtaacaatgtactatggttttggagtattctgttggtttacaatatatcgtgtcattgtagcggtcaaattttgatacctaattctgaggtttgcttgagcattcgtgcctcgtgtgcgatgaagttttatcattttcctcagaattacttgctgatgcatttgactatgattctgtttgtgggctgcctgcttgtgcgtgacattcttcatactatcaatataacaagagagttcacatcgtctcctaagctaagtttcctaagggctagtaaattggccttatcaatttttggtaagttttggaatttttgtcaatgctaaattttggtaagttttggaatttttgtcaatgctaaattttggtaagttttggcatgacaaattttaggaaggcaaagttgtgctaaacaaaaatagcctaagttaattattgaaatggcctattttcttaggcattctaaaatttgtcttcccaaatagacactacatactattaaaattgtcaaatattggtaagtaaaatttgggcctcaaaccaaactagccctaagttcagttttttttacgaaactagccctaagttcagttttttttagaaggagagatcacatcatggcctattttcttagacattctaaaatttggcttcccaaatagacactacacattattaaaattgtcaaatattggtaagtaaaatttatgcctcaaaccaaactagccctaagttcagtttttttagaaagagaggtcacatcatctcttagattaagttttttttagaatgaagagagtacggcatacatttcaaccaaaatttaaatttagataatagtactagacaaagcgctagaagccttccgtccctatccccccccccctctctgttgctggagatcaaaatcgaatcaattgcaaagctcaccgttcacccacccaccccctcgttgcgttgctcctaagccaccagacgcagccctgcactgcagcagcagcagcagcagcattagtctcgtgtgcttctcggcggcgagtgatcggctccaccacctcccacttccctttccccttcgttgtcacgcgaacgcgagcgagcaatcgaatcttcctcgcgtaagcgtaacacctctcctctggtcttgctccgcccgccccgccccgcccgtgcctggattggacctgacgagaggagctcgcgccctgccctgtggtgccagtgccactcactaatcgaggcgtgcttttttttttcctttttagggttcgtcggccggcgcggcggcgggcgcgtgtgctggtccagagctgcatcggcggctggcgcgctcttcgctcggaacatggtatgcacccgtttcgctcctgcttctcctcccccagctgcttgcttctgttgatgcttgattgaagaacctccagctgtctcgtctctttgggtagtaggaaggcaaggaagaatcatgtgctacagtatactagcgtacaggcagctgggttttgcatgcaaaatcataccatctttgtggtgtggagcttctgctcatgtgcgtagggctgccgaaatgctcaggatatcatctagtttgtgcctgttgggcgtgcaaatgcagttctccttgtcttcctttgggaaatcgggaatgcttggttggttagtgtgatttttcctggtagaatctgggatggtttgctgcagcattcactgccttccgctgtgcattgaatattgttcccggcaaaaataacattagcttcggtcaccctggcaaagatattgttccgttcgttctcagtgtctagagtaatgcgagcttatttcattttcaaaatcattttagatgtttgccagcattttatgcaccatatgtgatttctgccctttttctcaggccgggaggcacaccatcattctcatgcaaccatcgcagaacagagcgacaagaacatttatggacttcaattcagttaaccatgcactggatggtcggtattttctctcatgcttgcttgaaatgttagtgcagttatgggaataacctttccccttttgtgcctgtatgttcccggttatgaacttatcacaaaagtggtgcattaataaattgcatgagcatttgttgcttgcttcagctatataagcagtggcatagtattttcttcatttactccttatctgttagtactttggactgaaattcaggaaattcatcagatttttgttcactgtcttttagtttaaccttgtaggaatatataacagaacgtgtacagattgctttaataaactaacatgatatgctatagctaatgtacagaaaacccaacaagctactctttaaagctcaaatatcattgaggaatatgcgtagtgcttctatttgaatcaacatgataacagtcatacgttttctttaaccattaaatgaatgtctgtaaatttcacatagtttgggagtcacgcagtcaagtatcagctaaccataggaccatgccaacggctgtacgattgttgctgttttccattctaagtcttgggaaaagcatctctattatccccattatgttcttaatcatgcccaggacaagcattgcgtgctcttccttgtttcttaatccattttctatgtttatatgtgtgttcttcccttgaggaacttggtacttacagtttgctgtatggaatgacaggaatctgtggcctttacgaaaggaaaatcagggatatcaaccctatggccagggacttaacttatgatataaatgacctgtacaatttcatcgatggcctaaccgacataagtgcactagtgtgagtgccggcttccctgacatcgaatagcattactaatcatacactgatgcgcttagaactaacttaaccatttgtgccctcaacacctcgcaggttcgaccggtcgcttcatgccttcctgccatacgaccgtcggtggataaagcaggagatgtttcagcacctgaagaggttagcacagcagtaaagcgtgatcgatcgccgttggcaggtgaatcagcaaacaagcgtgatcgccgtggtatcctgttgcggtttgtttcgtggtgtgagatatctgggatttgtttcttgtaagaaaaacgcgaggttttgggtcgccagcctcctgtcgtatccgatgcagtattctggctttgaatggaatggtttgcctctgtctgtctgtgtctatgacagtatcatactatcttgtgagcacctttggaattcatgaattttacagaattttcacatgatgaaacagttcaagtcacatgaaattcctctaaaaatcgtacgtcccaaaaggacgcttgaacaaaacacaaaaacacacacacccaaaaaaaacccgaaggaactgcctcaatatccttccaaatgatactgtgcttctttctgttacaaaaaatgaaaggaaaactaactgttgtttcacctataacctattgatgtgctgttgctgatgatacataaagaactagtctaccaaagagtggagaacagaaccagaacgccattggtaatttggtatagaatgaatcatggatggaagacaagtatcctgttcatgagcttgtcagtcaactcccacggtcttgtagctcgttcatgagaggaatcaactccacagtacccgttccagcatcgaccactttgattctttcatcttcgacagccacattcagagcatgacagctagaatcatctgcgacaaggacggaaaattcagcagtgtcttgacctcctttcctagcttcagtagattcattgtcctgaagcatctctgccgggaggagcattgagttttggtcactctggggaacaagaaacagcagcatcagcgggagcagcctcgacaagtttctgatcaggacggcaacccagaggttactgaactccgttcgagtcacattcagcaactgcagcatcaggccaccccaccagccagacatcagcaacccggcattttggatggacatgagcagcgcatagaaagttccttcgatgcctggaggacaaagcttggagcaaacacgaggagcggcaaccatttgagcc

SEQ ID NO: 25750 - DNA, 6614 bp, Oryza sativa
gccgattcttgtgttgagccgggtcaccattatcagatcgagcattcctgccaggcttgaaagaacttggccccagaatagcacgccgcggaaagggcagtccttcagtgaaatttggtatagtaaaactccgagcagcgaaccgattgaaccgaccgaatacacaaggccaataaattcctgaaataaacgatcgaatgacgcaatcgaagtgtcatcagatgattaaaattagaagaaggtcaaataactgaatttatctaaaaccacacctcattatatggatttaacagtggtatgcattctcagtattacagtccatgcaaatgatgcgatgaactgatgatatctagcaaatatctatatgcaggaatgtgcatacctcagagaatcctggtcccactattggatcagtgtaccagtagaacattcctgcttggatatccaggcttagactgagagaaacatacatatacacacacggccgccaaacttcggcacacttcagtgttgcccccatggactgaattgctttgtagaatttcctatgaacctgaatccatcaaagcactcaagtggcatcactgtccatgcctgaattcagcaatctcaacacacaaaaggaaaggtgttcaaattttgtcttgacattctgacctgcttgtaatcgaaatctgtaactcgcctctccttcagcaaaacaccagccaagaacaccagtgcagaagggatgcttagtaatccaagagcacccttagaacaagaaaagaaaaaaaaagcaagaatcacaatcatatcaattgacattgtgtgagaaaacaaatgatgatgcaaatcattatctaaggtcagggaatatcacacctgagaccccatggagtggacaagaagaccactgatggagaatccaagcaatgccccaacggaggagctgaacccacacaggctctgcatgtctgcggctagcggctggtgcgtgatgctgttctgagcaaccagcgcgtccaccgtcacgtcggccaccgccgcgcccgcgctctgcgccgtcagcgccaagatcgccggcatgatgcccagcttgcggtggagagagagcgtgagcatggacgacgccccaatcactcctgaatgaatcaccgagagaagtgatcaagtaaggcgaaagccttcgaactgcgagatgggatcgaggaggcggaggaggctgcaatcccctcaccggcgaggaggaagtacgggcggcggcggtagccggcgacggggacgacgtcggtgagtagaccccagatgggcttgacgacccagggggcgctgacgaacccctggtagaactgcgccgccgacggctgcacgcgctgcacgtccttccagtagtaccccgccgcgacgccgccgacggcgtcgccgacaccctggcaggccccgtagacggccacgacggcgagcacgaagctccagtgcagctcgcgggacagacgccggagccagccgccggggaaggaggcgccgccgccggcttctcgaagcgccgcgtcgtcgtcctcctcctcttggcgatccatctgggcagcgatttcttgccgggggtttcttggggatctacggcggaagcccgccggaattcgcacggctagaatgcaggtctcgcgattgatcggtgggagagattgacgaggcgcatcttggcgttggcgagctgagcaagagcaagtgtgcgttgatgggtatccgcgctcaaggttttgacttgacaccccccaccttgcaactattatagtactgtatactcctactaatttaaccatggtaattttgcaccattaatctatgtactagtagtagaaaactgggcaacatgtcaacactaattttgactttgtgccttttactattgcgcatcatctctttgcactgcgttattactgtgtagctacttacgacctaatcaaggcctgataggaattaataagtgaatatgaaataagttcactttcgacatttaaatgctgagtttgaattgcgtccttatccacaataccagtataatgtcagttaatttataatatcggtgtacccgagattctaaaatagtataacaccctattttaactgacatgatgagccaactatgatcatactgatcgagtaaacgtgagacccacatgagccccatatattagcggttaactcttttttccttcatcgcctcttctctctacccatccctcttgccaatttctctccaccggtggagaaggccagaaaggcggtgagcagcgggaagaaggatagcagctaatgggagaggggtgacaaccagtggactagaagaccttgagcttgccaggcggctgctcgagcaaccctcaacctcaggaacccagcatcgacctcgatcgcgtaacatcgtgttgccccctcggcttaccccgatggcaacacaagctacgtggccaaggtaactacggggttcttgagcatgatggcttttccagcagttgctccagttcctgtcgggaaagagatggggaaaagggatgggtagatagatattaggtaaagggactcggtagagagagttggctgctaacatgtaagacccatgtgggtctcacgctgactcaaccagattgataatagtcaactcgtcacgttagttaaaactggatgttatactgtcatgtgacctcggttacaccgatcttgcaaattggttgaaggacacaatctaaactcatcgtcaataagagagacctaaagtgaacttattataatgaatattgactattgagttggcccagcagcccaccatgttcataagaataaggtccacgacaactgctgctcacctactctccacctctcccagtctcctgttcgttcctctctcccaagtctagggatgaaagtggttggaaatggtcggaaacggcatcattattttattattttttaaaaaacaagcagaaacggtcgaaaaattttcatattcatgaattcatctatttagtgtcaacttcaatgccacaccgttagaaattaaaaaaaactaaattttaaaaatgataaccatcgataaaaatattattattatattagttttgcggaaacggtatcggtacggtcagaaaatttccataccgttttcacccccagccaagtcccaacaacgttccgaggtcacagcgctcgtccgggcgtccatcgctgccaatttcaggcccgttgttttggcgcccgaatccccctcccgcatttttcccctttagaaaaccctgcgcgcgtggccttctcgattcctgcccgtccgatccgccctcacggcctcaccgcctcatctccgccgtcgattggccctaaccccaccgaccacccgcggccctcgtcttcctcctcgccacgccccctttcacaacggagccgggcgctgtccccccctccgcgctgcaccgcaaaccagccgccgcctcccgtcaaggccgtccttcgccgccgcagccgtgagggcatccctccccctccccgctgagcgagctacactggcctctttcccccctgccccgtgctggacggtgagtggcattcttcttcctcctttaaaagttttcttgggttgatgtgtatatctcgcttaggtctggggatttttgggtatgatacttcttgattttgttaggctactcatatagcatatggtagttcagatttggatgtgttttgcacatatgttgggttctgcacactggttaattctgtagtttagctattttcacatagaggttgcacacatgcatgctaataatttgctggcaaattcgcataattcaccgccgccaccgccgcgtccgtttcttcactctccgtctttccaagcagcatgacgagaggcaagaaggggatgcagcccaagatcagtgcgttcttcaagcgtcaggcccccgagcccgagacgagcaggttcttcatcttggtcccctcttcaaatctgttagctgtagcgatccggtaccaaatattgccggattccactctagtagcgaatttctgcaatattccatcaattagagcgaatattaaaatcgctcgtcaggttggaaaaaaatggttgttgatttagttctcgttaattcccaagcatgctgtccgacattggcatgttcctggattcagatttgataatggactgatcaatctttgttgatttggtaagtggtggcgacacgcatagggaaggaacctgcgggatggaggtgaagaggcccaagagctgtgcggatggcaaggtcctcaacaagaagaggaactacgcgcagttccacctggagcttgggcagcccgattttctcctccacatgtgcccggtttgtggcatgatgtatgcccgcggaacgacgacgacgagaaggctcacaaggcataccacaagagttacttcgagggcgtcccgttcaaggtgttgcacctgatgtatatttgtgaatctcactcttctgttcatctcgtgttataaatttctgtgaagagtttatgacaaatgtttgagttgcagggttggcgcaatgaaaccgtggtcgcgaggtctgaaggtggggatcggataattcttgtgaccgatgaaaattcatgtgctcggaacagcaaggtattttgcctgaatgactaactgtattgcctagatagttgaaagaaatcactagttggggtcttggggaaatgaatattgaaaagagtgggttcctcatagttctaaactgtagaatgtgtgtctttactaactgcgaagtttctgatccaattttgcaaccactttacatttacgagaagttcagaagcagattgcagacattttatgattatgtaatgtcatgtgaatatttcaggtccaggaggtgatcaaagtggtacagaaggagctggggtttggtgaaggtcagctccttcacaagctttgtaaggtaacatcagctcctagttcaaatatgacaacatctatgcacatatattcatcctaatgggtaaaacctcatttgcgttgcataggtatatttgttcatatctagtcagaggatagtgggatgccttgttgcggaaccaatcaaaacagcacataaagtgattccaggctccacagaggaaacggcactgatctgcctgttgataaaattgaaccagtcaaaacaaaccatacattagagttcgggaaaatcagttttaagagggaagtcctgaaacggcatgatcattcagacaagaacaaagaagagtaccgagatcctggtgctataatatgtgaaaaggaagatgttcctgcacattgtggatttcgagcaatttgggttgtaccgtcacgcagaagaaagcgaatagggtcacaactgatggatgctgctaggtaagttctaagtttgatgcgcattctcacctactttgcttcacttagcatctttctttttcgcagcattcctgcaatgcccgtcttgaactcttgatagcatacattgttctttttggggggaatacgcaaaaggcttgcgcatcattgcattaagagaaggatagcatgcattgttctctgtaacaacaatgtatagatccatcatagcacgcattgtcaatttggacaaattccaagcttttgaccagattataggactaataaaactatttgttatctgacatcacactgcaaatatcactgaattatttatctgtctgtccagttgttctcttctatgctctgcaagcatttccaagagtttgatattatcttatcttgctaaggcactctccattcgtcttctgcaggaaaagcttcctcgaaggcgagactttgtgcatctcacagtgcgctttctcaccgcctacttcctccgggaaggcgctggcacgcagctattgcaagaccagcgcattcttagtctacaaggagcaagatgcataggagatgctgcagaagatgttacatatctgaaacttctcttcccattgtaaaaattgctttgctggggatatatgtgaaacataaacaggcatgttctgcttttagtgtaagtctaagcaccagaagcagtgcgtttttgcaggatctctatgtattgacacttggatttcctgatcagcagcattttctgaatatcatttcatattagtagcttgcaatcttccttggggaagatgagatctttattagtccttgggagtattaacaggcagagttatcttctagtgttaacctctgtctctcaatactctcaaaacccaagaaaaacacaggggaaacagtgcaagccgcttttgggccccaaaaaatttcccacaatttatcatatgggaacatgtcacaactttggtcaatatatacagcagaccgatgatacaatgttctgataactagtcagaatcaacaatgggcgacactgatgcttgtgcgccagaataatacatcttttagtgttttctcctcgtcaatggaccatggatggctgcatttgagtactcatcaaccactgattgtgtaagtgatggacgcaaggatcttagcgcggcctggaagtgaatatcgtcacatacaaaacgctctgacctcagactttccctcaaggcagccattcccg

SEQ ID NO: 25751 - DNA, 18714 bp, Oryza sativa
agattacaaactccaatattaacattcactggtcagatgtggaaattagatttacatgcgcagaagcaaagttttcataaattgattctactatatgaaaagaacatttggggaaccatatccaacaaaatatgcttaacacttctgacacctcttcaacttcctaatcatgtacaccatggaaaagatgcaaatattattattacgtaattatagaagatagcctataacaattcatgcacattcttatgatgattgtacagaatcatttttaccaatatcatgcatcatgtatcatagatctcactagtatgtgccacaggacaacaagagacaagatataaatgtgcaccttttaggggcaattgcatcagcctcatcaaaaaatataatgcttggagaagcaagacgtgccatctggaatgtacgtcgcaacaaagcttcaccttcaccaacatacttggagtataactcagcaccactgtttgaaaatgtgtaagaaatttagaacaacatagaagactgtatactgaactcaaaatgatccggttagcatgttctagctatattatttggactagcgtacaggacaacgattcaagcagcagaatttgaacaaattatgccagcttggtcttaacagtacatgaaataaacatgttaagttcttttgcttcctctaataactccttttcagtacatctgagattaagtgatgtttattgaatttattacaatataagcatcacatcagaaaatattatgcgattcacaggcttctttttgcatgttggaaggatgaaatgagaaaaagagagaacaatttttacgcagcaaaccttaatgaaaagaaagaagcttgggcagcatgagcagcagcctttgcaagggtagtctttgagcaccctggtggaccatgcaatagcaccccacggataggtgatattccaagtctatcaaatgaagcagcatgcttgatgggccattcaacagcttgctgaagttttttctgaagcatagcaacaataaccattaaaggaggtttgattaaagaaatcctaaaatgaggcatattttaccttaacagctttcaaacctcctatatcatcccatgaaacagctggaatttctttagttacccctcttgtcacactatttttggccacagatttagcagactcccaatcctccatgattagcgttagcacattctcactctctgatgagcttgataatctaccataagcacgtcttgcagcttctcgacataaagcttgtaaatcagctccaacataaccattgcaggatgcagcaacagattgaagatcaacacattcaccaagatgtagattcttggtataaagctaaaaacataatatggtctataagattaagcttcatataagaaaaaatcatcatgaacatacgttaaccacatccaaaaaatgcagggcttgctatgttacatcataaaatacaacattcttttactatttttgaggggaaaactacattcttatatgataccttaagaatctcgaacctttcttctgctgtaggaacagtaacctctatctctgagtcaaaacgcccaggccttcgcagtgctgactcaatagcatccaccctaatgaaagcaagttgtgttttcattcaagagaaaaacacgaagttcataaccagaataactaaaggaaaacttaagcgcacttagtggaatatgctgccgtatcaacagaggaacttcctaaaatgaacttaaaatgttaggctatttgctaagatcacaaatcacgcaactgacattcctgacctggtagcagatgcaacaacaactaggtggggaagcagctttgatgacttcccgtccatcagagtcaacagctgaccaacaatgcgggacccttgctctctcctgtgaaaaatacattaataataacttcttggcaaatataaaatttgtaggtaatataacaaacttgcctactgccacgcggtggacatatgtcatcacaagttcatcaatgaatatcacggctggtctaccctgtgatgcctgggaatatgcttcagtaaaagcctctcgcatgaacttctccccctctccagcgtggggtttatgcacagaaattgaactgtaaacatatgtacattatgtgaattaagtgccaaatcaaaatatgcaattaaaagcaaagcagagtctttcaaggttaaccaattcgagttaagtcattactcaatcactgtgaggtgggcattacattctcgaacaacagctcggaccatgcttttctgacagaattgcaaaagcagtaaaacattcagcactacaaattgcgataccagtagcaaaatccacagcaagataaaagcaaactctacatgaacctagcctaagcagacgcattggccataaattgcaccggattgaagacattaacaccgtaaaagcagtacctttccagtgccagaggggccgtggagcagcaatcctctgggaaactgcaccaatgcaaagattatttcaaaaatggattgctatttacaagcaggtgcacttgatgataataaggacgaagagaagaggggataggcgacaatacattgaggccgagcacgcgggcctcccgtgcgtagaggacaggatacatcacgagctcccggagagcctccagaaccgcgcggttcccagcgatgacctcctcggcgcgccaccgtcccgtccgctcgccgtccccatcacctccgccgccgccgccgccgccgcggtggtctttgctctccctgcccctaacctcttccattcgcctcgtccgcttctgccctaagggggaggccgccgagctcgagaggtggacttcaagtcgttccggcggaacgccggtgagcaggacggtggcgggggaaggcacggcgacggagggagacggcgaatcaccaggcggggctttgggagggagacggtaaccctagcatttccggcccattcaaagcgacaaattcgacgcggcttgcttgctaatggcccagcccgaaattaattgggccttcaagaaataattccagaacaatagtttagcacccatgttatttttatagagctctaaaaagtaaaaacacacaagcacatgagatttggagttatcataccttatacacatggtaatgagtaatccatcggcaattcaatatcgagtattttattatctcctctctctctccctcagaaaaaaagagataattgctatctaacatgtgacaaaagttaagaaaacatgcaacctgtggatgccgcggcgcatctacaccaccgtgttatactataattattataattatatgttagttacaatataattacattataatttttttctatacgtatagttagtatctaatcacgtttcatctatcaattcttacgctcggtttctcaccatcggagtttaggaaaacaatagttgtgtctacgcgcattatatcgggtatggatcatacgcactactccctccgtccctaaaaaaaaaagacaaacctttggttttcgtgtacaacgtttgactgtccgtgttatatgaaaattttttataattagtatttttattgttgttagatgataaaacatgattaatactttatgcgtgacttgtctttttatttttttttcataatttttttaaacaagacggacggtcaaatgttagacatggaaacccagggtttgtctttttttttctgggacggagggagtggttgtttgtatatgtatagttgtttcgtgattatagtcatatatattttgaatgattttttatggttctttttttttcgaatgttggtcaggtagggtcaacttttagtcagtcgtgagacaccttgcttttggcttcgcgtgatactctatatccggagttgcgttaattcttttgctacgtgattctaagctagtatacccattacgcctgtccctaccagaattctgatgaacactgccaccggtggttggccggcgaagccataaaacccactgccacctctcaggctgtgtttagtttcactttaaaattaaaagtttgactaaaattagtagtttaaagaaaacagttaaaagtatatggccgtgtttgattcacccctaactacctcaaacttccaactttctatcatatcacatcacatccaaaactttactacacacgtaaacttttaattttttttttcaaactcacaactttccctaaacttccaacttttttcagtaactaaacacaccctatgtgtaggatagttttgatgtgatgaaaaagttaaaaaatctctactacttaaaaagtccgtagtggtggtcttgattcctgacatagcagacgcatctgacagacatgcgtaatatcaaccatctgatcgtcatatccaacgggcaatcgcgcacagagatcgccatcgcggtagaccgccatcgcgcggacagtttctccgccccactcgccatcgccgccgactcctcttccgccaacctgaccccgcgacgtctcttcctccgcccacttgcccctgccggcgccggcgccgccgcccaccgcaaccgccgccggcgcgccccccctcgtgccgtggactccgctccagatccacccgccgccgattcttactcctccccgccgtcgacgcctactcctccggccacccgccaccgccgccgccctcctcccatcattatttgcgccatcgtcgactccttcccatcaacccactctcccgcgccgccctcctccccatcagcctccacgccgtcgtcgatgtcgccggccgctccagacgccatcgtcgactccccatcagcccactcccccgcgctgccctcctctgcatcagcctccgcgctgtcgtcgacagcgccagccactccagattgtcaccgccgccgcgtcttcctcctgcccatcagcctgtcgtcgacgtcgctgccgctcctcttccccatcagcctgccgtcgacgtcacggtgcctcgcctctttacctgccactgccgctagcctcctgcctatcaccgtgcagccattggagtctgccgccgcctgcgttaaggtcattcaacccattctatgaattcctttgcttaatttcctacttatcgatcagaaaactaacaagtatatctgttagtatgtctggaacattgatttaatatcattttgtatggcagaattcatcaaaatctaaaatttacttgagatttattattcatgtggtttgttcaacacaatactgtagttagtaaataatgttagctctccaaatttttcgtcttttggccacttttgttgccagccaccactctaggagctggatgcttcctgccatattcatagcctccttctgtaaacactgtgggactatatatatgccagtttctatcaacatgattagacggcatcatgctacctaggcagaaattggggagcttgattgtgatggttggtgggctggtgagtgaacttatctttagtaatctgcttccaaggaaaattgcacgttttttatgtcccatagcaaattttgcctttataaatgtatgtcttatattatgtactatcaccattgcggatgtagcttaaaaagctttgttcacgatctgactttgtttatgtagactaatgatttttttagggtgaagcttgaaaaggttttggtttttcagtttcaatagatgccctccaggatggcatctatcaggctctcgttgccgttcttttcatgtaactgtatcacacatgcatgttgtcggtcagcaagtgctactaattcctttcaaaacatcaaacctttgtagtttgcacctgaataaattagcccggttgaaagtgcaacattggttatggcctggccagtgaatctttgttgatcaggggcactgaataaaatgtatcttctctgcatcatcctgattcctatttccttgttttttgggaacagttttatcattaaaatgtacttatattttttggacgtacacttgcttgctcttttctgctcactagggatcaaaaagaaagacatttcagagtttagctacagacaactgttaatcatttctgtccttatgctatatcatggaattaaaatatatgatggtaaaaatgtgtcttgcaaagaaacaatctcactctgtatgtttttcaatctattgcaggggttagactgcttgggtacatctcaaaaaaaaaacatcattctgatatccgatacatcttaggtggtgtcctcatattgccttattgtgatctgattgtcggaaagtcaaacagaggttatcatcaacaaggtaatacttgtgccgatctgcttatattatgcattctctggccatagggttgccacattcgaatatatatctccacatgcaaaattaaagattgtggtggatgcccttttctgtgaatcgttatgctaaactgacagttctatttattcatatttgaagtgagcatggatctttgtattaatcgcggcagccagcccccgacaacgtgaccccgcactgcctcccctccctcctcgacctcagcagttgctgccagatcgtgggagctggccccttacgacgcaaccccgcgccaagcagcagccgatcaccccgccgtggcagaaggttgcctcgaagctctgacattgaaaaggtcattattgtattaaatacttctgcgtttgatgatttttttttaaacccaaaaaatagcaagaagtgacctgatagggcagccttacggcataataagtatatagttttgtttgtggttttgaattatcaacattgataactgatatttatttcatagtaatcttgagaaaaaaatgtgtatgctgcactactaatgttgttgttaatgagatcatagtaatcttcctttcaagaaagacctctcagtgtattcataattcatcctcaataaattgagagttccttatttatgcctcaatatagaagttgatcttgagttggacttgtacaagctaaatgttggctgaaggtataatctgtaactaatttaggttatcaccagaaacatacatatacataaccaatggcttagacttgaaaaaacttgggcaggatggatgggttagatcaaatgaaatggtctttgtatagtgtaaagaacaagagaggagattcttttgtttattgagcttgcaatttagttgagatcttgctggcgtaagaaactgatgttcgatgaccaggtcatgcttcactgtccagttctgctctatcgttggggattttcacgcttttgttccccacctcgatgccatatcctttctaaactatataatgctatcttcagattaattgcacataacttctgattaagtgcagctttatttttcttaatgcattaaagtctcaagtcacagcatattgaggctgatctgttctgattgttgtggcgtttttggctgcagctatccagcccagctaatcggttgctacccaaaatcgtacaaccagcggtagaaaacgaaaaaaatcttgcatcaggctgtcaagcttttaaacatttatatgggattgaggctgcaactacaaaccttttgctctatatatttttctcttaaactttatcctgttgcctgtcatattcatatgtttacatgggattaaagtagccagtgttgatatagatatatgcaaactagactcaaggatgctgaacatgttttttttaacagtaagttaataaatatttaacttacaaataggagtacataggctgctaggactgcctacaaatctgttttcagaataacaaagctaaatttcttttgatgtataagtagatagcatttcctgtgtagcctgcattttgtagaaagctttataaggttccctgaatttagttaacgttagactatcagaaattggggttttctgtacgaaaccctccatctgtttactcatattccatggcttttaattgcactgcttatgctacatcaacagatcgatgtcatttgtttagagctgacttttggattgatttgttctcttttttcagcaaagtatcaatttagtgggtccaggagccctgataatactatatatggctaccattgtgcacatatgcaatccaattcatttttttggcttatgtatcatccaagcatagaattgattgtccattacccacttgaggattagctatttccttgaaccatagcgactgttctaaaatatccaccaaaaagttccccctcttctctcttataaagaagaggctctatcatttgtttttaggtctgtattttctatacgtgacccatgaaatgtctttgttgttgaagaacttgtggagaaatttaagaaataatacttttaagaaagcggatttgtccttttgagaaatagttcatgggccaatgtcctttcttgatccagatctcaaagcttctcttttatgcaactattttcccttctttttttttaaaagattttgcttgtggctgatgttttcatctttgcacaaattacatgttatgcttaagtatattagaagcaaacacatagtattatcgtatagagaaaatagttatacgggaatggtatgacatacatatatataactattactatatactggtaaataaggactgacctattttccccttatccaggcaaaccaaaccaagtaaccttcctcaattcctctcccattgtaacatcacctgctatgaatatgaccaaacaagctagcttgtggtgcacctgtggtgtgtgattcatgaggacatattgatgctttatgtgttgtggttcagtagatttttatattgaatatattgcaggcatagagaatatgtttctcatgacaaaagatacttgtgtgtgttctcaatcaatcgttgacactatgatgttctagcagtgtgaacattatggtattgttctgggtttgaattgcggacgtgtgatcctatgctgtcactacaaaaaaaaccttatataaagacacttttgtagaggcattttgcaaactgcctcttagatcaggagttttatagtgtagagatattttatagaggcattttaaaaaatacatgtattgtttggtttagtcccttctactcgcaaaattacttctcttgcattcacttgctatgttacgaaatacagaatgtcatctgtatatacttgttgccaaacaaatgtgctattagttgattagttacttgatttgatgtcatgagtgtaaaactgtaaatacagctgaatacgtatatccccggactgaattaggattttattatattactacttttttaagaaacactcaataattatttaacataattttatcggtctgattatgataagcttacattcaataactattcagcacaattttactctgtaatttgaaattgatgcgtttttttcccgttgcaacgcacaggcacttaactagttaaagaaaaaaatgataactaaacaatcactcactcacccgcctaccaatccttcccgcttctgaccgtggaatcgcgaaatgccgaaatggagaagtcggtgcgcgagctttagctgaacttctcggctgaactacacccccttccagccttcctcctccacctccgccgccggcgcgtgcagccacaggtggcgcccgcggcctcaactctgatcaggaagctgcaaatctgcaaacccgcccgcccagcgccgagtcgtcgcccatccatccattaccaaccgcgtcgccggagtaaatgccgccatcaatggcgtggctctctctccccgaatttactgcggcgcaccaggcacccaacccaaccccgacccgattcactccctcgccatcaatacaccttacgcatccacatgcgcatgctactagctcgcgcctgaacaagagccggccatgcatgtttatcctttttcaaaagaaaaaaaaacacgaaacatgcgtgcatccgggatgccagctttaccagctagatagccgccattaagagcaagtttaatagtaaagcgcgctgcttactataagtcaatcttagagttaacttgtataataagttagctataatgttaactttattttttccattctctctttctcactctataaatttgatgtatgtttcttgaaagttgtgtgaagctagctcttgtatgagagccttatagcccattattatccttgctctaacgggggagcccgagctaaggtaaagcacaagtacacgcgagacacgggtctcctggaccagctggtacggccggggaattaaccggcctcgccgtgttgacacgaaactttttctcgatcgcatgctgccggagaatcgtacgtgtaccgctgttcgaaatccatagtacgtactcctactatagattgtcccagccgaccgtccggtatgtcgtcgtatgctcgtacatgagtccgtctagtgtagcgcggcgtcggttgtgcgtcccccgatttataatggatcgcatcggcgcattcgctatagtggttgctgctgccggtgcgtccaccgtcgttaatgccggcgcgcgagagatacatgtacgcgactagtagattctctacgccaactcgatcgatcgctctctgcgtccaccaccgaaactatttctgcatgttcatcagctgctagctgttcttgcacatagtggtggtggtgtagtggtgtgtgagactgtgagtgattgtgcgctcgtgagcgagctcagctgggctggctagctcatgagcatcccgttctcctcggctgcaagatggatcagatgaggcggcagcggcggcgggagtgcattggtgttctttgctcggcgctgtttttctctgtcctggcagtggccgtcgccgcaggctccggctcgtcgtcgcagccgccgtcttcgtctccggcgccagctgctagctcagcaacgccggctgcgagggcgccttctcaacggacgccgccgacgccagcaacgccggcaaaggcggcatccccaccggcgacgaactcgtcgtcctctccacggacacccgcggcgccagccccgaggcctccacagccgccaccggcgacgtcgccggcgccaacaaagccgtcgtctccacccgcgccgaagccaccttcccctcctgcgccgtcgccgtccacaacgccgtcgtctccacccgcgccgaagccatcttctcctcctcctgcggcgacgccgaccacaaagccgtctcctccaccgtcctcgccaccggctccgagaccgtctcctcctcttcctcctcggacgccaccgccaccgccgccggcagcggcaccgaaaccatctccttctcctcctccggctccaacgaattccacgacgaactcctcctcgccgtcgacgtccacgccggtccagctctcgccaaatttctacgcgcagtcctgcccgagcgtggagctggcggtgagggatgtcgtcaggtcggcctccacattggattccaccatccccggcaagcttctcaggatgctcttccatgactgctttgttgaggtaagaaactactgatgccatgactgtttatctcagaatctagtagtatactgcttgcatttgtcaaatgcgtcacattggctgcaatttgcaacaatggaagttcttgtgcatgcaagcaaatggtgaaatggctgtctgcaatgtagatggttatatgaatcacatccaagtgtgtagatctagccatcaacaattcctgttccatcacactggattggggtattgccatttgccgtctcagtttttcatattctcagaaataacaatggtggggtggaaatataatgcagtaatgtgtttttgttcaattttatgatgatatatagttccttcggcccaatttactagcagctgaataatagttattttcatccgttttcttagtttgaaatgctgaagacctgaagaactaatcaaatgctcattctactagttagtttaggatattccttttctcaccctagttttccccagaatagttatgacatgtgtggcactaattgcatcggctaataatctggcattattcgaatataatgtatatcttgtcgattgaatggtccagtctagaatagttattgatcactaagctatgtggtggctaaaattaagaccctaatccattatgcacgcttggtataaccaaacataatgtagttttccacagcttgcacattgtcactgccacaattatgggaacaattgtatttgtcttgcatttgcatctcatcgggtttaagaattgtgaaaacatccacgcttgcacaataacagaaagtgagaaagtcattcttagagtacattttttcttggtctcagggatgtgatgcatcagtgatgattgaaggtagcggcacggagaggaccgatcctgcaaacctctcacttggtgggttcaatgtcatagatgctgccaagaggctgcttgaagccgtgtgccctgtaactgtttcctgcagcgacattttagtccttgccgcaagagatgctgttacatttgtaagtatgatggcactatgtgatttctcttttctagttgctacaatccactcaaaggtaaatgtgccaaatatttaaattgttgcctgagatgaattttcctagaaatgttgctactaaatatagttaagcagatgtagtactcttcataagcataggacatcagaaataatccacattaatgctgcaacagttagatctttaatcatccaatgaattgagtgctcctggtccatgcatacgttacacgactataccttggaaaataattagaactactatggttacacccaaataaaatcagacaggtagaccatcatgaacttaactaagtgaacacaattccgtttccattagtttcatgattgtcatcttatgtcgttggaccacaatattttatgtgcgtaattctgtgggggacatgattaatggtcctaaggggattgatgaaatgagctaatgaaggggggcacaactggaatagtttttcattgtttagtagcttcttctttcctctctctttctctctttcactgttttggtgatcttgtaaatactttttttctcccctgcttaatataacaccagctttgctggcttcggtttttttataaaaaaaacaactggaatagtgaaacttaagaacagatatgctttgaaactacattcctctgtatctagaaatacagagtttgcagtaacattcacactcacattcaccttcaccatttcacccacatcatatagatgttgattcggcatagacttggtaacaaaaaagaaatacagcaagacttataatatggttgtttctacggaaatgtttctctaaacttcaacaccctcgttttccattagcatatgcttcccaaactgctaaaccgtgttttttttttgcaaaaactttttatataaaagtttctttaaaaattcaaatgaaccctttttcaattttatattaattaataattaattaatcttgtgttaattgcttgctccggtttctgtgccacttaaaagctcaatttttagtcttggcacaaaatcctattggcatgttagggcagattggtttacaaagcagataaactaccaatgtaaaatgagtgacattcatgaactaacatgcattcacctgctgcaaaccagaccggaggaccgttggtgccagtctctctcgggaggctcgacggcctggtctcgctggcctccaacgtcagggcgaacatcatcgacaccggcttctccgtcgacgccatggcgaggagcttctccgccaaagggctcaccctggacgacctcgtcaccctctcaggtacacacacacacgctcttgaatgctggaggatcaactgcgattttcacttttcacctggtctcaccgtgagcacacggctgtcgatcgccggcgtggcgcactggcgcgcaggggggcacaccatcgggtcggcgcactgcacgacgttcggggagcggttccgggtggacgcgaacgggagcacggtgcccgcggacgcggcgatgaacgcggactacgccggggggctgatcagggcgtgctcggcggtgaacaacacggtgtcgtcgacggcggcggtggactgcgacgaggggtcggcgtcgcggttcgacaacgcctacttcgccaacctgctcgccgggcgcgggctgctgcgcacggacgccgtgctggtgcagaacgccacgacgcgggccacggtggaggcgttcgcgcggagcgaggggagcttcttcgccagctgggcggcctcgttcgccaggctcaccagcctcggcgtcaggaccggcgccgacggcgaggtccgccggacgtgctcccgcgtcaacggctgatgatgcgtgcacgcacgatcgatacatacatgcatagaagggatcgacacaatgtatgttgagaatgatcgatattcgatttgttcgttgttgttgatgatgatctgtttgtagtagcagcttggttttttttttctccatgctctggtctggatggtcatgatttagcgaaaggagagtgaaaattaagtgatctaaattctaaatgatttagcgaaaggagtataatgcagatggcgcgagatgcgttttatctgtaactaaggccttatttacatgtcaccctaaaatttttcatcccgtcacatcgaacgtttcatctgcatgaaatattaaatatagactaaaaaataattaattatacagaatgcgactactttgtgagatgaatctttttaagcctaagtgatatatgatttgacaatgtggtgctacagtaaactttttctaataatagattaattagccttaataaatttatgatggattaattagccttaataaatttgtttcatattttataagagaattatgtaatttattttgttattagactatatttaatactttaaatatgtccatatataatatgtgacacgctaaaaaatgttaccctgatcacagcccaagttaagctcttatcaccaaatctctcggactgggagtacacgtatgagattagtaaatgcgtctgttcgttctcgtcagaacctgcaaagaaaaatgaaaaagaaaacgctgtacgtgtcatgtcctcagatagtcacatgccctttctggcacacgaatgaccaggaagaccgttgaggaagcgattgtcccgtaataactccacgagccgggccaatctcggacccaaatcgcagtcgcgcagcagcagtttgggctgaaaatccgtgaaaaaacggcgtgggccgctcgtttcgcccccgcgggtgcccaactgccagcttccgggcgcgtaccggccgaacggaacggaagcttattaattcgttcggcgcgcggcacatgcacgcggcacggggtgtgtcgcagcgaccgggcggcggattccgtcggtcgcctttgtcctttcccgcggcgtctagagccatcaaccactccacttgccggccgacgtgtaagggagatcgattccctctcgtgctctggcggcgaatctcgtttccatctcgcgtccgatcgatcggtagcccagtgcaggccaaccgtgtgcccgtgtgatcgaatcactgcgtggcaggttcggtcaatcgacctgctacaacaatctaggctacgtcctactcctacgtgcagtgcgcgggccaaggaggagggaggaattgatacgctcggaacaaacgatccgctctctgtggctgggaatgggagatgctttgatgctcacatatcatatgggcgacagaccaggagcatattcccgcccggagatgtggcacgttcttttgagcagctagctgcctgcctacctgatcgccttctagacgcggcatatgagcatatcatggcggccaagcaacgcatccaagctttggacgacaatgtgagatcacacctcctcagcacagatcccttccagttccttgccaagttgcaactgatgaatcaagcaacagcgttggagcgagaacggaacagcgacagaagcgccaccatcggaggaatcagctcgtcagaactcggaagtgttccaaggacaacaggtcggcaaggtaggggagaagcgattgccctcacgagtccgtgatcgagaccgcgtaatctatctatctatctatctaatatctttctttttcgttcgcgcgtgtcaacgaagccgaaccaatctaagcacccgaataatggaggaggtcgcgatcgtccagtataaaccaattcagcaacatgcagtttccagaaagaaaaaatatatatattcatggataattgggtacaaagcgtacaacttcataaacaataatacagatatggatgtcagaagataagcatagggtaccgaacaggtcgctgcatcatctttccaagcgcgacaagatcaagctcattaaaggattccaaacgcaattatcagatcaggcagcactcctttaaattactgttacatgtaaagtagaggacaataagcaaatacataaacatgtccaaaaaaaaaatcgaagtcaatggtccatgccaaggcgaatggggcggcaagagccaagcatgcggcatatacttcgtccagccatatcttgcagaagataaccatgaacacggggaaagctatagaatgcagttcttccagctatttttaacttataagagctagtaagcattttgcacatgctattctcccagacttttcattaatgtactaccttaagatatacctgtgccatgggcatttgcagtcccatggaacagggggagctctacagagttgagataacaagagtggaaactttcgaaaatcgttttctccatactatctagtgtcccaagcagaactttcttagacaccagcagcaacaaaatttaacaattgagatcggaaggaacattagcagaaggcaaaggaaatttcccgcaaatacttattcatatgttttgacaacatttctcccgacgcatgctcattgtggcagacgcagctgaccacctagagcttttagttcaccattattatttagaccaagcatacgtcccaagatcagaacacatgcttacaagcgaaaatactaatagcctggctggctgcttcacagaataaccaaacgacaacctcaacagataaaaatgccacggaatgaaaacaaagcagcgaatcgtcaccagaagtcccatcttactcatcaaacactccatcattctcctccaacgcatcctctccccaggggagaagattgcccagtttaccttccttaacaggagcagggttcaccatattctcagcctcgaagcagtgcagaacagatttgggcgacccaacagcaacaggtacgtcttcagtagcgtcgaagctctggtagatgaggaggccaccacagggcagctcctgctctaccatgttgttgcatttgtaagcatcagcattgagctcctttgcccatgttccagcatgaccatgcccaccaaagatggtaacagcaacagagaactccgaagggccaaagcacctgaggaccctcttcaccaggtcgccataagcaagagtagaggcgtcgaagcccacgacctcataactggcgtagctgaagccatcctcaggggtcacatgaatggtagaaaacgctgagccatggattgcattcatggagtagccgcagggttcgaagtcaaagtcacagatctccatctctgggataatgtcagagatgcccgagagttttgtcatttccttagcacatgatgtgtgaccatcagcagaagtcttgaaaaagactgaagctttctccttgtccagtccggtcatgcacatttcaagggtaaccataggttgctccgggtgctgagtagcatagtagatatgccacttctggccaggctttgctggatctccaatcacataagcattaccaccagatttcagatggccaaagtagcggttgaggacagcaacttcctcagagaagctcctgtggggagcaggctgtgcactggggaagatgaacatcccgcgggagtacttcacagcagcaagtggcatagaaagcccttcagcaagctcaagaatccttggaattgtgagcaggagctttgtagtcccacaggtcttaatcacaatcttatcagaatagataaacaggctggactcagagaggacataggagtcaaagtccttgttggacagctcggacacaatggtgcaccgtgcaagatccagaacagagtcaatctgggccctggagagggcgcgcaaaccccgaccatcagggtcagcaaagacaggtgcctcagagaaagtgatctcaaggcgcttctcatagccctcaaacccaattgctgagactgggggagggtcagcagcagacaagacacccattggagcaggttggtcagaacactgtgccggagatggaggagggaggagtgcagggagcaagactagagaactggtcgattatcaggaagcagcagccagagaaataggtcagaagaaaagtgccaaaatggaattgcaagaaatcctaaactactaggatggagaagccgaaagggctatcaggatggcttcttcgcgcactgcaacaaaaggaacaattgacatgattagcaacacatcggaagatacaaaggagggaattaaatctgtatttgatgctt

SEQ ID NO: 25752 - DNA, 4852 bp, Oryza sativa
aaaataagggcatatgtttgtagaagatatatgtgccagaccgaagcatctgagtctttaatgcaaaaaagtgaaactgagataagaagctatcaaaacgataccaaagagtaaacagttacataacaatatgatagattccaagttctaactaggagtaaatatgccacaacaggacaggtcaattaatatctcacaatctgattcaattcctaattttccagtaatactcaattcctacaagccacagcgtcctttacaatgaatcatatatcagtattctttcttatatttagatttacaattgagtctcacttggattcagatttaagatctggtcggatttacaatcgtgatgtcatttggattaagatttagagttgagacttttccgttggacatatgcaaatgttcctatattcacatatgtttcgtccctgatcccatcctatgttaatgataataccatacatttgcattaaaaaacaaaattcgatcatggtgtcacagaaaaagaacatttgttatattcctatggggagacgaaaaaaaactatttttctatgtcttaggatctgaacacacaaaaattcttagtacaatctttaccacgacaagaaattttacaggatagcttttgcagtaatctgcaaatcacgaacaactcaaacaggatagcctaactgcacaagcaagatcaaagaggtaacctactgaccttttgttttacatagataagcttatctacaccaacaaaccaaaattcccatcataaacaatagcaacacatagcaatacgccctacaaaccacaaaatctgtaaaggaaaaaaaaatcagaagtaccaacctacggagagggtttcagcgaagaaacttacaattcaacgaagaagctgtgtttggaacccccgatcccgagcgcgcccccgcgtgatccaattctgatcttacgaatccccccttagctccccccctcttcacgaatatcacgaaacaagactaccaaaaatcctctgagcctacggatttctcctctccaagaaaacggcggcggcggcggggagcgaggaggggggggagttcttatgcaagaaagcgtgcggtgcggctggggaagggaaaccctgatttggcccggtatttatagcggccgcttatcggattcgggtttttcagtgttcgtgaccgccaaggagaggggacgcgcccgacccgctgctcgcgtggaggctggaccggccggcgcgtcacccgtggcaggtgggcccacacgcgctggtgggattcgcggctcacagcgtccgtccgtctccccggtccccctcttcatcggccgggtcgcaaagcggatgccgatgaggtcgcaaaggcaaaaaaaaaaaaaaaaaaaacaaagcgcgagaggatttttttctttttgcaaagcgggggtagttttcggcgctgctttcacaggaacacggatgaaaagacaccggattaaaaaagttttgccaattctagctcaaaaaagaaaaagagagatgacacacaggagcttcagggaaaaaaaaaaaaaaagctcacggctgcgtttgcccaaaaccacacgaatttgtgtgggcgtgcatgagatcgctccatgtgttgaactgttgatcaccagaacatatatctgcagatcagatcgggttttcctgcatgggtggatcctcgtagctctcacaaaagaaaatgcgatccttttttttctcactcttttttaacttcggaccttaatttctttctccgaggccgtgtaatttaaaaacccaaagaatatggatgggggtggatagataatctgacgatatatatatctccggcgtttttcaaccgtatggcaatgatcatccttctggtccatgattcctttcaccacttgccctttgtcttgttcctccgcgcagctagctaggtgtagtagtacaattttatgcgtgttatgattattgtccttactccttcccttttttttctctgctaatggctgtgcatctccttgtcctctcctgtgtttatttcttccttctggaggccccagctgtttgcctttcctgcctgcggggacgttttacagtgcccccacttatacgtgtagtagtgtagtaagattatatctgaccgttaattgtcatgggcattttagtctttatgtttatttcggtggaaggatatttcggtaatttcgcgttcgcacagtattcctcatcgtttctcccgatcccccaccatctgttgattctgttcgccgcctccatcgccctcatccaccaaaccgagcgcgccgccgcgccgcccctccaccagagcccgagcgctccgccggtgccgctgccacgccgtccctccaccggagcgccgaaaagccctcgtcgtccccctccactgccgtccaccttagtcatcaaggtccggcgccgacaaaccacgcggcccctggcgcttcattgcccctcgccggtcccttcgctttcccccgccggacacctcgctgacccacgccgggattctcgatgatctccccaacggccgcctgccctcgttttgcatggagtcgccgaccctcgtctgatttggaatcggagtcattgccacctctctatttttattcaggtaatgcagcagctgctcagcaaaaaactttaggaaggcttctttttgagcaagattatccatttccctaatcgattaattaccgtcgtagtttaaggtcttcaggatttgctagctgccatagaatagagaaagacaggtctgaagtatttgctattgattagaggaatacaggattgtttgaatggtgtttgatctttcctgcgattacataaatacaataatgtttgaatggtgtgaactgtgctagattaaatttgatgctatatatgctattagattggatttattagcagtaaacttataacttaatgttatttatgaaaacagaaattgtcagattcacaatggagtgtaatcattcaattattgggaatgtagttgtgttataaatctatatatgggtataattggttataggaaattaaccctgaacttacctgatcaggtgcatatatgtagcccttaaactgtgatttactgtatacttctgccatcactgtacacataacagccgtataagcttagtatactagatgactctaaatgtggaatttttaagattcatcatttgcccatataagtacattttggttgtattaaattttgtggtttgactaacagttgaactttggaaatatgaattgcagaaatttggaatggctgacaatcacattagtttggaggaggttgcaaacaatgaaagtgtgataaccaaggagtttagaagcgaggcagaaggatataagttctataatgattttccctttgttgatatattcttgaaaactagatgtatctttagagttacaaaaaggtgagacttcttgtgattttgtaattactgtgtaagttccccatgcactgtttttcaacttgggcttatataattaagagtaaattgcacacacggtgcatcaacttagcaggtgggtgcaatttggtacaagaacttgagaaatgagcgttctagtgtaataacttggcagctaagtacaatttagtataagaatttcataagtgatcgcttaaatgcaacgacttgcaagatatgtatgattttgatacaataagttaagaagttatatgacaacttaattatttggagcactatttatacatattcaatttttaagtaattattttgacaatatactggcatggatgtgtacataagcatatttatatttttatcctaataactaataactgaaagtcaattaaactggatgtagaaattattatatttcggttaagattagggaagatgaagaaaacaaaaattctttaaggtaattggatgtacagtataattcttaaagattaaattcaatattataaggtaatatccctaggattgctatgtaatggcatattgacatcgtgaaaaaaactcacctagcatattcttagctaagttgatgcaccaaaatactaaattgtcaagttcttatactagaacatacccacttgtcaagttgttacactcgaacgttcaattctcaagttcttgcactatatcgcacccatctaccaagttgttgtaccgttggtgcaatttactctataattaacatatgatggatgttaaattcaatgttttctgaaaattattacacagtctaactgcatcatatatttcctatgttgcagcagacgaacagttgatattgccatctctgaattcattgtcgccaggagatcagttgatgttgagaatctctgcgaggagaagaaatgaagtgttttgctttggtttcgaattcgttgcagtttctgtgattcagattttcagtattacagaaggcatggaagtgcatgaaagtagtcgtactgaaaattgcattggtggctcatattttgttcttcatgattacaccttgagatttttgtaccctcaaatttaaccgtagaagaaataaaagggtaaggtagtttaaatgtaataagatcacaattctgacagtactggatattgcactgctagcttataatttttcccccttcagttcattgccctgtattttcaaaacccatggaaattgaatttcagtgctctgaattctcttctaaaaacagaatctaatatgcatttcactaacttttgcgctgacatttttttttaccgaaacggatggcaggagctttggccattcatttcagatggactgggaataaaactgtaaacttttaacttttgtttgtctgtttcatga

SEQ ID NO: 25753 - DNA, 5382 bp, Oryza sativa
catccgaacccatatataggaaggtgcagacatttgacctctccaatgctatcatcacactaaactaacgaaaggaattagacccaccggttcaacaactgtacaaaatgactttatgtacatggtggtaaagtagcctagtcagtaaatcaaactgagctgaacaaaatctgcaaattttgtcggtaaatattttgaacaaacaaataagcgtacgagagagaattgtcatttggagttcctatattctgcaagaaatcatgaacatgggagaaaaatataagaactgtttctgatacttttagctgaggacttaccagactccatcacatgctataacaagaaactcggtatcatcagttaattggtcctgccagagacaaaaggggatcattttgcatcagctcatatccagtgggacaaacttaacttcaataacacaacgtagttatccttacagctcgaatttcaggagaacaagtcagcaattgttgttcaggacgcaactttttgttgttcttgtaagataaatcccctgtataaagaagaagaataccagtaacaacacattaaattgtttgtgtatgacctcacaccgccaacaaacatataagctataccgattgctcttgatactgcaattccattattaacacggtgggaacccctagaaaaagatacggaacctcctgcagctactattctctgagtttcctccggaaaatttggttgtgatcattggataaagcgattgccttcgaatacaacagaaataaacagaatagttaggtgacattagagtgcatcatccattatgaaaaaggaaataccagctaggcatttgaaaacaaaagtagtcactgcacctgaccattccttgagattacacaacgagcatcaccagcatttccaacaacgatctgcgtatttctaatgagaaccacacatgctgtacatccttctgctaatggtccacaatagacaggtccctgaaaacaaaaaccaacttgaagtaaataacaaaaatataaaaaccttagattctcgatctacagaacaattgagatattaccagcacacaaggagcacatctgagccaagaccgcccagctgttctccaatactcgttgccactaccatactcagttaattccttgcttgccgcctgatttctcaacatctcatccattctgcaacaattaaggaggaaaaaggattacatattttatatttggatgcacaacaggtgcaataatgaacaccaatgtggcgatggttgtttcttacattcttataaaaagaactcatgtggcatcaaaatatagagttaatggattaactagctgtaaaaacaacctgaaaaaggattgcctcaatgcattagcaaggttactgctaaaatcttcttgctccaaaaccttattgtgcaagtgatttgcgcaataccttgctacagcagaacctgaaatagaagttaaataattgagatactcatcttacataaccattgcgcaacattactcttgagtgcaatgaaggttgcatgtacatggatattataaattttactagcctagtcctccccccacattatgtactatgtagggtgagcatacttttcaagaagtcaaactttgtaggttttgaccaacaattagtcaaagtgctttctcgtcatattggttttgtagctatgaacaatatattatgtggaagaaatcaaagtgaaagtgtacttttaagaagaattgagcatgcctaaagaaaatatgccctatacaatgagaagggagtatcccctcaatcagtacaataaatttgaattttgctgtttatatggggatgagattgaagatcaaacctccatggccatcataaacaccaaagaatgacgtgttagtgagagcatcaagattttcaatagtcgcatgctggagaatagaagagtacacaaattagcctttagaatttcaccaaaattagttgcaagccaaccccccatttctcctacaaaagactggaaggttactcacggcatcttccatggtgctacggtatccttgcatagctgatgaagcataagcaagtacagtgttccctccagaatgagtagactttgttatgtcaggaacttggaggggacgttgaggttgagccatagcggagtctgcttcgctgaaacataataataggaataaaatatccttaaattccatactaagatcaggttacagatcacctaaatactagaagtaacggtgaaaatacgaataggaattattggggcagaatgaatagaaaggttaactagcttgaatttgaactgcattttgcagaaacaaaaaatagatacgcggtatgccactgtttgcaaagctcaaagcataactccaatattttggacacatattgttgatgagcgagcaagcaaagatgactcatgactctaaagcagtccatacaaagcaattttttggtagacacaggtcccacggatgcattccaggatttttttttcttctttttatatcttgcatttataatcttcaagatacacaaatgccatcattttgaacccaagatctagcatgaaagttagacctaaggtgaactatgatgatacagtaaaaaatacatagaaatttagcacagcataatagtaaattttatcagtgcattccaacagagggaagtgaaaacaaacacaactgcatcatacaaaaagtagacaagattacaatcatcttgcaagaataaaccagacaatctgaagaatgaagaaattcactcgaggaagtataatcaaaacatatggtaacgactaatttagggaattgattaaaaggaagtataatcatagattctcgaatctagcattcaagaacaagaataaacgagggggagaaaactctgcggtcccaaatttcagttctactatggtctaaggatggatagatgtttaccaaaaacgaactgccgaacaatgtaacactgcagtagtgcacaacccccggaaactggcaacaaaatggaaaagtgttaatacgcttaataaacagaacgcgtcgatcttgcaggaaaaaaaataactcggtcagcaagaagggaatcctaatgaagatttggcatataaaaagcagaaaattaaaccaaataacaggtaaaaagcacgggcagagacatccagtttccgctcgcccaacaagaccagcaatcgcagcagaagcccaacgataggaaaggatgttacaagcctacacgttctaaaaccctaaacccacatgaagaaatggcgatctcgaacattccggaacagaaaatagtttcaaatggaaacaagcgagagatcgagacgaagcagccaccctcgtgttgccattgcgcatctgtgtagcaccgtaaaaaaaaaagaaaaaaagaaagagatgcatccaggaacagatggtgggaagaacaaaaaatcaccgagttaattccgagaagactcggatgcagcctcctccaagaaaaccaccgatcacgactgaaacagcagccaaaaaagcaacgataatgaacacgcgaacaccagaagatctaagaagggtaaaaatctcacgaactttttggagactgaagggcctaaaaaagagagacgaagctcttgcaccgtacaccgaagggatctagtagacgagaacgacaagaggacgcttcgatccgacggtggaacgagcaaaacccgtgggagttgcaaacacggaggcgaacggagatcaccatggaatcgcggagctcgtccgcctccggcaacttcagttcatcccatccacgaaaaccaccaccagtagcagcaaaaccaacggcaccaaaacccgagaagaaaaccatcggcagcatcagcaacagaaggtcagaagcacgcaagaacacacacgacgacaagaacggagcgggcttaccaaaccagtagcacgcacgcacgcaccccccaccggacgatgacgagaaacaccagcagcgagcgagcgagcgatcgacgttaccaacaccagtagaacacagacgcgcggccgcaagagcgagcgagagagcgagatcaagcacagcgaaatcgaagcacgaagagaggcgatagatcgagaattcacaggttcccccgcgaggaagagaggcttctgatcggtggaagcaaacgaacaaaaattcagaggagagggagagatgggaggagagagagagagagagggagagggagagatctcctcacctttggccttagcgcaagcggtcgccttccatgcaactgagggggccttcacttatactacccgggcgtcaccaccaacaccaaccaccccccacgcctcgctcggctcggctcggctcggctcggaccagcaacggcttcggctccggctcggctcgcgcgcgtccggacaagccccccgcccgcgcctttcgcgaggggtttaacctgaccacattaggaagtttgttactggtaactacagaatccaatgcagcagtgcacgaacaaaatctcaagaaacaagaaggattcgtagggggttaagagcgaggtcaatatatagccaactactggctccaaaatatctatagccaatctaatagtctatttatacaatagttaactataaaaatatactgcaccattaatacacggtcccacctctcatacacacataacatcttaaagtccgtgttgcagccggctacaaatctgtagctcgcttttttatctctcttcttttttcttctcgatatatggttacagccggcttatagcatgctattgtacatactcttagaaagaatatgtgcatattcggtggtaggcgcaattaatagctaaaccccctggttaattgctaaaccccctggttagtctttcggtggtaggcgcaattaatagcttgatgacgtaactaagcatagaaagaataggagcatattcagatgggctttgtcacgttggcttgatgcacgtacgcatatctaagttcactgtagcctgcactgcacaacctagccttctttttcactgtgctagctgtacctcattccccatccaaggttaattttctccgtattttttaatttatttctggaggaatactctagaagcacgagaaaatatctcgagtttgtttttttctaagattattatttttggtgttaaatagactttcagcattttcacatttgagttgaataaatgagcaattatggcgattgatctcacttgaatctactagtagcaataacactaggaaacgtctagcaagaaggggtggcacacgcaaatgtatctgcaaaaattcccatcgagaagccggcgtaatcaggcaacgaatttaaataatgttgaaattttcctct

SEQ ID NO: 25754 - DNA, 874 bp, Oryza sativa
aggcggaggcggcgaaggaggacgaaaccccctgctcctcgggcttcgtgtcgcgaagttttgaacggcatggaggatgtgggggtcgccttgtcgtgtgtgtcccacatggcagtcgcagtaggcctacccccacccaaacactagaaacggaacggatgcttctccgctgtttttttcctctctttggaacaaaaggtcagagaacatgtagtatgcgtgtgagagagaggacatgaatcgccgccatgggcgaggcctgcaaataaacaagcctggatatccatggcaaggagtggttgcaacgaaaaacaccaggaatgcagctttgatggaagcaatcaagcaacgaatatcagtcaagatcacatatacgtttgatggaggcaatcaagcaacaaatatcagtcacgatcacatattcagttattcacatgcatttacttgcagttcataggcaatcaggctgttatagtcgtatcgtacattcgtactgtacaatgatgttcatctatcgacttgagctacaacaggcaataacttgacccaattcacttgtcatgtatttttggtaagaacaacactgccatgtagtttcacagaatacagcaccttttcttcattgttgattcctatcctaaacgaaaacaaaaaaacagctcattattggttgctcacatcgtcacacggctgtggtgatggccaaatatccttgcaagctaaggtacaagagaacgtggccagacaatttgctcaacaggagcaagagcatagcccccatgactcacttgaaggtattttacctgagaactctagctctacaacttctccctgacataacataagtagtctgcttacacctcgaagatcagct

SEQ ID NO: 25755 - DNA, 1117 bp, Oryza sativa
cgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctga

SEQ ID NO: 25756 - DNA, 1202 bp, Oryza sativa
tgcattgagtgcaaggaaataggaaaaaaaataccaagctgatgtgaaggtcttgggaatcaatgtatcatgggattcagaatagaaaaatgaaaaagggatcaatcagagaatcactacgatggtaaaattttgaatgaatggacaaggataggtgctttctttgactacttcacttgccatacgcactgcaaacccaagtcacttacatacacactgcaagcccacgtgtaacatcattttggcaagaggtgggaaacgctaagccggttttccccttgattgaggataagttgaggaattccagcagatggtcagccctcaactcgataattgcatgtagctttgcctaattccccaacagatagctaaagcaaccactctacgtctctacccatctttcatactctctcaagctgtttagcatatcgacttatatcagtcacatggatcatgcagtacgattaagccatacaggttgccattctaaaatgaaacatccaaagatattattcagtaatgccacaatcattcttcagaaacatcacaaccaaaaatggaccaatctcccccgcccccgaaatgaagtatgaaatgctaaccatataaccaacagaagaacctaatccacaaaatcatccctgacgatggactagtaagcatcacacaacgaaaaaattgttggaaattcatagcgtgatccttatagtgatctagcccgctctacccatcatcatcccgtaatcttaggacgtatagacactcagatcagacagaggatcgggaaaataagtccataacactggatcgagcgggcaccagagacagccatctaacacgggcagaaacaggagaacttaagtgctcgtcagaacccaatacgcccgccacgaactcagcaccaggcgcgtacatcgaggtgccatccacaccgaagagatccacacgaaagcaaccaaactctgaccgcgcgatagacggattcaaatcgaaccaaggcacgtcacgggcagaacagatcagaacccccaacacacggcatgatctgatcgggagagaggggatccctcacctcggccatctcgtggcgtcggagactggggaccggaggcgaggatgaggggggttggaatcccggcgtcgcggagcggaggaccgagccgagaggaagggggagaacgacgacgacgacgacgtggtag

SEQ ID NO: 25757 - DNA, 5243 bp, Oryza sativa
  unsure (1)..(5243): unsure at all n locations
gttaggtcaatagaagcttctagaccagatcgcctctatgtgaaactatggtgaatttggtttacttttgctaatacattgcataaggattatcatgcaagtgctgtgtaaatacattacattctattccattatctaaaagaatgcatcgcatttcttttcttcttcgtacttcacacgaaaacaaggattcttggatgaaatattctggttgctctcgaagttactcgccgtcataggctccagcttataaatttatggattattcctgccacaaactttaaattatgatttttctatatatattctgcattaatataatattgcttagataacttgttctaaaatacttttatgtttataatatgtaatatttaattaatccttataagcattaattatccatatatccaatcatttataaagaacaaaaaccataatcaaatgctgagagatatatatcatatttttcgtataaaacttattacctctagataagtacctcgagattctaaaatttgtgtgtaaaattttagtacctacaaatattttctcaaacgtaaaatttgtcattttctaaacattataattcagaactatttgactacatatatgcaccaagaggtttcttattccaagtatatacatgttgaattgtgcgtgtgcatataaaagtttgtgtacattcttgaccatatgaatacttcttacctttcaaatcaatatattgaacgcaaaaacggaaaaacctaacaattttatttcctaaaaaatacagtagtcaagcagctgctatagtcagcaaatatagttagctactttcatcgctcacataactcatcaatagattatacacaaagttatctcctcaatagaccgaggatatagatcatactgttgtcagttgacaaggttggcagccactcttttctcatttaggagtatatgtaagattagtcttgcctaacattctccagtcatacgcattccaattaatattgtgtcttactccctccgttccgtaaaaacaaatatagtacgtgatatataactttgtagtattacgaaatattaggagcaatcgtttctattttggcttgtaattagagggcgtttaattagctactcaaaaaaaatactccatttgttttaaaaaaacaaatatagtagcttgatttataatttacaaggatcgaaattaaggagcaatggtttctattttgacttgtaaccaaaggacgtttaattggtcataaaaaatactcgagatataacctattttattaccgtgaatttagacagagatagaaaaaccattgctccttcttatccttgtaataaatcaaactataaatgaacccaatcccttaacaacatgtagtaccatcataaatatatcattataatcatggaatgacggaatatgttagtacataatcttaatagccaacatttactgagccatctttatgtcatatagtacactaatcatctactaaagaaaagaagaacaataattattgctattttaattccttacaatatttttggccaccgattgaaagtgtgtttatttgacccattttgtcatcctaaattagtttggtagtcacagtcttcaatcaacccgagttataattccttgtcctctcctccaccgtaacccgaacagctcttcttgtcaaggttaacaaaaccgtatgattatcgtacgttatagtggttatcacgtacggtaatcttttcaactttttaaaaatacggtataccacgctgtaagcctgtaacgtcgtcccaaacaatttggcgaagctaggtgaggtgacgctaaaccccgcttcttgccgacctgagagtcggagagtctcggcacgacacgacgagaacgatctgataaacactcgaccgcaacgtccccacacgaaaaacgtccagggtcgggtggggtgaaccgtgtccacccaccaaactccaccagtccacccccatccatccctgactgtccgactccgagcccatcgcttgcggtcgccatcccaccaaccacccccctcgccccacgcggcccccacccgtcgccttctccaacgaacgacgccacacggggtggaagaaaacccgaaaaataggaggaaaccgacgggggaaagccgcaaaaaaaaaaaagtagagagaaaaccagagtgagctgcgcagctcatgacacatgatggtgagctacgcctacgcgagctcggagctcagctctaaccccccggggcccccccccccccccccgggccccaaaccggggggcccccccgcgacgnccgtagnctataaaagccgctccacccccaacgagcccaccagctgctctccaccaagagctgctccgcccccctaccccgcaacccgttgctttgttccgcgcctcgctttggtcttcatccgcctcagatctgattcgttctaggttggtctggtgagtggtgcttggcgtttttgttttttgttttttttttgttttcgtgtgtgaggggattgggatgctcacgaggtgtttggtggtatgcgtgggcggcggcggcggcggtggcaggggaagatggcgatcacggtgaggcggtcgacgatggtgcggccggcgtgggagacgccgcgggtgcggctgtggaactcgaacctcgacctcgtggtgccgcggttccacaccccaagcgtctacttctaccgccggggccccgagggagggggcgcgccggaggggttcttcgacggggagcggatgcggcgcgcgctggcggaggcgctcgtgccgttctacccgatggccgggcggctcgcgcgcgacgaggacgggagggtcgagatcgactgcaacggggaaggggtgctcttcgtcgaggccgacgcgcccgacgcctccgtcgatgactacggcgacttcgcgcccaccatggagctcaagcgcctcatccctgccgttgattacaccgacgacatctcctccttctcgctcctcgtgctccaggtgagctccaaatttctagtagcaagtacagttagatccaagcacaaaatcaaacgaggttagagatagctttctggaagtggagcgcaaacaatgctttgcaactgcagctgacaactaagtttggcagtaagccattaattataacattttggggctgattgtatagctaggtcccatgttggctgttgcactaaatgtttggggctgagcttagcgggtcacctactctttggttggctttaattagctgcatcagatgtacggttccatccaggcagttgatgtctttctgttgtgggcggggtctatttttggtttgatgtttatgcttattgtgatagtttagtaggggttgtgtaggaattatagaattttaaaacaccataattcaatgccaataatcagtatccactaaaaaaatgaagtatatgcttcaccttgactgtgtcaaagcctagacaattttgatttgtccagagtgattgtatcatatagatttgaaatgtgtttttcacgttggactccacattgtcttctatgttataccatctaaaagtggcagcagcgtgcatcaatttgtgcattaagagtaacagacaacaaaagccaccggtcgtgcgggtacatccctgccaagcttgagaaactaatactagaggactactttattaagtagccctttaatttgctccggtatatccctatatcctgtcctgaactactacacttatggattcatgacctacagatatttgaaccgagaagcttatcccatttggagctttttaacattggatttgcacgtttaaccctgaagcctttgttgaatacttaaaactttgtggcgatgactatatatattgctttgatcacttaagcataagtgccgatcattccatgtcattccatgttactgctgatatttaagtgttttgatgccagaagtaatggttagattgcattaaaacttgttattagatgggaacaattttagtaggcactaatgtttttttttcttctagggcctctatagctcccatatatggttgattggtcaatctcattgttccaaaatgtcaaccatttgccccatgatgtagacaggaggggacttaattgggtgtgatattaacattttgtgatagttagtctttgactgacaatagctttcttttgcctgttcgataactggagcccttgtcctgtagagcctcatgagctgtttatcctttgatggatacatcattcaggttgcacgttcaattttgtcctaaatgaaacatgtctgatctgctcaccttctggttatccatcatcagctgccctttcatgctggaattcttgtacaataaatcaattaggttgaatgaatcattagtcttacgtgagacatacttgactttgaaataatatggtacagtgtacaacacaacgtgttaatggaaagaatttatttgcttgtaagtctagtagaccttaggagctaaaattttatttagaaaattgttctaataattgaggcacatgctaatactttttccttgcaactgaaaatttgtgcatgcactttccataacataaaactgggccaaaatttacaaggttacaaaccatagtttcattcaatttttttactcgctgatatgtcagcaaccatgactctgagtagtcttggtgcactgcatgttggttggtatggatctgagtgttaactggagcatgttccatctgacaagtttttgcttataataagttaatagatagtactgttttgcgccatattgttccaattttagaagttatttaaaccttgatttcctctcttttatcaactctagttgttgctaacttgttgtaacacctgtttagatggcaagctgacttcaattgtggtgtgcatgcatcaaccttcttttttttgtgggttgggttgaccatggaatgttgcatcctgagctagacaagccatttgcatgtagtccttctctgttagttgccaataaaatgtcttgcagctgtggcaaaggtacttttgcattgcttggtagagtgcttgtcaattgttggatcctaacaccttgttaatgtggatctgaggcctgcgaatatcatgcatcccaaccccaaaaaattgtagagaaaattatgttactctttatctagtgcacaattggagcatctcttgtcatctgtagttgattccttctatgttcatcagaaacttggt

SEQ ID NO: 25758 - DNA, 564 bp, Oryza sativa
atgtgcagtttccccttaacaaaaaggtgaagaaacggttagttttcagaggagcttgcccatggcgaggccgatgccggcaatgccgacgcagacggcgagcgcgagccaccacgcagcggccccgcgccgggcgccgccgtcgtcgtcctcgcctcgtcctcgccgacgccttccttggccgagccggcggctcctgctgctcctctgagcccggagttctcggcctccagcatcatgacccaccggcggtgcgccgacagcaccaccgagtcccgcaccagcagcgccgagagctcgccgttgctcgccccggcggccgccagcttctcctccgcctcccgcgcccgcgactgcgacagccgcagcgcacgcatcaggcggtcgccgccgtcaccaccaccgccttcgccgtccccgcccttccgatccgggctcgtgctcgtccacgccgccgcgttctccaacctccacatcaacaaaaagggtaaaaaaaacaaaaaaaaaaacaccgcgccgctctaagcaatgccacactcgcgaattccacggcatcgatcgtgt

SEQ ID NO: 25759 - DNA, 270 bp, Oryza sativa
tactcattttctcttgtagactctaaatgatagaacaattaaggtagactttactagatcgagaaagaagcagtatgttgtgccatcagctcccatgccgaagcacagcgtttttgtgggtaatctgacgtggagagtgagatctcgccatcttcgtgaattatttgcatcaaccccaggtgttcaatcagttgaagttgtcttccataccacaagtccgaggcgatctgctggttatggatttgtttccttttcctcaaaagaggcagc

SEQ ID NO: 25760 - DNA, 1705 bp, Oryza sativa
gctagaaaaaaaactatatcaacatgataccatattggtgattcaacacttaactgatgtgacatagaccaactttcaatgccccctaccatatatgtatttggtctaccattaatagtaagcacgacagtagtcaaaggaccaaacttatcagtaagggagatcacacatgttcctataacaaagcggaatctaatatgcatgcatatagtattatccaattattactatcatgttgtcttgcaatttcatttagtcatcaatacacattgtttacctcatgaactatgtccgtatttgtgattaggtttaaacaattctggctcacatttattaattataaaattgcatgcctgcatgtttcatgttaattaatgataaggcatagtacatgcttgcgctagtttttgtatcacttgtactcttgtttgaaaatttttttttggctgatggcagattctatggcacattttttatggtagaatcagaaatcgggaatttgatggaggatgttgtcatttgtatgcattattacatgacaaaagtttgtatagaagcacaaatttgagtttatatgtttatggttgcagtcaacaattttggtggcaatgcttatgtcttgcatcctaagtcttggaaattcaattagaaatccagtacccagtatagtatggaactgagtttcagttcaacaatataacttgcagatttttgaagagttgtgtcagtacatagttaatttctgacatccagaatgtttatgcctattggtgtaagcaacttctatctgtgtcattcatgtactatctatctcaatacttgtaatgttgctataatggtatatgcagttgaaaatatgaattatatttatcttagtaagtgaaacatttcaagacactgattctccttggttttgttattttgttccaggtgacctacttcaagtgcggaggtgtctcccttggagttggtatgcaacaccatgtggcggatggcatgtccggtttgcactttattaactcatggtctgacctctgccgaggaactcaaattgccatcatgcccttcattgaccgcactctcctacgagcccgagatccaccaactccatcatacccacatgttgagtaccagcctgccccagccatgctgtcctccgtaccccagtctgttactgctaataagacaacaccacctccaactgctgtggacattttcaagcttacccgctcagaccttggtcgactgcgttcgcagctcccatcaggagaaggtgcaccacgtttcagcacatatgcagttcttgctgcacatgtctggcgatgcgtatctcttgcacgtggcctgccttctgaacagcccactaagctgtattgtgccactgatgggggggcccggaaaacccaaaaacgggggggttttttgggcagctccacttccagaaggttactttgggaatgtcattttcaccgccactccacttgctgaggcaggcaaggtgaccagtgggctggcagatggagcagcagtcatccaagaggcgctagataggatgaacgatagctactgccgctcagcattggactacctggagctgcagcctgatttatcagcattggtccgtggagcacacactttccggtgtccgaacctcgggctcaccagctgggtgcgcttgccaattcatgatgcagattttggatgg

SEQ ID NO: 25761 - DNA, 721 bp, Oryza sativa
gagagaaataacatcctgaatcaaaagcagaagatatattaatcacaaggaggctagcaaaaaatagaaagctacagaaaagagatctaaaatcatccaacctttagaatatcagcagtggtaattccagattccattagttggcccttgagtagatcaaatttctccggtgtcagtttgtttagtatactgcatacgcacaagaaaaacaggcagcaagtcaatgccagaaaactgtgttataaagaaataaagaaataaagaaataaaagcactcaaaaaggaacaaaaacatgaaaaagactgaacgataattatgataccctttcactgttttcaggactctatctttctctgagagattgcctcttctagctgaccaaggtacctcagccttgataagagcaggagtcgggccaacctgaaagacatacatcagcaaaggcctgatcacaaagtcacaaatacatacaagtatacaagttatgaaagaaaaatacatattaaaacatgtgaattgatttcatacaacaaaataatatggactgtcacatacaagacaaactgacattgttctgtaccaatttataacccgacacttcttctgtggtttacatttcaacattcattgcaagaaagatagggttaaaagagcatagatggcactagtgatcaattgtgaatgaggggacagcaaaatgtgtaaataacactgttgagt

SEQ ID NO: 25762 - DNA, 6217 bp, Oryza sativa
actgcgaaaatagggtactaaaactcaacccccccccctctcttttattgcatttcaagactacagagtaaacaagtaaccaaaacttatatcgaaagaaagctgcggctcttccacttgaggctagtaggtacagtttcacttaaatatcctgtgagtgcctctatttccatcctagatcggtgctactttgtatatagcatagtctaaagttaaatcattcatcactgaaatttccaatgatatgctagcaacgcataccatcgaagtactcgtaccagcaaaatttctgttataaccatttcaatgtggccaatttagacacttctacatttattgcagccaaagttggttgtgtttcaactttcactgcacgaatacctaggggacattaacgtggtatatttcgatgtttgtgtgctatgcacctagttgcagaaacaccacctacgcgatattgttttccatgtctgatgtgttgaaaagtattccaaatagaaacttctgctctaatttagctcaaatgtgccagatacgctgcaagcatttttcaacaaaaccaaacgacagggagcacgtaaagcagaacatgtctactaagatattcacagcaaatttcccatccagaaactgatattgaataacacaacagattgcaagtacctcacgcagttcgagaagttgatctcttgtatagcgaacacgctcgcgcacctcaaaatttggatcaccaatctgcagcaaaagtatcagccatgtcagcatatcaaattagaaaacacaagtccacaactccacaaattaaatcacaggacacaacattttggctaataatctgagagattgatccaacaaaaaaatatttgacataaagattacataacacccacgacaacaacaacttgcttgattcagctaaggatgcaatacataaatgctgtttgcagttttaaaacaaacatatatatgtatgaaacttgccgaagaacaaggcagactcagttaacttatatgcacggcccattgtatcgcacaagccacatagaagagcaatagaagccctgaaagctaaaacaacactggaatccactacaaatcctaagtatagcatgctgaaccatgaaatatccaactttaattagcaaaagctgtcatatcacagtcgggactatcagctccttgtctcgcattaaccccctcctaaaactaggtcgagccgtgcaagcgataatcaactacaaccactaacgcccctcccagattggagcatcgatttgagatccgatcctctcaccggatctccccctcccacgcccgccaccatcccatcgaatccacatcgagcagtacatcaagccgccagatcgggcgcgtccaagctctcatcccccatcatccccccctctcaccttggatgcgccgccgacgtgggagcggagcaagtcgccggagccggaggcggcggcggcgaaggcgggggagaagaggcggccggggcgggggccgccgccgccgccgccggggcgcaagctgatgacgggctggtgatccttctccatgcttctcagacggggggatgggagggggatgaaccgaatccggaggggccgcgcgcgagctcgatcgaggcggtggggggaggaatccgcggggaaatcgcggagaaatcgaaaccccttttcccttctccctcttcggcgagagaaggttgcgtttgcgaggggaggaggggaggaggaggaggaagggggagcggaggcgtggacgacgggaggagggtggggttttatcccgggtgcttttagggctgaggggagggtgggtgtgggtccggatcgtagtttccgcacgcttgcgtgggtagtctcgtactttcctatgcgcctcgcggggattttactggcacactctctcctggtgcctggtggtgtgcgctggtgtatttgtgtgcgggccggtatttgggtcgtggtggttttgggcacgagagattgggatatttacgattgggggtatccggggcttagctggtttgtgacctgaggggtgggtattaccgtactttgtgcagttttgctctgcgtgctcgactgctcgcatagtcgcatccggcttacggttacttctgttcttcatcgagttggtattatataccagatctgttttaaaatataataaatatattttctatgtaatatgaattaaacaggtcattaagagagtacattttaaatatgtatctaggcttaatggagaagtctattctgtcctagggtctcgaggtcggagtcttgacccccgcgtcgctctcacgcgggcggctcgggggcgaaaccctagccgcccgcgccgccacaccttcttccccatcctccacctcgccaccgccggagctcggcggcggcaaagccggcggtgagccaggaaggcggcggcgaggcccatacgagtcagcggaaccgccctctgcgtgaggaggacggagatggccgatgatggcacggccggaggtggagtcggccggtcagcttggggcggcggatccggcgcccctgtggcaggatctggccccccacctgcgggccagcgcggtgggcgacacgacggaggcagagaggggcagcgagcggcaccgatggaggacgcgggtctcgatcggcgatgcagcagcgaggcggtggtggccctcggcccggtgatggcggcggccggatccggtgatggcggtggccccttgaccagatccgtcgccctcctggccggctgacgacggcgagctgcctaggagaggtgggggccggtatgccctcgccagcgcagggaaggctgcaggaggccggcgacggaggactgagccgggtggcgggcacgtgacggaggcgggggcctggtgctgcaacggaggcggggggcgggtgcgcccaccggcggttgcgggaggcccttgtgcgcggaggaagtggtggccaccggctgcgcccactggcgtcttggcacggcgcagcggagcgctcgtggtcccgatggctggccgagcctcgacggccggtcccatggccgcctcggccggtggtcgatgcagcagtggatggtggaggcttggcggctcggcggactggtgaatctgcctgagctgtgggtggtgggctaggcttggcggctggagtgacgatgtggtggtccggcgacgttcgttgcacgggtggattgggtggttttggatgacgctgacgaaagccttggctggcctttggttggaggcatcgttcccctccttggaggcgtcgttatggcgtctccctcactaccaagaacctttcccatgcaaggatggtcgttcgtggaccccgcgtcgaagctctgtaagcctagcttttcggcgaggccttcgtctcctaggttccattcttgatgtggcgagcgtacaactttcttcgttttcttctaggtgaagtcggagctgctttgttagggtgcaatgaagcttggcaacaataacatgtgcagttttcgaggggcgttggtgttagctgcgttcaagaagtggtgctctggtgatttgcgctgatgttcaaagtggacaatcgatgtcttgcttgttttctgtgatgcatttggcaacgatgttgtgatagctgtggagtcgaagctgctgtgtcgctaggcgacaagcccggcaacgataacatttgcttcacgaagtcgaagcctttgtatcgcttacaacaagctctttatcgatagctgttttgggctccgccatttttcctttttccatggtgtcggtagcttaggttagagtgttgtggttttcgcccagttttcccctaattaactgtgcattgtaaggtttggtctcgttttctccttaaaatgagacaccttcttctttatataaaatgtcggcaatggcctgaccgttcgaaaaaatgtatctaggcttagaaattgtcttagaagcttgaaattctcaaaagcagctgataagaattcataaattctaaaagttttttttactttttactttgaatttattttctagacttttggtaaaaacatgaacagtttgaaggggttaggcattttatataagactagaaaaaatgtctgtgcaatgcaacgggtgaaagctattttaatcttatcgttattacttattatacgatttagttaaggtgaaattcactttgagaattcgcttggatatatatatattttagaaaaccataagttgcaattaggagtccgaccatctaaagttagcacgtgagttttttttaaagagatttcctatacgactccttctgtatttccaaaagcgaacgaactttaaaaaccgactcaaatacagatctgtatttccaaaagtgaacaaacttaaaagccgactcatacacggatggcgtaccaaagtaccgacaaaaacatcttaatccttataatagtagagtgggtatggttgtcagaaactcctcccttaaataacgactaggaatatatagttgagtgaggtggtggataggtcatgatttaaagtatattttacaggtgttagatattgtttttgtatgtttgtgatccccccttgtttaccatactaataacgtttattgcaacaagcccatagactcgattgcacgagtacatatgactagggatgggttaggacgatgaattgagatccaacctcttatggtctatagagtggaagaagggatataagcataattgagacctaaccatttgtagcgctgggaggaggaataagaatggctccgcttttaatcattagagactagcttggtttcaatttatggtctttgctatctttttctcgtttggatttataagatgcaaatccgtattgagcaggtgtttgatactacctcacatattccccatgcccaaatgtaattatgctttatttatttccatatctgcattatatttaaaaaaatcccatctctactgcatctaagtcccactctgatatattttcataaatagaaagttttataaggaaaatgtgagctctattgattatgaaatcaagttacaattgtttaatagaagctcacgaatataagttggtgtttgcacatgccataccgcacaatgcattgtgcacataactagctaagttattttataatgaaaataattattctagcttttgtttcaaagaaactataaaagttgcaggataaatgattacaaattataaatttacggtttaattaaaagcaagacaaccacttaaaatacaacttaaatacatatatttctatatatatggttggtcagagtatatatggtgaagagaagatgcacatcggtggtatgcacggcaaaggacacaaagatgtccgacttattcgctaatagcctcgtcgccattctcgttctcgtctatgtccaagagaaagtcgggtaggggtcagccacaccatccccaccgccggcctcgcgctatcgctctcagtgctcgatgtcaccacatcgttctactatcacaacacctcgtccttaagaacacagctgccgtcctagtgaggctgtttgggatggtgttcaggtgatgctcatgaatcgaaggcgccgattgttgttggtacatgacaccgtcgtcaatgtgttgggcacaagcgacgtggcacaatacaccgtcgtcaagataaagtagcaactgcaccacacgcaatatttgggtgtacaatcatgtgctggtggccactaagaaagagagagaagggatggagggagagaagaggggcaatgatttatgggtctcgctataatttttttgttttcttaactagggcacccactattatgtgggcctaatatttgttttaattttttctaaccagattccaaatgacacgtggatcccactagtgttttttatattttcttttagtgccatgtaataaattttacgtgagacgaagaccaagtaaacatgttataccgacatcatgtgagccaaaacaatcttaatactactgagagactcgacccaatcttatgattgaggaagaaactcgacctatgattaagggacgtaaagtggaccttttcctatacaaattcagccacagcccacgccccacggcgacagttcacgcgtatcagggatcagaaccaaacgaaaggctggcctgctcgttattttggtctggcccattgaaagcattggcaaagatccagtccgttg

SEQ ID NO: 25763 - DNA, 31649 bp, Oryza sativa
  unsure (1)..(31649): unsure at all n locations
gaattttttatttagatttcttatatgactccttctatatgtccaaagacgaacgaagttaaaactcgactcaaatacagattgtatttccaaaagtgacatgggccgacatgacgatgacgaagccattagccattaggcgtcgttctccttcttgaaggtgtcgttctgacgttgacatttcttagcaccaagaacctttcgcatgcaacagtagttattggtggactcctacgatgcatccgaagctctacaatcctctataagtttctctgttttttttgggatgtctatacatctattgatagaaaatcccacctcccatctttcaaatgttggaccgttggatgtgttttaatattcgtgcagatgcattaaccctacctctcatcctcctgttcccctcccgtcacgcgtccgcacccctcccatcgctactcctctgcccgatccgccgccaccgcccgcctcgccggctggccggaggacgtcaacggcgccggcgagaccctcccctccccccttcctccttgagccggtggcggagaggtgcccccgccaccgacgccggcccaccaccctcctccagccctgcggcgttgccggcgcctcacccgccgcccgatccgcctgccaccgccgggctggcggcttccccagccatccttctagagccggcgaactcctcccctccccctccccttcccacccccaccccaccccaccccgcgatcctaacccgtagggtccttgccggcgccggagaaaaagaggaggtcgccggagttggaggaaaaggcgtgatgcacgaatcttgaagcccatccggtgtcccaaaatctgtaagatttggagatgcaaaatctgtcgaaagaaggttagcaatttcgtttttcttctccaaaataatctaccgtgtaccccgtgtaatgctgtgacgggagtgggtgcttgtttgtagctgtactagccggctagccgcgaccggttccatcgatacctcatatacctatcacgtgtgccgtttgcgcgtagggaggtttgatatagtagatcggacggctctcgtgcgcggtgtgctagatggtgcctgcaatattttgctcgctccgcgtcaaggccatgatgcgtacgcgtgcttctcacacgaaggtccccacctgtcagcccagccacccgagtacccgacaggttctctgctgcactgcgcgctctgctcgccgcggtcgccggcggccgacccgcgtgaaagcgtggaacatatccgagacttagttggagacttgggccgcaagcagattggatgagtttggttgttgccttaattattattaatcacccgtctcttaacgggtcggatcatatgtttgttagcgagaccgagcaggatacctgaattaatgaatttaacaatccacatagctgtacaccctataaaaggcagcagctagcgaacaagaattttcgtgttttgtgtgttgacatgaagataactactggtgacaggtatatacatgtgcagattttttttttcatgaagaaatacggataacgatcgctaatgtgacctttttttttcttttctctttctcgcttatgtacaggaaagaaaaacggaatgttggattcaagattcctaagaagaaatttaggttttgtgttcgtgatgagtatggcacgaaggcattggctgagcaagttatggttaaatccacgtcactgtggcgcgagattgagcttcgtaccgagacaaggatgattacagcatttttttaccatgggtgcggccttcgcacatggtcagcgtacaggcagaacatccctatttttaataaattgcatgccgcattaaacaatatactcagaaggtacaagagtcgtcgtgtggaaattggcctattttatctgcaatcaaatatgaaatgttttcagtttacagtccggagtcctttggacaacaacaacgagtttctgaaaaagttacggaaaattaaagcacacgaatgcaacatgagagaagataatgcggagaaaactggaagcctttcccctataattatggggacattgagattagttagcaagaggcatgtacttggctttatgtttgtgatatttttatcttgtgtaataatctttctatgaaaatataagatatcttgaacatcgcctaatattaattatttcttttacaatgatccttcttcatattcttgttggttttctaggccttgaaaacaacaatagaactccaagaccatagcaacctacttttatattgttgtacaattattcataaaaacatgtaaaaaatattttgttatgtaaactttatagcaagtttttttcctatcctattggtgtattgctggcctaacaaaaaaaacatatattttatcctcgccagtttgttttattgcgcaagcgttttttggtaggcttgcggttttttttgtccatccggttttttccgtcagtgttttttcacaccgcagttcggttttcatccacttgtttttttatttgccttttttttcgccgggccggaccctaatgttgcctccacatcgatctttcttcccatgcatgcgtcgtttcccccatccaattgatcgcaaaaatcgattctatactcatccttcatcattttctccatggtttcccctttcaactcgattttaattcgtcggatttaatctccatttaacattcgtcgatgatggctggccgttgagctttcccgaccattttatctgatcaaaattccttaaccaattttgggagatcgagaaaattcagccggactttatgggtaggatcggctccggcatcgtacggcacaaaaccatattccgaaggttaaaaacggtagtcgactgtgcgagctaggcctgtggctccacttgtccgtgggcctccgccttcctccccacgccgcatgcctccatccacccaacatgcactggtcgtcgctcgccgctcgctctctctccgcccgccggcctttgcttccctagtcgcctgttggcgagctcccaaaccgcataggatgccactccctccctccgcatgtgcgccaccgccgctccctctgccctagcccacggcaactccctccttgccgcctagccatggaactgaactgggttgggactagacaaggtcggggatatggctgatgtgtaataagggctttttgttagttcagggtagtagatacattttcttttgtattctaaatgaatctctaatggtggagtaaatgtatggtcaaatggttattacaattttgaaaagcgggttcattgagcaaacttcaaaaatgatggtcagtttaattgttaggcttcaaaatagggtgttaaagtgaaagacaaatgcatattctcacctgtctcaaaataactttatgattcaccatcttatttatgtaagaacaaactttatgtataagggtctatttggatcacatggactatatttttagtactgtcacatcggatgttatgacactaattagaagtattaaacatagactaatgacaaaacctattcgataacccttgactaattcgcgagacgaatctattgagcctaattaatccatgattagactatgtgatgctacaataaacatgtgctaattatgatattaattaggcttaaaaaaatatcacgcgaattagctctcatttatgcagttaattttgtaattagtctatgtttaatactctaaattagcgtccaaacatccgatgtatgtgaaggcgtgcaatgattgctttaggtggtgtttggatcagcccccctccatatatatatctttgcacataacttgccctgacgagtgcatttcaaccctgtgacatcccggcccaataaggattaggcctgtgtggcccatgtgagctgtgtgcgcatgtttagtaccacgtcgctagtttagcacgagtggaaccgacttataaggcctcttccctccaaccacatcactccggggttaacccttttacacgaagcgaggacgaaagtgtaagtggggtggtgtgtgtaagtgggcccgctcatcggttggctgggctacgcggttctagagggagggctgttacaaacccaatcctccaaaatatccctaaatcagctaaggtttcgacagtgagtcggtgaggttagcggaagaaggccgagaggtagtggttgtgggggttagcggaagaaggccgagaggtagtggttgtgggggcctcagcggaggaggcaacgcagtgcagcggggttagcgatggcacagtgcggtcagattagcggcgggaggcccatggattctccaagctcgtcctcgtcttgaagtcaccggaagaaggtgttgttgctcaagtgctcgttgtgcgggagatgacattttctttttttggggaagaacattttaagtattttttttttgggattctggtgtcagtatatagttacaaagagatatatgcgacatgttgtgatgtggagggggctaagagcaaaagtgttgcctatgtgacataccatgttggtggtcaaacgtggtcaaagaacgattagactgggtgtgatacattaaaccaagttcacatatctaaacgtgcaattttttagtccacagacttaagtgacaccaccacacaaatttaggggaccggccatgtatttcactctataaacagccataaatccacagaaattttgttcacatctcgttctaatcgtttcaaccatgccccgttctcgccgcggccctcccaagggcgccaactcgtcggtcgccggcgctgcgccgcgcgggggacgcgtgagtggcctcaatcaagcgtacaaccggatggcgaaggccagccgggtgcccaacccgctggccacgcccacgactcaccagggggagctcccgggaagacgtgtcgaagtgaaagaactgaagttctagtcaaaatatgataaataaaaatattgttttttaagaacattcatttgaatgctgtcgtgctctataattcttaagactatttttaactttcccttcaactaatcggcagcaggaagctagtatggtttgctttctctcatagccgtggatcctattctctgcattcttctgaggtgcagcagcccgcggagcagctgggccaccaggtcgccggcgacggggtggacctgcccgtggcggcccaggagcaggcgccagtcatgggccaggagggccatgtgccggcggcgcccgtgcacgcgccggagtccgatcctccggcagcgtgagggcgagtgcaactgacaagatcgttctgcaagcgaggagggtgtagtggcaccgaagccacgcaacgcaaaacaaagcataatcggccatgcaaagtagtatgtagtaggaaaaaggcagtgaatcggctggtagtttgtagtaggagaaggagaatgaacaagaagtatcttgaatctggagacgttaatgagaagttatcctatatgaatttcttctttctactgtttgattgaattgctgtttgtttttcttttcttttttgcgtttttgtgatattttctttgggctgggctaaactgttcgaggaagagggtgggctccggcctttcgatcggtgctcaaaggtgggtcttttggcctcttcgtgcctcttgatcttgatctgtaggagtatattttggctgtgtttagtttagtgtaaagtttgaattttgattgaaattgaagatgatttgactgtagagttgcgtgtgtatgatatgttaatgtaatagaaaaagactgaagtttggatccaaactctgtatctaaacacagcctctgctagaaccgtcgtcctcttcgtgcccttgtgtgattgctaatagatctgtgtagattccctcactctctcaaaaaaaaaaaacagtgcagattctgtctcggtcgcgctcctcttcgcgttccaggaatccgccgcttctcgggaaggcgggcgcggcggcgcttccatgttcccggcggcggagcacggagctagggctcggccagcgccagatctaacggcgtcttcctagggaagagcaagagcaccggcagatgcctcgtggtcagctatatcggccgtctgcggcggcctcggggcccaccagatctggcggtgggcggcgacatcgagctgaacgacctccatcggcgccaagcagaccctgccgtatcgtcggcgtcgagcagcttcgccaacgacctccacttctgcgacctcggcggcggctgctcgttcatcccctggtatatttctttgctcttggcaagaacaagaacactctttgttcttggcatgaacaagatgatcgtgcctgctgcaattgtataaacagagaatttgttggatctgtggctgcagcgtcattgttggatccgtggccagcagcagcggcgcccgtctgctggtgtaggagagctctgtccatctgtcaaaggagcagcaaggaagaattggaatggagtattgcttctggttcatgctatagcaattttcttttatagaattggtgctaatgagtttgctaaattggaggtcactggatgtctggattggttgatttgagggtaattgatgttcttgaaagtgcagttttttttaatggtgccaactctacaaatttaatgtataaacttgtcttcttggttggttgatccagatgcggtgagttgacaacaatgggctcttgcatctcaaggaggaggtgacgacagaggtcaaatgtcaatggaggtaatgtttcttcagccaatttcacaatgttcaatcaatatagtttcaggtttttcatagcacaaccatttggactgtatgcaagggagtaggagtacatggattactcctacaagggagtaaaacagtgttcctgtaagggagtattaatactgcaagggggtaaaacagtgttactgtaagtggcaattctgcatcttactgtaagtagcctatttaatccctttcctgggattcaacgtactcgattcatactccattgaacatcatacatgacagaatgacaccatgattcatgtatccattcaatttcagagaccataaaaatgaggcactcaatgaaaagacaacagaatagcctaccaaacttgcaatccaaactttgttttccaaaacaaactttagaacatatgttgtgcatgacaataaaccagaacaacaccagagttactcctttacatcagtatttgtactttcatgtagttttctcccttatatcagcagtatttgcaacttttctcctatacatcagtatttgcgacttttctactctccatcacaatagtgtcctaagccattgctctaaccaacttgttctagacagtccaacgccttctcgtagactctagcatcacatgatagccaagatggtaaccttccttctctttccaaagcttgcttattcatatgtgggattttgtacctatttcctccattatctttcatcacttctagcatgcacagctgtagagttaggaacactctgtttatttttgaagcttcataaccatcaaattcttcttggacagcatgaattagttcttgaatagtttttggacttgagcaattagttaatgattgaatggagctaaagaatcctaaatctaacacattcatatctggtgaatttgagggttgtttcagctgaatgtttagtcctgttgcagccactgcttgtaggaagtgtgggtcatttggagggacatgtgttctagcgttgtcctgttggatataaattgtatccccaatgtcctcttctggccacaatgactgaatagctggaattactttttcaatcaagaattgcctcatgacatccctgttgactatgatagattttgtctctaaagtccctatggttctgttgcgactctttcttatagctggaacctgaaaccaattcataaagagttcagatcagaacatagagtaagtcatttgaaatgatgaactcaaactcacctctttaacaaatggccacgtgccaatcttgccagaaaaagtcacattcccttcctcgtcaaatctgggcctggctattgcagttaggaacataactttaccgattctattcttattttgaacagtccgcaaaggatcttcttcttctggcaggagatagtaggtcttcttccttttagtcatatcaaccacttttcatcaatatggactatgttgtgcatggtcatgaatctaggatcaatatcaccaagctctaacattgaaatgcagaatttcaccctttctctcttattttcctccctcaagtatggcttcaacgtattggagtggcgtcttatcttacccagcttgaatttttggtgcactgttgcaatactcacacccaaagagtttgcaagtgaccttaaattagatcttctattcagcggaattgtagcgatttttgagagatcaatttccatcttgttggggccacagcatctagtttttctgttgtcaacatcaaccttgagcccgagtgcaacctgttcccttgcatgcttccaaatcctttgaataacttgaatacctacattgaaatattctgcaaccttttttgtggtgtccttctctaatctgccacctttgcttttagcatgtaatgctatgtaaacagcatatctttctttgtctgataaccatctccttatctttctctcttgtggttgaacacctacaagggcatgaatgaaacaggacaaatatattaaatcaaattaacaagattcaaaataatatggataagcagttgtactaggactaggagtactagaattaatataggtaatcaaaacatgaattacatatcaacatgtacttagagtagcagaatgtcaaatcaacatgtaccactgttaacatgttactaggagtgggagagtaggagtactaggattctggagttgatggacaattaacatggatagacagttaacttttttttttctttcactctttatttcagttcaagaacttcaggcacagggaaataaacaaatggcagcaggagtatgtgtacaacagtacatgcattcaagtgtacaggcacagcagaaggaaactctacaacatgtatagatcagcttgtataccaacataaaccatgtggaggcttgtcaatgagtaggaggcttccatcatcacaatttgataatgcagtttgtatcttccttttgtaaatgcagtttgtaacttctttttgagactgtaacatgttgggagcagaatttgataatgcagtttataacatgttgtaaatacagttgttgaactattgggagcagaatgaatgaatgaatcgatctgacagtgtatctgtttggcaaattgagtcatgagctactcctggttatatcattgaacctacaaactgaacaagcatgagttctccagattttagaggcaagagtacaacatctactccatttcagaggaaagagtacacatctaggaattgcagaatttcaggggttctccaacaataccatgaatttttttttacagtatccaaaagattttagtcaagctttcagggtttttactccatgatttctggaaatttcagagaatactccctcatttctgaagtggaatacaatgatcaacatccatgatttctggaaatttcagagactactccctcatttctgaagtggaatacaatgatcaacatgtactcatagtattctacggagtaaaaatttcagtattctacagacatttcatgaagtgatgtacagacatttaggaatagtactctgaaaatttcagtatattaacatgatgtttggttgatgattcttaacatggcgtttgaatggcatcatcagttaagacatttcagagtgaagaatacagtacaacatcttcagtactccatttcagacatttcagaatttcagaacttacataaaaataaatgtgaactgtgaataatttcaaacatttcagaacttcaaaaatctgaaatactccaacatccttagcgagatgaatcaccttcacccgaagcaatgttgcctgcattctgagctattacctcgtcagctacagcacctcctccaccttcatccccagcaatgttgactccagcctcgtcagctatggcttcgcctcctcgaagttcgtcaccgtcttcaggaggaggagcgttgaggtcaaagagaggaatcgccgccatggagcttaacgtgatgacgcacacgcgaagcagaaacttgtggaaagggagctctgaaacttgggggaggtcgctgccggacttgtcgggctcaaactagtcgacgtgggcgtgcgttgagaagcgaagcacgccggagtttggctgaagcaggtgttctgtgaggcgaggcgtcccgtgccgtgccgcgtcgccggagtgcgcaccgaggaggctgcgaggcgaggcgttctgcgccgcgtcgctggagtgcgcgtcgaggagtgtgcagtgccggccatcggagtgcgtgccggggagcttggtgccgaggaggtgcgtggccgccgccgccgccggcgacgcggcccctgcgtgtctgcgagctactactacctccgaggctccgagcaatggaggggagaagaaagggacatcgggggcataaaggggaattcatcgcttccttaatttgaaattcaaatcccaggacgtcttataacttgtaacagagggagtagctctttaggccgagtttacttcaaaaatttttcttcaaactttcaacttttccatcacatcaaaactttcccccacacataaatttttaacttttctgtcacatcgttacaatttcaaccaaacttttaattttggtgtaaactaaacacacccttagtgttagtatttattttggcaaggttggttgcatcgatttggctgaggtgagactggtgacagtgagaatctgtgtccttatgttatgctctaaagattaactcctatattgcttctggatgtcatacttggaaaccatggcagtttttcattttcttgcctcattaatgatgcttcaatctatcccattcagatgttattgttttgaaaggtgtttgattgtattcctcaccaagggaaaccatagctgattgcagagttgatgctgcttgttgtcaacaccctgctgctgggccagaccgcccattggatattggtaacctgccagaatgttgtttttcgatgcatttatcacataattttcatactcgtctgaattttcaggtgtccagtcattaatttctgtatgccctgtgttgagataactgctcccatctactccctccgtcctaaaatgtagctatttctagcacagtgtcttgtcccaaaataaagctatttcttcacctacctcctcctctcaaccaatcacaacaattctttttcacctactttctcttttcaaccaatcatacacttcctccaattattctcacctacttttttaatacccatgctaacttcaaaaatggcttcattttagaacggaggaagtagattttaatctgttcagttgtatattcgtgtatccaaagctctctcatactactattcatggatgaaaattcaatgatattgatttgatagcagttctctgtaattggttcaacagagcagatcgtttgaattgttctgaactgcgtcccatcaaatcagtacatacaattgccaacactatcatctactaggttcgcagtgatgatttactcgagttcctttctatcccccgttgtgtgaatcttgattgatcttggttctgatttcactgaattgcgcaatgtttgattgcaggctgggacaaggcacacctaagaaccacacctccgcacaaaacttgtatttgcaggcgcatgcgtcatcctcggctatgattcgtctaccgccgatgcaaccggagcagcgacgactagtgtttttaattgtacaatcaatatggatatgtgcctgagtctttgtaacatgtagtatgatttttttactcgacaaaaatatggctgtaatttgtgttggctatatggatttgttggtaaataggatactctatagtcagggagtaatttatttttagggttaattggatccatgccactgtaaatatgacaaattaaaaatatactactactattcacgttatctgctgagtgccactacaaatttctaaaattggaaccatgccactccatcattctttccgtcctccccgtcaatctttccgtcatccccatcatctctccggcatgttcaccatgtgggtctccatcttgccggcggccatgagctcaaggagggagtcgaggaagtcgctgccgcggctgtacgggtgcatgtgtaggcggtgacgaacatggggtcgcggccagcggcgaacggcggcggcgacggcgaggggacgctctcccatggccaccgctccgcccggtgtgttacgtcgtcgccaaggcggccgtggtgtttggcgcggcgcccgacggggccgggctggggctgcagggcaagggccagctcgtcgccgtggaggccatgttcctcatgtcgctcgcgctcaccgccgcgcacatcgccatggcctaccgcgccagctgccgcgagtgacgccgcctgctcgtctacagaatcaacgtcgaagctgtgagtgattgattcccttctttgcttgtatcgtatcaaaacaaaggattttgcctagtggtagcttgtagtgtggattggaaacatattaaacccaaaatatgcaagctttctagattccaatccgtgttttcgagagattttggagaacaacttaggcatacgcttgccgaccttttactggacatcacaatggccggaagaacccgacgtccccacatgcgaggaaagcaatggtagagcggtggccggtggacgagggcaggaggaggcactgccgcttcttgccgccgccggctgcggcgcagggcgtggagaaggcgaccgcggagtccgcgcgctcgatgcggagctcggcgacgaggtgcaggttgcggctgtacccgtggtcggcgaggtgggcgagcacggcgtcgtcagcgggcgtcatccggggcggtggagaggaggagaacggggagaggatggggaagacggaaagattgatgggaggatggaaaaagtgacgggagtgggataggtccaattttaaaattttacagtggcatatagtaaataacgtgaatagtagtggcatatttttgatttgccgtatttgcagtggcatggatccaattaacccttatttttaatgagaaggttcgagcaatttgtggccaaagcaatatgttcatatgtttttactctaacaatctggaagtaatttatttagttagagaataccagagtcaaatgttgttggtatggttagatcaaaagctatatttactgacataagcaggggaaaatttgatgaagggtaatttttagttactgagaaaaggccaagaagttatatggctagactaaaggtaatctatttacgaagagaaggcccgggtaaattttttggggagtaatttatttattgacatgagtgctacggatttttgtgggaagtaaattctttactgggtggacaccagagggattcttttgctaaaaaaaatatatttgtcagtaattgatttactgatagaggcttggtgtgactaaaagccaataatttatttactaaaagaagtttaggtgcataggtaatttattagtaatctttttactcgtggtttccaagggaaggaaaacaacaggagtgtggaaagggaaaaaaagaaaaaaaaggaaaaaaacgaaaaaaaaaaaggaatggagggagtatggactgcgggcggaaaaagaaaaacaggggagaaacgactgcgggtggaaaaatctcatgaaaaattcgaaacaatgagcatttgagattagaaaaaaaaatcctatataggatttttcgaggatttccaacattaggttggaccttatggccttatgggaaccttttatcgtctccatctctttccaaaaaaaatcgtatacttttcttatgaaacatcaaaataaataaataatcagtggttcgcaaaggatcctttgaacgtagtacggggcttatgttttccatcatgcaatttgatgacaaaatcaaaatgttcgtgcccttgagatttgattcgtaagcacacgcgggaaaactaataaaatctttcagcatcgaattgcacgacaaagataggatcgaacaaataccctgcaatatcgttcattgaattgttcttggcgatcaattaagcatcgaaatgcaagggaaagacagaattcgaattcgaattcaacactgaagtattttagtacaggtttacaactgatcaccgcccacactgacgctgctactcttcttcctcctcttcacaatcccctgctccttcaccgccacgcccttcctcttcgcgtcttccgcctcgccgttgccgccgtcgtcgccgccgccggtgccgaccgcggagtacagcggcagcgcgaccgactcgggcgccttcacgtgcagcgcccgcacgttcctccacttcctcggcacgcacgccgcagccgcctccacggcggccaccacgttctccaccgcctcctcccgcgccatcgccgcgtggcccacccgcacggcgcggcacgtgccgccctccacccgcagctccacgcgccgcgccgcctccctcgcggactccgcccacgcctggtcggcgaggtcgacgggcacgacccgggcggccttggccgccgccttgcccttgccgcccgggcggaccctgaggcggcggtcgacgagcaccaggccgcggcgcgcggcgggcgggagcgacccgagcgcgggcgaggggagcgggtcgatgtcgtcgggcaggtccgccgggaggcggtcggagacgagggagatggacgggaacggcgagcgcgggaggcggagggtgtgctcgaagcggcgggcgggggcgcgcttgagggtgacgaggaggtagatgggctccggcgccggggtggggtggtgctggagccaccggaggagcgccgccaccgcgcgggccacgtcctcgcggcgtacgcggctggccggggcggactccatcgatggcggcggcggcggcggcgggagtttgggaattgggagtggtcgactcgcgggggtttagggtttgtatccactacgcttgttggacccgaagtgggtttggtcctggttgaaccggaccaggaagccggttgggcggctcggatgtgagccacggctggagtgatcggctcggctcggctcagccggtgctgagggaccatggtccatggagcaaacacaacacatcattgacacacaactataccaacgttctatctcctttgatgtcatgacatcaaataaacaaaccaaaccatatcttggccagtatgtcatcaatctggtcacgccataaatctcaaggggttcaagtcttcaagacatggctagatagatatatatcaaacctttctacggagtatttgtatggtcataagtgtcatgatggtccaaaagaggcaaagatgatgttactatgatcaatgaggtctactctaatttgtttgttccccggaggatggttacatgcctttgttgagacaattattccatttgaaaacttcacaataaactcacttggtaattactccctttaatttgaaggaaccctatagttttcacttcaacatcatattacacttgctagtaataaaatgtggtaccggtaactatcgagaaccacaaactaattataggtgcatactttctatttgcgcatctccctgtcctcaaaacaatgaggtccacatatactcagacacgctaatcaaaccacccgaaccaccttttatcactgtgtattcacaacctataaaaacacacttcacggtcggacagttttccttaaccaatcatcattccctcatcccattaaatttgctcaaataattaaatatgacaggcatgggttcttccatcggccgtgccaccattttctactgcgttgctctatccataattgccggcgccgcagcgacacaggtgccccccaccgaagcagagtccgtagaaggtagtagcacatgcctctcctgcaaaaattactgatcagctaactaatgcgttcattttttttggtacacgtactgatcacggcacgcgcttgtggctgcacgtatgcatatcccagcggcagagcttgcgtcctctgccttcaaggccgacacgttgccctcagcctcccgcaagctgatggccgttagtgacgtgccgctaggtaatggcaccttgttgtgttgttgtacgtacatgtgattatagcttggcggtatatcgtctgacatgcgcgagtgtggcgtggtgtgtggttggcagcgccggtgtgcccggtgcggttcgacaagatgaaggggcccgccatcgagctgggaaagaagtgcaagacgacaggggtgaaggtgtgctgtgaggcgttcaagacattcgcatgcccgcacaacaagctgatcaatgacgtcaacaacggatgcgcggacgaaatgttctacaccatccacacctacggccaattgctgccgggaaccatcttcaagaaatgcctcgagggaccgcatgggatgaagtgttgaattcgatcgtgctgattcgacttgctcgatcgatatcgctccgttgttgctagcctccggcctgatctatactacctataacgatgaatgtccctttcgtcatcttgcaatgtaactaaacttacttttattacttcgaaatgcaatgaaccacaaaaggtttattacaattttctcctaggatattggttgaacataaaatgttaaccataaacacaacatttaaaagtgtgatgaagagggcgagcgtttaaaagttgcatgtcgtaatcttgaggcaatggttatacaactgtttaccaattttggatggagattcacaaacagaattcaataattgtgtactccttatcttgggttggtaggtgtcttctttttcatgtgagaaactttttgttttgtgtgttactctgtaataattggctgtaactcgttgagcaaaggccgggatattctattccattatctaaaaaaaaccataaacccaacatatcaatgcaatctctgtatatctaattgttataagggatcgtgacgctttgagagttgtacaacaacccaaacacttttttcccttcctttcccttcctcatcttgcatgtcgccgttttcatgcgttcgtgaatgctccttcgcctcctatggtggcagtgccaacctcatctcgactagcaccctcagctaacctcctccatttcccttctcccctctcttccccaaggcggtggcatcgagtgcccccaccatgccatcttcgttgaatgaggatgcaaccatcacatagaataaggagcaccttctcctcgtgctcaacacagttgtgcatgacgtcttttacttgggtgcatcacctcatctatggatgtattgtacagaaacgttatcatgccgacactgccataagatcgacaaacaccttaataactcaatgaaagtactcaattaatataaacatgcatgtacggcaaatagacaaacacataaatagatatatgtcatattttggcaagaaaaccgaccatctatcttcggctcttggctatatgtcatagttttgggcatggcataagttaaatttaaagggttcatcaacacatagctagatgtacctctacagagtatttgtaattttgcatgtcaacgggccatgtgtttcaaatattcaaagaaaaatgctgtgtgctggaaattgtttcttctccgaaggatgtgtgtttgcttttgttgagaacagtataaataatatatgaacaatggtttaaatggttgctatcggtgtaatcactccgcttcatatttcgatgatatacaaactattcattgtaatctgtagtggggattggtacaactaatggttttattctaaatagtttatggaattcacacacacgttctctctaattaaaaaatcacaggggggcatcttctcctagatgttactccctccatctcacttaaccaattttttcaatgttttataataatataaggcgcatatgcatatatgtaatgaaatagcatatttccctccgcttaattttttttaacattctccaccctgaccagtatctgtaatttcattggttacatgtactttatttgttaagatgatacaaaggagaaggtgagaatgtactatttcttgatttttgcattagtagtagttgcgtcttatattttttatatggagggattaattaaagttgtacttgtagcagccaattctttttcttccgtttgaaaaccttactacacatgcaggctcagtagtacttatttttagagagggaaatctgtgtggtctgtagtatgtacttcataatgcgagtatgcatgcatgatttgcattagaaatcattgagaattaatctcgcacactaattataggtccagctaagttggccctggtatatatattggccgcaaattaaatcaccacaactcctgccctcaaaataatgaggtccacaaacagacgctaaaccacctcaaccacaatttctcatggtcagtttcactaatcaaccgatcattccccctactctcgtatatatgctctcgtaaaggcacgaacacacatctctagtcctgcagcctgctgggaatcgcaagctaggatgggttcttccaccatccttttctactgcgtcgctctgtccgtggtcgccgccgccgccgtcgtgtcgtccgccgccgaggaggccgaggggccccaagacgaagcaggccgcttcctatcaggtactatagcacatatgagtcctgaaacgttaatttcctagcttttgcaacgtaaaaaatggctagctagctaactccaattatatttttgccatcgtcttttggtatacgatcctcttagcggccaccctggcgtcctccgattccgacgcaaagacgtcgcgcagggcgctgaccagccaagaggagataatcgcaagtaataacacgcacgcataagtgtttgttgtatacgtactgtgtgccggcgatgatatgatcgtcgtacgtcgtctcgatctgacacgcacgcacgcacggtgctgcggcgtggcgtacgtttgtacgtgtgcagagccgtgcccggtggagttcgagcaggtgaaggggttcggagaacttggggccaagtgcaacgacaagcagacgatgaaggagtgctgcgagctgttcaagaagatcgcgtgcccctacaaccatctgctcaacgacatcaccaacgtctgcgcgaacgaattcttctacctcatccacaccaagggcaagctgcagcccggaaccatcttggagaactgcaacgagggccctatggggatcaactgctgaacgcctcgaagtaccgtacgttgatcaatatattcaccatttcttaatttgatgacaaattttactatagtacaccaaaagtttgtgaaatttacttgtggatatcgaaaaaaaagtgtaatggttagaggacaccaaaaagctagtaatttgccggagaatagtttggcacaattggagagacaaattcttcaaaatacgaattaaaacaagcttatgaaactttctcttctcacacacatcacgctggttggagtctgtgaaatacgaattaaaatttatcctgcgcacaagaccccagcaaagtgatagaatgatgtaatcttcagcatagtgatatagaatgatgtaatcttcagcatagagataaaatgatgtaatcttctacatgtaataaggatcaatggatcactggtggtacattggtgcatttgccatgtagtttataggatttttttctctctaaatgattcggaaatcagaacacacacatcatcattcatcagttgagcctcttgatggacacgatgcgaccgagctcctcgcgcaccgacacgagcagcacgaacgcctccgagccctgcacgtccaccatgtgctgcaccgtgccggtcaccgggtcggcgtagcagccgcagccgaccacccgcagcacgccgccgccgtcgggcgcgccgacgacctccgccacctccttctccttcccctccgtcaccgtgagcagcagcggcgccgcgggggagccgcggcgctcgccgtactccacggcccgcaccaccttcccgccgtggagcgccacctccgtctcgtccaccaccgggaacagcctccccccgatctccacgcgctcgcgcgggtcctcgtcctcgtcctccttctcctcctccttcccggcggcggcgacgacgcggtcgtcgtcctcgccgcgcgacaccaccaggtgcaccttcccctcgtgctcgacgacgccgcgcgagacgccgcccagcgcgacgcgccacctcgtcagctgcggtacgtacagggacgacgccatcttgacgctacgcgggcctccggctgcggctgcggcgccgccgtccccgccacacaagaagatcaggaagctagctacggcggcgcacaggatcagcaagagcgatggggaatgcatgagctcctcgctagagccctcctcctcgatatataaaggagcgggatctggatcggagttgctcgatcgtgtgtgaaacgggaccagaggggggttagttcattgttgtaagcgagcgtaagccggtaaaggcaaaaagttaagccggctgggaagcatggggtggcatgaaacggtcgagtactagtagataacacacataccatcggtgatcgcgagccagttcacatccaattaatgttttttttgcttccttttgtcactcataaatgtgtagtactaatgcattcttgccaaattatgtttgtagccaaagtcctcaacttttgcttgtcattcctactgctctctttaattagtttatttagaaatactttagaaaagactactgtgcgagcgagcgcgcgtgaatgtccaattcctatccggattaaagtccccgcgtgaatgtccaatttcgatgtagtacaaactatatatatgatatttataggtatcataatcagacttcgctctaactttcagtgcaaaaacttgtagacttttcttgagatgagattttaaaccacgcccatgagcttgtctcatcccgattcgtttttaactttcaatgttgaagttttgtagtttatagaaactttatttacatagaaacatgtgctgcacagaacatgctcgcaccatgcgaattttcacgcattggacatacctaactaatacgtgttcatgttagaaagttcagccgcgagggaaggatcggagtgatgttaattatgcaaaaaagttcatttacttccctaaactatttcattggatcagttaagcaccctatacttatttttattagtttacactgaaaactactaaaaatattcagctttactttttaatatcatttatatattttttcctctttatatgagttgtaatttaagctaggaatttgagccatagatgacactattgtcaaagttccgaaatatttttaaaaaatttcacaactattgacttgaaatttaaaacctagatatttaaatcaatctcggtgcttccaccctatgtaaacaatgtagaaaacatctaagaaatgttgagagctgagttataatacatctatcaatactgcaaaatttcaatgtaaaatatgacatatatagacaaagaaaaatacctttacgaggtaaggtgaactattttaaatagtttgggatgtaaaaatgagccgataacttgtttagggaattataaatgctctagcgaaatagttcgggagagtaaaataatgattttacttttccaattatacatatgaaccaggtgcggatctctggatttttcatattttggtccttttgaaaaacttatttcgtaaatagacccctgaaaaaacttatcccagaaatggtcctttttggggcgccagagtacgggacagcgccagcctctttggcgccgtccttcttacaccgtggcacacgcgaaccgacgtggcaggaggtgctggcgccgcccgagggaggagggcgccagcacgngttggcgccgccccccccccccaacccctcacctccattcctgtttctctgtatagagttacaacggtgtcatttttgttttattttttcggatgttttttcacacttaggatcacgatacaaccaaatttaaactcgaactaccacttagctaagtctgaaaatagctagcataccacttagtctactttgcaccttcactaaaattagaccataactcctttagtaaaaccctttgatcagcatgttataaataatgcactctatcactatatgaaattacttaatctaattcaaaatataaccacatgaaataatagccataagttaaacagtacagagagatgcatttttttgatttttatttcatttttttgatattttttcacacttaggagaacataggaaccaaccatatataaaaaataaactcaaacggacaaaatatgttacttgtagaattttccaaaactctatcgaaacggacaaaatatgtcatttattaaaataggcgtaactttctcatacggactcggaatcaggcaaataatatatccacggacatctacagaaaatgttacatccgattctcccctgctttgctgggttcggcgatattaaaacctctaaattccgcttgcaagattgtattttcgaggagagaagtttctcggtagagctttggaaaattccacatgccacatattttgtccgtttgagtttattttttatatggttggttcttgtgatttcctaagtgtgaaaaaaatatcaaaaaaataaaataaaaataaaaaagttacacatctctcctctgcactagttcggagagagaggagaggagaggaaaaattctacaggtcacatattacgtccatttgagttcattttttctatggtgggttcttatgtgtccctaagcgtgaaaaaaatatcaaaaaaataaaagaaaaataaaaaaattcgggggggggcgccagccactctggcgtgctccccctagtcacctcagcatcgccccgccacgtcagcagggggacggcgccagagaggctggcgccgtcctgttggatgacggcgccagccactctagcgccccaaaaagaaccatttctgagataagtttttccaagagtctatttgcgaaataagtttttcaaaaggaccaaaatgtgaaaaattcacgtgcggatctagcccacgtgccaacttggccacgtcccgtggactagggcgaaaaaagcccacagagatatatcttcagccgttcagcgtatgtagtttgaagtgagcccagtatgtgttgggttgccggggcttgatcatggataactcatcgcccctgcttgatacatgcggtgtgcagcgacgcaagtaaaaagaggaggaataagttcacttcgtgaccctcaactgtgatcgaaatctaatccatgaccctaaaccacaaaaccggatatctcgacccccaaactcctaaaaccggtgcaatttgactccctaggtggttttgaagggcagttttgctgacatggcgtcacgtggcgcctacatggtgatattgaccgagtcttcgttccacgtggcgttgacgtggcacttaggtggcattagaattaaaaaaaatgtgtgggacccattagtcattcacacataaagaaatatgggccactgacatgtggggcccacatgtcaatcctcttcattcttcctcctccctctctcccttctctctctttctctccctttttccccttcagccggcggcaggcggcgagaacgagcggcgacgacaggatgggcgagggcaggaacggcgagccgtgcagccgcccccgccgctgccatactcctccttccgaggcgtcgcagccgccgccaccctgacacctctccccgccgtcgcagctttcccatgctcgtttgtagtttcaactgcctgagaagagcgccatttatattttttccacgaatatctacatgtatgttcacataagaagacaatctacaagaaacaaataacagatatggtgtaccggcttaaatagactttctacctggtcatataaatactggatctgctgagcttgttgtagaacatgtgttgacagttgacatgagatgattaagtgctgacatctctattatctttgtctctgtttcttggacagcatcaagaagatttgtcaactccacctaagatacgagtgccggcggctggggcagcacgtggagctcgtcggcggcctgctgcgggagctcgagctcgccgagctgatgcggcgggaggccaccaggcggcccctcgagcggctccaaggcgcgctgcggccgtgctgccggcgctcgcggcgcccatccactgacgacgcgtgctcgttctcgctgcccgccgcccgccgttggggaagaaggggagagaaagggagagaagggagagagggaggaggaagaaggaagaggaccccacatgtcagtgggtccacattacttttttgaatgataaatgtgtcccacacatatttttaaattctaatgtcacttaagtgccacgtcaacaccacatggaatgaagattcggtcaatatcgccacgtaggcgccacgtcaacaaaaccattctccaaaacagtcgagggagtcaaattacaccagttttaggagtttgggggtcgaaatatccggttttgtagtttagggtcatggattaaatttcgatcacagttgaggggcatgaagtgaacttattccaaaagaggacgcgcgggcgtacacgatcactcgctctcgccgtgcggcccgttgcccgttggtggtgagcgggtgcctcggcggatgacggaagcgcgcccggagcggagcggtgctgcgttcgggcggagcgcacggaacgacatagcatgccaacgggtgcgcaagggcgcgctcctgatcgtcacgactcacgcgggtcgcggcggggcaggctgccgtgccgacctgccgggccttcttctccagcatctgcctggtggatcgatgcatattgtctctcgaccagaactcttattgctagctgagctggtaataacggtaagataccgtggcagccgatcgatcgatcttctgtgtggaggtacgggccggcggtgtctgatttggggctagtttattttattatcgaaatcaatctgactaatatttgatgttattaaaatttggtatgttttggttctatcgaaagtttggtaacgttagatatgttagtttgaaacccttctaaagtcttgtatttgtttttgtgagagaaaacttttaaattccaaagtttagtaagttaattagagattgtaaaatatattttattttgtaaagtaacataaaaatgatagggttaaaatagtaatgaagtgaaacatcggtttaatttggacctgcgcgacggctgcgcgacgatggcacgatcgagctcatagttgaatggagacagagagcagaagccacctggacgtggtaccggccgaccggtggcttctcggtgtcagcttaactatgaattatgaaatgatgaaatagtttgtccttctgttatcgaaaaaggaatgaaaaaagatacacttattttgtcacgacttatttggacgttagaacgtaacatctccgaactttatcctggacctctactcgaagagatcggtttaattcccgttctttatggattccaagcaagacggaagggtactgtaaaaaaccattttgtacgtcagtaccctcatgtgcagcacacctgtcttcagaaatgattgtccacatatggatatggataggttaattttcagagaccaatttttacgtgccctcatgtgtagtagaccaaattttcaaaatgcatttttagacaggactgtaatattgactactaattatgtcgggttccaaaactaatgattcggtaaccaacatattaaaattgtatcaagctctggatcagtagattgatacaagttcaataatctgtatcgtctttgcatacatttagacatagctttgaaggagatattattacataaagtaatagggtatttacaagattgtggctaactattacagcagaagctttagaatgacctaactctgctgttttactatagacttaaaccatttaaattacctagacttgaagactaagttaaaagggaattaacttgtgtgattgaactcccatcatcaacaagaactccaaaataattctgaaaaaggatgttgaagcaaggatgagtacaacgtactcagcaagctattatatcaaataatgaatgcatgaaatagtatttaagtagatctaggtttactggcagaaagctgagaataaagaggaagaaagcctggtatgtctttatgcaacagtatttagtaaaatcttgagttaagtttctaaccaaatatcatatgagtcccgatactcaattccgtgagcacggctattcgaatagtttcatgaatactctactgcagtagatgtacgctttactcgtagtcgtagcccagccttaggttagtcgtagcccagccttaggttagtcgtactcgatgttgaatactctacttgccaattttcattagcttagtcgtagcccagccttaggttattaacaatagtggcacctgttccatgaactctagtccccatgcgctctgaacgtaacgttatcagcagcgagaggagttcttgcgttcccgaggtttttagagagaactggatgagagaccccacgtcatctcaaccaggtttttacaatatacacacacagcgatcgcaatataatcaagatatttacctgcgcctcggtaaatatcacatttgcccttcgcggcataagtttgcctccttcgcgaggacttagataagaaccactgtacagaggtaccacattgttaattaacctaataactaggtctgtccctattctaaaagctgcggtcatactcgttcgtttgacataagtatttggtggcaattatatcgatagagacagtactagccacccggaaatcaactaattcatgcgtactgtcccaatctaagttcattatatttttatgcagtctaactaggcagggctaagcaaaatctagcatatatctagtttgctatatgttcaagttatgaattcaaaatcatgaatggctaatgcttagaataaagctatagagtataggataattatgctcaaaggagaggaataataacttgccttgctccaacgcaaataaatccaagataggcaacctgattatccgatgctcgaaatactacaggttgccatccagaataaaatagactctattaaagaagaggaagaaccaaattcaataaaagccataaaacaacaagaaagcaatgaaggtgagaaaggctaggtttgaggggtatagctatctccttaatgggttattgagctagtattttatgcgcaggctctaaggagttggaggctaggttggagaggggatcaagcaactgatgtcgcttatatctcatgtgtgggctttggttgaatagtggctagggtttcgatgctgaaatgggataacatatcggctcgtatttcatgtttaaactatgggtagttggagggtaaatagctggtatggagtttggatagcaggctggctagggtttcatttgattaagccaatatcgaggtaggatgaatatcggctgagatttgggtgtttgctagtcgtcattagaattgggtagtatgacgactaggtttggtgtctagccgatgtcaacagacaatataacggctagagggataggaagtttgtgtaggtttagtggggcggatgtgttactccgacaaccgtgagtggcggcggagcggctaggatcacacagagtctgagagctaactgtgcggcgtgctgtggaggtcgagagaatagtgaagctccgactgctgtacgcatcgaggcgtggggtgccaggagcagcacttcgaccttaggtttaggttttgccgggctttacaaccaacggttcgacgtcggggatagtaaaccgcgagcgtccccatggaaagcgtaaagttccaactggtggctttttagtggctaaagggtattttggaaataaacggaaatattcgaaaagcaaatataagtttaaattgtaaattcaattataagattatatcaaatatttattcaaatggtatttgaataaattaaggaaattcaaatgaaatattaaaatagcaaatttggtgtcaaaaggtagggtttgaatttagatgaatttaggtccaagtttcatcggaatcggatctacggtttaggagatatgggcttctaaagattgggatttgaattaaatctagaaaatatgaaaagttactgtgcgggggcccacctgtcagtatcttatcttatttttctttttcttttctccttcttcttccttcttctcgtcttcctcttctctgttccagagagagccgagagaagagagaggagaaggggagcggggtggcggcgctccggtggctggagggcggcgacgtcggaggccacgcgtgttcccgagcgtcgcgtatccggggaaggcagtagctggcggagagggagagggaggaggccggaacggcgacggcaggagcttgaccatagcaataaaaggagtggcggtggtggcttgctgtggtggctaaaagataggggaaaaggggaaaaatgagttcacctcgtcgaggcaaacacgatggcgcaagggcttggcttgtagagctgtggaagaggagatcggccagtggcaaggtggtggtcggcatgggaggagagagaaagctcggtttgatttgggaaaaggaaggggtgttgccggtttatttataggagggggaggtcggtttggaggaggagggcaagagggtcacgacgacggcagtggcgtgcaaggaaggacaacggcggccggctttagtttcttagcggcgacggaaggcttggcggcggcgtgcgcgtgcacggcacgcgcgcttgcgggaggaggaggggcggctcagctatgggccgacttgggccgcgcgagggagaagaagaattcggcccaaagttaaaaaggaggaagtctaattttcctagagattcaaataatagatttagaggaatttggatggctagattttgaaaaaggatttgaataatttgaatttgaaggaaaattgactgagagagagtttagaaggaaattatattttaatataatttccaaaagaaatatttctctagttggtttgagtgcaatattttggagagggagtttatttaatgcactcaaatagaaattcaaaatattcaacaccataaataatatttctctagatttgaatatttttgagtatgtggagggaatatgtagggagtagagtaaatagaattttagcccaaaatatgtggtatgaaatttagagaattagatatgggctaaatgaggttttggatttgggacggagggataaagtctattctcttagcacaagagcaattactcacaatatttgtaataatattattcgtgtgccgagaagaaaatcaagctacagaaattaaattggtggaatttagatatttggatcaagaatcaaaggatgggtttaagatcaaaggatgggataacaattaattccaataaaattggaagtggaaaggatttggtttggaagattttcttggaccataattcgaaagggttttaaatagaagaaattttagtcgaaagaaagttttagataaaaaccaaatcaaggaatatttcgagataaaattttaaatgagaatcacaaaggcttttgaatatcaaagggggatttttatgcaggttagctttaggaggtctcactaattatattttcctaagtttaaagaggttattaagaatataagacccggcatgatgcaaaattagaaaatagctaatttttggtatgttacaattaataggacaaactaatacggaaaaaaattgattgcacaggttagaacagaagtgtcattatgttttgtttctattgatccttcctttttatttaacttacgatgtcgagcatcactgggcatgaacgtacaaagttcaagtcgtcgctgcagtcttttctagttcttgttctaggctgtacttttaaaattttaaggttccattatatatttatatgtttcatagtaggttttctaattcttagatacagtatagctcaggggcaattgcttaaccgtatgtgaagagcagcattttaaaagcaattggtctaaacgttttgtgtacatgtcaattaccattggcaattcttctcttcagccttcacgtccaggcaaaataactgaggagaagcgagtgcgactattgcccgttactactcctcagaagacagagtcaggtagtctgctatagcgatcaacgcgcgcgcgtcgtcgtcgtcgccacgtcgcacaacttccttgtccttcgacgaccgactacgccggccgtgcgagactgcgcggcacgaattgagtccgcgcacgcgcgcctcctttgtttgtttgatgtcgaaccgtgtaaatcatcgtaccaacatatcctaataccctatttattcggtctacgggtatacccgttgacagttgatgtggcgagtagtatttcaaagtgacaattattttgagataacttttgaatgctataaagacaaatattgtagaacggaggaagtaataaaagaacatgtgatgagacaaaatgtgtgggtgaacgaataaaatagtataaaagttagtaggtggaagaataaattaggcatggtttagtttccaattttttcttcaaactttcaatttttccatcacatcgatcaaaattttccttcacacataaacttccaacttttttcttcaaacttttaattttagtcaaacttctaattttggtgtggaactagacacagctttaatataaaagtagataatagagaaataaattagtataaaagttggtaggtggagaatatcgtagtactaagaaatcctaaaactccttatattttgggatgaaattgatggagaaaaattcctttacattcacggacgaagggattactccctcctctttcctgtttaaattcatagaacatgtatcacatatatttaaaatcttgtatattttggaacgagaggtgaacgttcatagcgaacactacctaccgctaccgctacgatgtaacagttttaatgtagtatcttgaaacttaacgtccgctatttagacttaacagatagcggatacaattcaatttagcggatcaccatatcctgagcctattttatataaccacgaacccataacaaataacgagtttgttagtgttttgtctcccaaaactttgtattcttgtgaatcttaacatctaataa

SEQ ID NO: 25764 - DNA, 10008 bp, Oryza sativa
cactagcgtcgactatgtcttgatgatctgcatacaaaacaaatgatcggaccctaggtacaagagcgaccatactattagtgtctgcatcacacttaaccctcctcaacccatcatttaattgtttgccaggaagcaaccagtaaattttggtgttatcagatttctcatatcctagttcttcaatgaaatcatcaacccacaacagtgaccaagaatctgactcacaatggtcaaaccagcttactctaccatcaacataagcccggtttacactatctcctgatttatctccttttgttgctaactcaattggcagtaggctatcgtgaaactgatctctagcatgggcatcatcgtgggctacaacacaaaagaagattcggaggaatcggaagatgtatgaggggttatttacaaatatgtgtagccaactcacgcccccataacgtgtgtatgcgccaatgtggcatcctaatcacgagccaactcaataagattggtgatgaagtcatgtcttggccttggttcgcacgcactacgcaagtttgtgtaccgaaacgagagtttttcaagtttttacactaaattgcacccaccttacaagtttgtgtaccgcgggcgcaatttactcaaatattaactaaagtccctttttctaatcatggctttcatgagccttaaacccaagtttttacagacaagtgacaggtcgatgaatcaggtcactgtaagagcctgtcaatacattgtgcagagcgtgcagcatcagtgcaccttcagccgtggcttatttctatgggacactatgtcaaaattttgtcgaaatgctgtcgtaattttattcaaattttggtcaaattttgtatctgcctagtatttgtgatttttatttgttaaaatataaaaacatcacaagagatgctcacatttgaattatttataacactcacaaagctgaaaaaatgggggcaaaatcacacaaagctgaaaaaatgagggcaaaactacaataaccaacaagggtatatatgtcattttctctataactaacaccgttagttgtggctgttacaaatgggggtccatggctgcttcaaattcaaaaagtggggtaaaacaaagtgggggtatggatgcaattgccccgaaaatttaacacgaggtagaacgtcatgaaaaaaaatcctttggatctttatatctccttgaatttctgcgtttttcccatggcttaatcaaacggtcattcatatgtttttcttatgtttttcttgtattttgcaattctttattttacacttgcattcctatcataatcatatgttttttctaattgtccgtttttgttcatctatgtgattcaaggaggcccttaaattaatccaacaagcagtatgctactccctccatttctaaatattcgacgttgttgacttttttaaatatgtttgaccgttggtcttattcaaaaattttaagtaattattaattcttttcctatcatttgattcatggttaaatatatttatatgtatacatatagttttatatatttcgcaaaagttattgaataagacgaacggtaaaatatgtgctaaaaagtcaacggtgccaaatatttaaaaacggagagactagtatcggctgtgtttagttccaaccaaagtttggaatttggttgaaattgaagacgatgtgactgaaaagttatgtgtgtatgaaaggtttgatgtgatagaaagttagaagtttggaaaaaaactttggaactaaacacacccatggatcaggatcagtatagagacagatacatgcaatcgatccaacactcccctgtacgaggacaaagcttaggtgcaacaggttacttcccgcggtggccaaattcacacgagcagacagaaaaaccgccacgtacgcttgccaagtcacgggacgatgcttacctccacgctcatcgtcacccaccgtgaatgccttgctgctcgatctctgcacctgcgtttgctgccgccgacaagcaagccacggccacgagcagccatggattcctcctcgatcgcatcggtgaccatgtcctcacgccattgcaagcactctgcactgcaacaacctataaagactcagccgccattgacgccaccgttgcaatctccatgaccagcagcagatcaagaaaatggcggcggcgacggcgagagcgagacggcctcatgtcctctgctttctcctcctcgtgatggtcatgccatgcgcgatctcggccgctgatctggcgtcggacggccgtgggaggttgtatcaggtggccatggaccaggccgcgcgcgccctcgccgaggcccgggcggcgcgccgggacgacccgcgcgacggcgtggcgcggcggggcgccgcccaggcttgggccgactgcgaccagctcgtggcgttcgccgtcgggcacctgaaccggacggtcgccgcggcggcgaggggggttgacggcgacgacgtggcggcgtggctcagcgccgcgcgcacaaccgtgggcacgtgcctcgacgggttcggcgagctcggcgcgtccccgggccggagttcgccgccgcgctggcgaacgtgtcgaggctggtgaccgacgcgctcgcggccaccgcgctccggcgcgggacggagaatggcgcgcgcgctgcaacaaactcaggcgatggcgacggccggatgctcccgctcgacatggcgaggccgggagacgccgacgtggtcgtggcgaaggacgggacgggccatttctgcaccgtgggcgaggctatcaaggcggcggcgaggcgggcgacgaacggtggcgggaggaccgtggtgtacgtcaaggcgggcgtgtacaacgagaacgtcgaggtgtggaccaccaacttgatgctcgtcggcgacggcattggccggacggtgatcaccggaagccgcagcgtccggggaggctacaccaccttcagctccgccacattcggtacgccacgttcatctctctctctccttgcgagctgtgagtgtgagtgtgtgacactgacatggatggatgtccatgaagccgtgaacgccgacggcttcgtggcgtgcggcgtcacgttcaggaacgcggcgggcgccgggtccgggcaggcggtggcgctccgcgccagcggcgaccgcgtcgcgttctaccggtgcagtttcgagggacaccaggacacgctgtacgcgcacacgctccgccagttctaccgcgagtgcgccgtcgccggcaccgtcgacttcgtgttcggcaacgcggcggcggtgctccagcgctgcagcatccgcgtacgccgcccgccgctcccggggcagcccgccgtggtcaccgcgcagggccgcgtcgaccggtacgagcgcaccgggttcgccatccacggcggccgcgtcaccgccgcggccaggttcggcgcccccggcgcggcggcgtcggcgccgttcgaggcgtacctggggcggccatggaaggagttctcccgggtggtgtacatggaggcgtacatggacgccacggtgggcgcggcggggtggctggcgtgggacggcacggcgttcgcgcagagcacggcgttctacggcgagtaccggaactccggccccgggtccggcacggaggggagggtgaggtggggtgggtaccatgtcatcaccgatcccggcgtcgcggcggagttcaccgccggcgagatggtgaacgccggcgagtggctgggctccaccggtgtccctttcactcctggactctagctctgtatgtatattggcattttgtgctagggactggtgattttgtgtatacagggactagattgaggtccccatcatttgtaaaatcagccgcggataaaatttaaattttaaatttaaagttgattttttatagaagtttattttccagcattgacttttaaatcactaataactaataacgtatatataaaagtttaatttataagttatactgttatttactaatataccgtatactatgtattatcccatttatccgtatatgtccaactgatgaggaactaaaactactgacggtatcctatcttattataaagttataacccactaactctaacactcaacatgcaaatatgccatctcatcatccactaacaataattacatgcaaaactaatacaaacatgcaacatcatctataattcattgaatttacaagtcaacatctaatcatcctccttcacattatttttcagaatatttttaacatgtatatatccaacatttttataatccttaacatatattcatgcatataatcaaagtgcgggatatcatgtatatttcatttacaatctcatacagagtctattaaatgtatttatcttagaacatagtttgacaaactatttttatttgttgttagtaactaatataatttttatttttatctcgattattaaaaaaatttaaaagtcacttaggaatttccgtagaaaagcgcggggaatcacctagttatctcatagctgttccaaagattgaaagtatattgtaagatacacgacgctagcaaaaatagcggcccagaacatggaccggcttgtaaacatactggaccaatatgcaaaggaaaaagttcacctgccatcccttacaccgagtttgttagacatcccttatcctcaatatcagaaaccggcgatggtcggcgctgctccaggtattatccgggacacgatggagcgacatggacggtggcggcggccggagatggcgccgctgcaaacccacgccgccgacacgagccacagcgacagcgacaggagaagaagaacggcgtgccggcgctggggcaggaggagcaggaggcgtgcacaccgcgtgtgccaactccctcttcgctgcaggagctcaccaacgacgccttcagcggcgacgaaagaaaaaggaataagaggatgagaaaaataacaagagagtatgggagattgacaagtggacccatgggcaaacttgtctttaaccaatatttctctctccgttttatagaaaataataaattaatcccgcgggtgtccagcaactaattaccacatttttacagtgtccacgagtagatttactttatttaggtgtctcacaacaaaggtcacaaattttgagttttctatagcaaattttgcctaaactttatagtatttgctctaagtacggtccaaatcctgtagttctacagtatttgtaaagaaattcaaatgcaaggaagaaaacagttaaacagttgaaggttgtatttgcaatttttgtagatgaaaggggaaacgctagtctgtgtgacacgtcactctcgttccggctcggccagtcgccgacggccaacctcgcctcccagtcgctcaccgccgctcgcttcccggcggctcaggcgggcgcggcgatttcgctttactccatataacgccgctgcgggccggcggccgcgggcgtcggccatgtccccgcatggggctatgggcgtagcggcggctgggacgccgctgaaggcggaggagatggccggcgggtgtactggatggatctccgtcggcccgtcggcgacaggatggaacggcgaggtgaggtccaaccgcccaaattttctcttctttttttactttgtcttcaaatctatattgagagcacttactgtttctgcgatttgcattcagtgtccatcttggagctacccttagaaattttgggataagttgcttgattcatgaggttatgcgatttacaagagcatataatgcagttgttttctgttgtgcatctgcatcctagtctaaattaatataattgacatggtttgcctttttcttttttgaaagaaaaagaaggataatagaattcagaatagacatttgtgtgcactgtgcagaatttggcagcaaattgttcagctggaatcaattattgcaaatgggggtcattcagccgcaaagccgacttgtttgaatggccagatgcagcgaaagtctctgacagagacaaagaacatgcaagcaatgaagtccaccgagaaccaaggactgtagtagaagtagcaaagtctctgaagaagaaaatgttagaacttagtccatgaatcacggaagacaagttgagtttgctaaccgagcatcagatgattggcacgcctataaatcagagaatacggtgcagtagcatacagtctgtcagagctttgctactagatgacttcaaaatcaggctgccgatctgtaagcatttccttgtttagttcattcctttccattgttcagaattgagatatcttttcattaaagaagataagtattgaaaactataaacttataaagatggcactaagccaagaatccagtttagaattggttccctgacagtggcttgtcactctagtatatatttgatcagaaaccgcttgtgttttggaattgattagaccaggaaaatagctgctaattctatgcgttgtctgataaatgatccatctgtgctaaaactgtagggatcagaagcgaacttgaagtgaactgagtggcagctacatcagtccagattcaagacagagttccattccttctgtctggccacatgatccagatctacatttgaacatagctagtcaataatgatggttattacaactggaaagattatcttgattttcttagcttgcactgcacatgtcgtcacctgcagttccttatatggaaacgagacagatcgagtggcactgcttgaattcaagcaggcagtctgtcttgatccaaaacaaaccttgatgtcctggaatgacagcatccacttttgcaattgggaaggcatcttgtgcagcttgaggattccatatcgtgtcacttctcttaatcttacaaatcgaggtttagtagggcaaatctctccttcacttggaaacctcacatttctatcaattctatcccttacagagaattcattcagtggacaaatccctgcatcccttggccacttgaaccacctccaaactctctggttgagtaacaacactctgcaaggagttataccagattttacaaattgttccagtatgaaggctctacggctgaatggcaataatctagttggaaaatttccgcagctgcctcatcgccttcaaagtctgcaactttcatacaatcatcttagtggaaccattcctgcttctcttgctaatatcacaaggctaaatgtgcttacctgcacatataataacatccagggcgatatcccacatgagatcggaaagttatccagcctgcaattcttgtatgtaggtgcaaataagttggttggcaggtttccacaagccatcttaaacctttctactcttattggtcttagccttgggtttaataatctaactggagaggcaccatccaatcttggtaattgtctacccaaccttcagctacttgaattagaagacaactgctttcaagggcaaatcccctcttcgttgataaatgcttccaagctatatcgtcttgagctagcaagcaataacttcaccggtgtggtgcctagatccattggcaaactaaccaagctatcttggttaaatcttcagtccaataaacttcaagctcgtaacaagcaagattgggagtttcttgacagcttagccaactgcactgagctgaaagctttctcgatagctagtaatcatctagaaggacatgtgccaacttcattaggtaacctttctgttcagcttgtacaattgtttttgagtggaaatcaattatcaggtggttttccttctggcatagcaaaccttccaaacctgatttatattggactggacaacaaccagtttactggtgcagtcccaaaatggcttggaactctcagtaatttacaacagatattgttacatgagaacatgtttactgggtttattccaacatccctttcaaatttatctgtactgggatctctctggctagactataacaaaattggaggacctttaccagcaagcttgggaaacctgcaaacgcttgaaacattgagcatttcaaacaacaaactccatggtagtgtaccaatggagatcttcagaatcccaacaatacggttaattgatttgtctttcaacaactttgatgggcagcttagtgccagggtaggaaatgctaagcaactcatgtatttatatctttcatccaacaatttatctggagatattcctagttcactgggcaattgtgaaagtttggaaggcatcaaattgggctcgaatattcttagtggaagcattcctacttcattaggcaacataagaagtctgaaagttctcaacttgtctcacaataacttaagtggatcaatacatgctaatcttggaaagttatggctccttgaacaagtagatttgtcatttaacaatctcagcggtgagataccaacagaaggaatattcttgaatgcaactgcagtgcacatcaatggaaatgagggtctttgtggcggggcactcaatttacacctacccacatgttatgtcatgcctttgaattcatctaggagtgaacgatctattttgctgtatttggtgatattatttgctagcctggtgtcagttatattcatatatctattattgctctggaggggaaaacagaagaaaaaatgtacatctttgaccccatttgatagcaaatttcccaaagtttcttacaatgatctcgccaaggcaactgaagggttttcagcatctaatataattggaagaggaatatacagtcatgtttacaaaggggaattgttccaaggcagagatgtggttgctgttaaagttttcagcctggagacagaaggagcagaacatagttttatcacggaatgcaatgctttgagaaaagtgcggcatcgcaatctagttcctatcttaactgtgtgctcaagtctggatactaagggaaatgatttcagagccctggtgttataagttaattccacaaggagacttgtattctctactgcactcaactagagatagtgagaatggtttcacttcgaacatcattacattttctcaaaggctaagcattgttgtggacatagcagatgcattggaatatcttcaccatacaaccaagaaactgttgttcattgtgacatatagcctagcaatattcttctggacaatgatatgaaagcttatgttggagatttcggtcttgcgaggctcaaagctgatgctgcagtaccatctgtcggtgactcaaactcaacttctatgattgcaataaaaggaaccattggatatgttgctcctggtattatttcctgtttttcaatttaacttgagaattttttgtgcttctaccaacatttggactaagttatccttgattgatgtctacagagtatgcatctggtggtcaagtttcaactgctgcggatgtttatagctttggaattgttctccttgaagtattcttacggaagggaccgacagatgatatgttcaaggatggtctggatattgcaaaattcgttagtatgaactttcctgacaagatactagatattgttgaccctgtattactacaagacgaactggattgctcaaaggaatctccagttgccatgaaggaaatcttttctgagggtttacattcagtgctaaacattggactttgctgcaccaagcagtccccgtacgagcgcatggacatgcgagaagtggctgcaaagctacatggaacaaggaggcatatctctgaggcaactaggtaatataatgtaagatatgtaccctgcctatagctgtgagatactctgctaccttctcgcatggcatgtttaatattgtcactctctcttatataatgaaatcacaactcttgttattgctgtaataatccgagcactacatttggtttggaatcttacacaattacactgcagatacatggtattgttggaaactctgcactgttatcatat

SEQ ID NO: 25765 - DNA, 1549 bp, Oryza sativa
gggtgttggtttcatgtcaaacaatatcaagggaaacatcccaaatgatttttcaaagttcgtctcgattgggtatcttgctgcgagtcaaaacatgttgtcaggaaggtttccacaagccatcttaaatctctctactcttgatgttctttaccttggttttaatcatctaagtggagatttaccatcaaatcttcttgactcgctacccagcatagaaatactttcattgggagggaacttcttccaagggcatatcccctgctctgtggtaaactcttccaacctaggtttactagacatttcatctaataattttactgggcttgtaccaagttccattggaaaacctaccaaactgtatcacctaaatcttcagtccaatcaacttcaagcacacagaaagcaggattgggactttatgaatggcttaaccaactgtactaggctacaaatgatctcgatagctaataaccgtctacaaggccatctaccaagttcattaggtaacctttcctctcaacttggaatgctacatttgggaggaaatcaaatatctggtgttttaccttcggacatagaaaacctctccagccttacttatttccggattgataccaatgaaattacaggtgtccttccagaatggcttggttctcttaaacacctacaagtattaggcttatttaacaacaacttcacggggtttattccaccgtccctttcaaatttgtctcagctggtatatttaattctagattttaatgagttcgatggacacataccacatatcttgaaaaacctccatatgcttttatcattcagtgctttccacaacaatcttcgaggtagcataccaaatgagatatttacaatcccatcaatagttcaagttgatttatctttcaacaatctagatggacaacttcctgcggcaatgcaaaacaactttcaaagttgtcacttgcatcgaataagctatctggagatattcctaacactttgggtgattttgaaagcttggaatacattgacttatcctggaataatttcactgggatcatccctgcttccataggaaagataacaagtctagaggttctcaaattctcacacaataacttaactgggccaataccatcattgcttggtgacctacattttcttgagcaactggatttgtcattcaaccatcttaaaggtgaggttccgatgaaaggaatattccagaatgtgacagccttgagcattggtggaaatgagggactatgtggtggatcacgagagttacacttactcgcatgccctgtcatatctttggtctcatctaagcacaagaaatcaattttactaaaaatactaatcccagttgcctgcttggtatcacttgctatggtcatatctattttttttacttggagggggaaacggaagagagaatccctatcattaccttcatttggtacaaatttccccaatttttcatataataatctattcaaagcaactgaggggttctcatcatccaatttaatcggcaaaggaagat

SEQ ID NO: 25766 - DNA, 37930 bp, Oryza sativa
  unsure (1)..(37930): unsure at all n locations
gcactgcttcaaattgtatttcattatctgacatgctgatgtgagtgaacttgaatcttgtcatatgcaatctacagaatgttcacatggtggtcaagtttcaactgcctcggatgtttacagctttggagttgttgtcttggaaatatttattcggagaaggccaactgacgacatgtttaaggatggattgagcattgcaaagtatgcggagatcaatttccctgataggatactagagattgttgatccccaacttcaactagagttggacggccaagaaactccaatggcagtcaaggagaaaggcctacactacttgcactctgtattaaacattggactctgttgcaccaagatgacaccgagtgaacgcatcagcatgcaggaggcagctgccaagctgcatggaatcagagatgcatatctcaggggaaactgaagaagcagtgcagttacctcaatggttttggttttgtctgaacgcattatatattatatatagcattatactagcatgcatgtgtgcatcttgttctggttaaatagatcggtattgccttgaataaagaagtggccattgtcctagagcagcaaatgtttttagattgctgtttgattcatttctaattttgaaacgaggttacataaacatcaggtgtttttcgtcgttcactgtgtgagttaaacttgagcttgtactgaaggatgaaatcctacacaaaacgacatcaatactcttgttttttagcagtttggaggtttggtcatctctggcagactggtactaattgaacctactcctatacggctaatgggttcaataccgagatacagtaagggacacaactataccgagagtgctagctggatagtgctatagagagacacccttctttcaaaaaaaaaaaaagctcactcaatatttatgtattttttttcttcttagagaagtttctcttaaattacttatccgatttataattcgattataccgttgtgttcgttgcaattaaatctttacaacaagatcttacataattatattttgatgaaaaattatatattacttttatcatatatctaaattacctttagatttcactaaattacttcttaggcatataaaagtaattcaataaaacctaaaagtaatttatatatattatagaagtaacttataacaaaaggaaagtaactttaatgaatacctttttccataggacatgaagtcatattttatccatacaacgaatttacttctaatgtcgtgacaaagttacgtccgttttattttaagttatttttataatatatgtaaattacttttagactttatttaatttacttttatatgtctaagaagtaatttagttaaatctaaaagtaacttatatatatgataaaagtaaattatgtatataataaaagtaatttacaaatataaatatgttttcatcataatataattatgtaagatcttgttatgaagatttaattgtaacgaacacaattgtgtaatcggattgtagatcggataagtaatttgagagaaaactttgtttgaagaggaaaaagggcatgcatgcatgtcgtacgagtacgatgtagtagactccatgtcttctccatatttaggtgtcgctggttaagataaaaacgagaggcctctccaaatagatttcacgtacaataagctattaggctaagcattattttcaaaaatacctaaaatacccttgcagacatacaaaattaacaattgatttatttcattagaagtttaaaaaaatatgaaaatttttacgtggcctcattacacaacatgggagtttgtatagatgtttcaagtttttttctggtatatttaatttttagaattttttttgtggtatatgagagaaaatttgcttatacgagagaaatatcttgtgtagtgtatgaaagatgatttatattaaaaacatcaataaaaaatattttatacagcatataacatataagttatactttttctaaaaaaatataaatgtaaaataacctatatacaaacttccatgttttgtaaggaggccacacaaagtttggtaaaatttgctacagagtatccttctaaaatttgctataagttatacattaaacggtaggagatttgccgtatatattagaagaaataaaaccaagagagtgcagaaacgaaaacaacaacaggccacaacaagtcctgtgacagaaatttacaacccaagggaaaaaaaagactgtgaaccaggttctatcaacagcagtagagcctggattggttgattaggtctatattctctttaattagaaaggccacctgaagctcgctttttgaagaatcctggaaaatcctcctattacgttctaaccaaatattccaccacgttgttaaaaggacactcagaatttgcttccttcgtgatttaggcttgatcgtgcagagggtgctccaccagtcttcaatggaagctgctgtatgttgatgcggtgcttgaatgtcgaaccatctactaacatggtttccaaaccaaaatcgtaaaggggcactcttttgctagatgtgtggcatcctcgaaggccccccctgcataaactacaaatccagtagtttacagaaaacatgattttctctaatgatgttacagagcgacaaatatttatagttttgccgtttgatttgtttcttttcatacgaggtgatcatatttaatttacatcatggatctcctagttcatcgttcattaaattcatatatgaggccccattacaaatattcagaccgctatgattggtgaatttgtggatagatgtataatgtaaaacaaaacccgtttcatattataagtcgtttaatttttttctagtcaactttataaaaaatatagtattatttttaatcaaaaaacaaacgtattatcaaaatatatgtaattttatatccaataaaattaaatttgatattttagatgctgctaattttttaataaatttgattaaacttaacaatgtttgactaggaataatatcgaacgacatataaatatgaaacggagggaataccaatcaaggccactgctatttttttcctttcatctttaaaactttcatccaagattttatatgaaaaagtatccgctaagaatgcacgttccaaataccaatcaaagcggcgcaaaaaaaaaagacagaattgtaattctgggctttacgtgggccgtaattggacccgtcgatccccttgacggaaaacccaaccgacgccgccgcccgatccatcggcggccggcggcggccggtgggtgatgctcggcggcggacacgaggtcgaggactccttcgacccctgcttcaccgacgcccacaccgtgtcgccttcccgcacctccactccgcgcctcctagcttccgcctcgtcactccgccggcggtgtcgccctacgcgaccacatcgccggtgggcggtggcgtcaagctctgtcagggcggccggagactccgcgctcatccggataacctgcggatcgccggatcatctgcagcatatacaaggtaaagtaaaactactatctcccatttaattgctaggttacctaaataattgttagtacatatctgaatgcactactctacgattacaagacgagaaggacttattatctcataatttaattgcaggattattattatggaaaattacgggtctgagtggctgagattttcgtttctgatgaatctcactgatgttgaacaatgatcacagagcaagtcgcctgctgtcgtgtcgtcgtctcaggttaatcgtatcccagaatggagttaacatgggaccgatcaatccaccaattgttagaatcatataagaattcctttcaaaaaaaaaaacaaaagagagaaaagaatcatataagaattacttgtggaactggaagtataataaaaccgttggcgtcatgttgtcaagggtagtatactgtatactggagacggaggctacattattggccacttggtcatcaggtgagatgaacaaacaggttagctctacatagatcaataatataattgcctaatcaagacaaaactatggacaaaaagttaggtaatcctccattttcactgaagattagcctcctctctgaagaaaaactggtgttgagttgaattccatgggctggtagctggttgagttgaaggccttagcttgccatgatagtgcagacgccatggctcttactgctacaaaaatgaagcagccgacgatggccacgaggctggctgcaggctgcaccctctcgctggtaacccctcacgaatgcatatattgattgatcttttaatttgtttctatgttcatcattttgttagttccatggaatagtatataaatgttggatcaatcgtctgcttttggggattgtatggaatgagcctaactatacctacaggcttgtttctgtctgtaaacttattgcgtactagatacagatgattagaaacactatatttcccttttttggtgagattgtcagaaattattacttctgtgttacctagaacttatttgttcagaatatcagatagctttgctagctttctggctttcgtcctcctttcaggtctctgacactagagacttttattttccaccgattggtgatcatttatcttgctataagcctttatgtttcatccctgactcttctgtctcaatggcagttggattgatcagcccgtatcagcaaaggatttttcatgttgctgaatcttgccagaggaaaggatatcaattctgtctgtggagacgaagtaaataagaacaaaagctttcttggtactttacatttgtctatttgccaacattctctaaccatctaaaacagcttctgaaattttaggctcttgcatgttctttaaaaaggattactaaccgatatgtattaatccctttctcttttgtctatgcatataagcaagacctaaatttattcgtccaaggagctggtcatgaagatcactgcaattgggttgtttttgttggtgcttatagcgagctgtcctgtccaaatcttctgcagttcgtcgtatggaaacgagacagataagctctcactgcttgagttcaaaaaggcaatcagtcttgatccccagcaagccctgatttcttggaatgacaccaatcacttttgcagctgggaaggagtcttgtgcaggaagaagacaccccttcgtgtcatttctcttgaccttagcaaccgaggtttagatggacaaatctccccttcacttgcaaacctaacattcctaaaatttctttacctagacacaaattcattcacaggagagatccctctatccctcggtcacctgcatcacctccaaaccctctacttgagcaacaacacattagaaggaaggatacctgattttacaaactgttccagtctcgagattctactgctcaatggcaatcacctagctggacagttgaataatagctttccttgtcagcttcaaaatctgatacttgcagaataacatcttactggaaccatcccttcttctcttgccaatatcacaggactaagaggacttactttcatgtcaaacaatatcaagggaaacatcccaaatgagttttcaaagttcgtcatgatggagcttcttgctgtgagtggaaacatgttgtcaggaaggtttccacaacccatcttaaatctctctactctcactaatctttaccttactttgaatcatctaagtggagaggtaccatcagatctccttgactctctacctaatctacaagaacttctactgggtcacaatttttttcgaggacatatccctctctcattgggaaatacttccaacctacgtttactggacatatcaaataacaatttcaccggcattgtaccaagttccattggcaaactaaccaaattgtctttgttaaatactgaattcaatctactccaagcacacaaaaaggaagattgggagtttatgaacagtttagccaactgctctagactacaagttctttcgatgggacataaccgtctagaaggccatctaccaagttcgttagggaacttatccactcatctgtgacaacttattttctcaggaaatcagctcaggattttttccttccggcatagaacacctctccgacttgaattctttaggactagataataatgaattaacaggttcccttcctgaatggcttgagaatcttaaaaagttacaaaagttaaccttgcaaaacaaaaatttcccttcctgaattgcagttattccgtcatctgtttcgaatctgtctcaactagcagttctcggactatattctaacaagttggaacggcacataccaagcttcgtaaacctgcaaatgcttcaactactagtcatttccagtaataatcttcatgtcagcataccaaaagagatatttagtattccatcaataattgcaattgatttatctttcaacaacctagatgggcaacttcctactgagattggaaatgctaaacaactcgtatctttgggactttcatccaacaagttgtttggagatattcctaacagtttggtaagttgtgaaagtttggaatacatcgcgtttgactctaatattctcagcggaggcatcaccacttcattaggaagcatgaaagagaggattaggctttcgacccaaaacgaggaagaattttcattaaaattttttaattataatgtattgcgatcccaatatttcattatatttctcatcctccaatagctattgtattactttaaaaaaacatcattacccgttgcaatgcagacattttttttagttttataaaaagaaaaaaaaggacatgcctgacctagcaaaatagatttgtagcttgttgttgttgctgtagttaagtactaacacttctctcatgcatagatacatgatgcaacggacctcgggtgcggtagaccccgcggtctcaggcggtccactgtccagcagcggcgataagccaccagccacacatgaagaatccgcagtggtgtggagctttgtttttcaaagtcaacgggaagtcctcgcgcccaaggaccattaccagatatgccgagcgcgcaatgtggctgtccaaacccaaacaagcctatccggttggttatcaaccaacaatgtggcggagacaattggccagaaccactcatgatggccgctcatttactcaatggtgtacaaaactacttgaccgaaagacgcgcacaaagctagctagtttcctctgagatatgaatctttgattccgtgtagcttggcagcaacctcctgcatgctgatgcgttcaatcggtgttgtcttggtgcagcagagtccaatatttagcacactgcgcaggcagtgtatgcctttctccttgactgccattggtgtttcttggcaaaggtccagctcgtgttgcagctggggatcaacaatctctagtatcctgtcagggaagttcatctctacatgctttgcaatgctcaatccatccataaacatgtcttctgttggccttctccgaataaataattccaagagaacaactccaaagctgaatacatctgaggcagttgaaacttgaccgccctctgagcattctagagtttcatccagcaagagttaagttcacacaaatcagcatgtcagataataaaataaaacttgcagcggtgtaatacaagaaaaacaaactaatacctgatgcgatatatccaatggttccctttattgctagggaataagttgagcttgaatcccctagagatggtgttgaagaaccggtcttgaatcttgcaagtccaaagtctgcaacatgagcaatcatatcatcatcaagaagtatgttgctaggcttcagatcacagtgaacaatagttccttggttgttatggtgcaggtactccaacgcatcagatacatcgaccacaatgcttatcctctgagccaatgtaatgtggttcagatatgaagtgttttcatcattttgtgctgagtgtagtaatgcatgcaagtcacctcgtcccataaactcataaaccaaggccttaaaatcatttccttttgaatcaatacttgcacatgcagttaggataggaactaggttgcgatgccgaacatttctcaaagtattacattctgcgatgaagctcttttgtgctccccttgtctctaggttgaatactttgacagcaaccatattatcatcttcgaataattttcctcgatatacataactgtatcttcctttgcctatcaaattggatgttgagaacccccctgttgctctgaaaatcatattgtatgaaacttggggcaaatgcctagcaaacgagggcaaagataaagattttctgttctgttttcttctccacataagcacagtaaatttgaccatagaaattgacacaatgctggctattgggatcactactttcagtattattgatttcttgtgcttagatgaaaccaaagccatgataggacatgcttgtaggtgtaactcaggtggcccaccacaaaggccctgatttccatcaatcctgaaagctgttgcattcttgaaaattcctttcgtgggaatctcgcccttaagatggttgaatgacaaatctagttgctcaagaaattgtaaattgccaatagaacctggtattgaaccagttaaattattgtttcagtcacagtctagtccgctacacttttctgctcaacatgtctctctttggcctagcccgcaattggagctataagcccagctcgcacatactgtcgtgttcaagctctagaaagtagtcccatgcaatccccccatcaaattcggccaaatctttctcaattttttaaaattgattgagggcttttgatgcactcgaccactctttttgtttttcccaaaattgaagtgaatcagtaacactcgggataaaaacatccagggaagctccagctgccggccatcatcggcaactgttaaataggggattgaatttggtgaattaaagcagtattgaaagggaaaatcacgaggaaaacaaagatggaggagtgaggaatcgatttttacaatcaattaaaggagtaaacgtacggggaggtacatgatgttgcggtggctgaggcgcgctgcgcacgcggatcagaccggaggagatcgaacaaaaaccgggcaacgaaaaaaatgttccacgtgaaaaaaaactgcgaaaaaactagacggccattgaaaaaaaagggcgacaaaataaaaaaaaaacgagcggagacggaccaaaccgtaactcacggtattatgaatatctaagaagtaatttaatcaaatctaaaagtaatttacatatatgataaaattaatttaaatatataataaaattaattatatatatgttttttatcagaacatgaccatgtaacatcttgctataaaaaattatttacaacgaatataatgtataatccgattgttgatcggataagttatttgaaagaaattttatttgaagcttacctattaggaatcttttatttatactgttgcatgcttgcacactttgacgtgagaaaaagatatattgctacattttaccatttattggtataatagttggttttgattaattagtgcacatgtactcggagaaaactacacgtcgggcgctcgatctgggggtggggaaatcgggcagcatgcaaaactaatttaaattgttttttctcttaaattatttatccaaattatgatccgattacaccattaaattcgttgcaattaaatctttgaaacaagatcacacatggatgtatttcgacaaaatttttttagcttattattgaattatttttaaatgttgcacgttgttccaccaagtatatcggaattgtttcactaagtagatcgaaaatgtttcaatcgtttaaatcggtcgttgtttcacctatataaaaacaatgttttagcaaatagcgaaagaatgtttcagatcactgcaacatttgatccatacatagtgaaacattataagtacactaggtgaaacatttttggtggaacaaaaattgaaatgaattcccttaataaagggtttccataatatgtaggtgatttgttgcaaaagaatgtttcaattcactgcaacattagatctatacatagtgaaacattgtgagtatactatgtgaaacatttttggtggaacaaaaaatgaaacggatcacctagttggacaactgaataataattttccccctaagcttcaagtgctgactcttgcatataataatcttactggaactatcccttcttcctttgccaatatcacaggacttagaaaacttgatttcacagctaacaatatcaagggaaacatcccaaatgagttttcaaacttcctcatgatggagattcttcttttgggtggaaatatgttgacaggtaggtttccacaagccatcttgaatctttctactctcactaatcttcaccttagttttaatcatctaagtggggagctaccatccaatttcctttactctctacccaatctacaagtacttgcattggactacaatttttttcaaggccatatccccagctcattgggaaacgactccaacatacgtgtactggacataacaagtaataatttcactggagttgtaccaagttccattggcaaactaagcaaactgtattggttaaatctttaatccaatcaactccaagcacataaaagggaagattgggagtttatgaacagcttagccaactgcactaggctacaaagtttctcgatggcttataaccgtctagaaggccatctaccgagttcgttaagcaacttttccgctcatctccaacgacttcatttaggaggaaatgcaatatcagagtcttttccctctggcatagaacacctctcaaacttgattgctttatcagtaggaactaatgactttactggtacccttccagaatggcttggaaatcttaaacagttgcaaatattaagtttatatgacaactatttcacagggtttattccatcatccctttcgaatctgtctcaactggtagctctcacactacaatttaacaagctggatgggcagataccaagcttaggaaaccagctgcaaatgcttcaaatattcaatgttttgtacaataatcttcatggtgtcataccaaatgcgatcttcagtcttccgtcattaatacaagttgacttatcttacaacaacctacatggacaacttcctattgacattggcaatgcaaaacaactagtatctttaaagctttcatcaaataagctatctggagatattctgaatgctttgggtgattgtgaaagtcttgaagtcatcaggttagatagaaataattttagcgggagcatccccatttcattaggcaacataagtagcctaagagttctcaatttatctctcaataacttaacagggtcaataccggtatctcttagcaatctacagtatcttgagaaactaaacctatcattcaaccatcttaagggcgaaatcccagcaaaaggaattttcaagaatgctacagctttccagattgatggaaatcaggggctttgtggtgggccaccagccttacacctaaccacatgtcctattgtgccattagtatcatctaagcacaataacttaattttactgaaagtgatgatcccactagcctgcatggtgtcacttgctacagtcatatctattatttttatttggagggcaaaactgaagagagaatcagtatcgttgccattttttggtagcaatttccccagaatttcatacaatgctcttttcaaagcaacagagggtttctcaacatccagtttaattggcagagggagatatggttctgtctttgtagggaaactttttcaagaaaacaacgttgttgctgtgaaagttttcagcctagagacaaggggagcaggaaagagcttcatcgcagaatgtaatgccttaagaaatgtgcggcatcgcaatatagttcctatcctcactgcatgctctagtattgattctaaaggcaatgatttcaaagctctagtgtatgagttcatgtcacaaggggacttatataatttactatatacaacaagacatgatagcaactcttcaaagttgaaccacatttcattggctcagaggacaagcattgtgctagatgtatcaagtgcattagagtacttgcaccataacaaccaaggaactattgttcactgtgatctgaaccctagcaacatccttctagataaaaatatgattgctcatgttggagactttggccttgcaagattcaaaatcgattcttcgtcaccttctctaggtgattcaaacttaacatcttcactcgcaacaaggggaaccattggatatattgcaccaggtactggttgggattttatcttgtttggtatatattgctacctattttctttttactattatgtgacatgctgatgtgtgcgaactcaaatattgccaatgaaattgtagaatgctcagagggcggtcaagtttcaactgcctcagatgtattcagctttggagttgttctcttggaactatttattcggagaaggccaatagacgacatgtttaaggatggattgagcattgcaaagcatgtagagatgaacttccctgacaggatactagagattgttgatccccaggtgcaacacgagctggacctttgccaagaaacaccaatggcagtaaaggagaaaggcatacactgcctgcgcagtgtgctgaatattggactctgctgcaccaacccaacaccgagtgaacgcatcagcatgcaggaggcggctgccaagctacacggaatcaatgattcataccttagaggaaactagctagggatctctcatagcattgtgttcatctttcggtcaaatagttgtgtacaccattgagtaaatgagtggccattgtcctagtgaaatactgaaatgtggctttgtcaccacctgcgacaaatgtttatgttctaatatactgtttgatttgtttctgcttgatattaggtggccaatacatcttgcatcttccataagtcattgtatttcagacctcatgttggcttaacagtaccatagcttgtatagtgaatgaccaagaacacaaaaaatcacatgatggaatgctcatgtcccgtcctttgcattgttagcagttggggcctttgcataaacattcatctgcttgcttgtcgtagtttatcgtccactcgtatagctttggcagacaccggttacagcacttgcaggtcgaaaggctttgatcctgctcgaggtaacaacgatggaagaaactagaaactagttaaactacattgtgcaagcatctgacatgaccatcagaatttccgagtactttgccctgaactgaactgatagttggcagatggcattgcaggatgcctcagccgctcctcactcacagcgtgtcttgtccagctctttggctactagcaagatagcggtgaatgccgtgcgccaggggcggggacgggcttggccgcggccgttgcctctgtagagcaccgcggtcttcactgccagagagggtggaccggcctccacctacgcgggccctagacggcgttgcctccgtagagcatccggccttcagtgctagagggggtggacctaactccacctacgcgggccctggacggcgttgcctccgtagagcaccacggcctttaccgccagaggggatggaccaaactccacctctcatgagctccggacggcgccgcccctttaagccacatggtctccaccaccgagggacgtcgccctatcgagcgttgtcatctgccacgactgaggaggtcgccccaccgttcacttgagccccttcagtgtggtctccaccgaacgttggggtatccaacgtaaaccttcaggcacaccacaacacccgagtaggggctagaaattatttgctccccccgaatcccggagccagcagatgagggggtaccgttggggaataaccccaagcctagcatatactattagagaggacctccatacttaggatgttgtataaactaatataataatagactagaacatcccaatagcattgcccctctaatgtaattgataagggtaacactataattttcagttacatataaataaaatgagccctccaagtgcaagggaggaggatcttctcgcatggcatcgagggaggagtgatcctctctcccccatcttctctcccaaggattcaagcttgggctctctcccacggaggaggggggcccttgccatgcatgttggactttgttccaataataacgctgcttgatcaccaatgacgagctgagccaaggtgcaaagaacttcggaggtgaatgcaataagcacaaatgtcattcatcggcctaaacgatgagcaaacagttcgaatggagagggaaaatcatgtggggatatcacgtaagtgtataataatttagaaaaatattggggccctattgaaaatttgtaactttttctttctttgcgaacacaaaatatgctaacttggaagtagaaagtttctatctatataaatttcttaagaaattattcataattcattcgtgttaccctcgaatagggatcacaacatcattaaaaaaagtaattcaaaaaatcatttgtataattatgaacaaactaaaaacaacaagagaaactcaaaatattatgaatgtataagaagtaatttaaatcaaatctaaaagtaatatatatatatatgatacaattaatttaaatatacaataaaattaattacaatatatattttttcatcagaacattatcgtataacatattgctataaaaatttatttacaacgaatataatgatatattccaattgttgattggataagtgatttaaatgaaattttatttgaagcttacttattaggaatcttttatttatactgttgcatgcttgcatactttgacgtgggaaagagatacattgctatatttttaccatctattggtataatagttggttttcattaagggtgtgtttagttctttgggtataaagtttttgaagtacacagacacacatttgaagtattaaacgtagactaataacaaaataaattacagattccacctgtaaattaactgtgagacgaatttattaagcctaattaatccatcattagtaaatgtttactgtagcatcacatttttaagtcatgacgtaattagactcagaagattcgtctcgcaatttacatgcaaaccgtgcaattattttttttcacatttaatgccggatgtacgtgtctaaacagatgtgacgtttttgataaaatttttttatctaaacaaggcctaattagtgcacatatgtgtctcgaggttttcgcaggggctcgatccgtggcgccggggagtatcgcctccgccatcgtctacgttgccgacaaccagctcggtcgtcgtcctcgtcagcgacgtcagctcgactggagaagactgctactccgcctctgccaaatcgatacccatcgatgagacgtatcagctacgccgcgctgaaccaatagcccaaaaactgaatcgttttccctgcctctgacctactctctccgttaaaaaaaaaatctagaataggtgtaacatattatagaacaacgaatttgaacagatgtatagctgtgtttagttcagcgcaaagtttggattttggttgaaattggagatgatgtgactgaaaagttgtgtgtgtatgacaggttgatgtgatggaaaaggactgaagtttggattcaaactttggatctaaacacagcctatgtctagattcgtagtactaggatgtgtcacatctagtactaggttgattttttatgggacggagggagtaccattttgtcactctctgtgaatttgggcctgtctagatccactggcaaaattttacacctgccacatcaaatgtttagacatatgcatggagtattaaatataaacgaaaaaataactaattacatagattgagtgtaaattgcgagacgaatcttttaagcctaattgcgccatgatttgacaatgtggtgctacagtaaatatttactaatgccgaattaattaggtttaataaattcatcttgcggtttataggcggattctataatttgttttgttattatactatgtttaatacttcaaatatgtatccgcatatttaatgtgacacgctaaaactttacccccttgatctaaacacagcctttgtctcacggaagtatatctgttgattgttgactacagtaaaatcgtggatggatgtgtggttgctggtacatcactcgttacaggaggggagggaggactggaggagctcctctgtagctctgctccttttcagcacaggtcgtcttcacaggtaaggctgtattagttccacgttaaaattggaagtttaaaataattggaacaatgcgatggaaaagttagaagtttatgtgtagaaaaattcgatgtgacggaaaagttaaaagtttgaaggaatctaaacagggcctaaaatgagccaaaagcctgtctcacattgggttcaaactaatgctgccttcttttccgcatatctaaatgataattttttcctttttcgttattataattttcaaattattaaatagtgtgtttttaaaaaacttgtttatctttaaaaaattcaaatgaactcaactttagagtttgtaaaagttaacgcttaatcattgctgcgctaatggcttatctcattttatgtgccaccaccaaatcgtatattcaaactagtcccaaatcactggttttgagcccatctttgactagtaatgatataaaaaaagggggaaaaatatgatatcagaaaatggtcaggactgcctatcatagttttggcttcacatggttctaagtttgtttcttgcgtcttcaccgtgttcgatccgttgaagtttctaccaagtcacatgaccagcgttttggaaagacaacaaatatggagatgttttattacagcctcaaggagttgtaaaatactattttgggggagttgggatggtgacaatttctgcaggctgagggagactggcgctgattggctccagattggccattgtcatccctgtaccaatcacaccctgcccaactctgcttgaggactctcccttttggttcttgcaaattttccatgtggaagatttttccatagcagcagcgaggacctgctagaagggacagattttcagataatgcttgcatcaaccatggatagaggttgagaggggttctgaagaggaacctattcccaagcaaatggctataagtaggtagcagctgactggcaccacctatgtactgcactctgcaccaactgcccagcacagcgtgtactccttacttggtaaggtacacttttcgtccctcgtctagctagtattcatcggcattctatctgattgagcttagtaggtgctgtttgccaaaattagaagtttggttgaaattggaacgatgtgatggaaagttgaaagtttatgtgtgtaggaaagttttgatgtaatagaaaagttgaatgtttgaagaaaaaatttagaactaaactaggcattaatatgattcatgtgggttttgattgtgcgactggtgtagtggtgttccacattacactcttcattagtgccaataggagttagtatagccatccttcaggggtcaatatttttccttttaaattattttctgtaggaacaactaagaaagcaagttttcggatagaggaaaagctgaatattaattaattcttcctatctgtacttcttgacacaccaatattaatatttttcgccaagatatttttaatcacatccactataaatatagtaggtgacgatcttccatgttccttcaaaaagaatatcagttcatactttttttttgaaacggaagccaggctaagctggagttatattaaggagaatagatagtatttacaatatcaccaacaaaggtgaaagagagagaaaacaagggaaacaaggaagaaaagcaacaaggaaaacctaaaagaaagacctaagtggatattctcgcgatgtttttttgccccacacatgctccaaagtttgatttcatcttgaattttggcgagtagttgcggcatggttttctcttgattttggaaaaccttcctgttttgttcacaccatatttcccatgccaccaacatgtggattgactcgagtgctttggccttgcttttgcctccttgagatgttcttctgatccaccattccaacaatacttcgttttcatcgtgttggtgttctatatcgctgcagttcagtctactcaggaccctctcctagatctgacgcacaaaattaagtgcaatctttgaaaagatgttgggcggtttcaaggttcctgtagcatagttggcagaaatagttgtttggccattgtctgatctgtagcctatctgctgtccaaactctattttgcaatagaagtcatgcaaagtgtttgcatttggaaggtgcccattgcttctaaatcagttttgcagccgctaagcttatcctgccattaaactgtgctatgtaggcggactttgcgctgtattttccatttgctgtccaccgccaagttatggtgtcctcaacaccttctgtgagtgcaacgccgctattccacacgtggtagaacacctcgaagaattccttgactagctcaaccgtgagattgtgcctaatgtctagtatccattggtcatttgctagtccttcgtagacagtcctacctttccttttggcatggttgtataaggctggggctaactccttcaatggttgctctccgatccaatttgattcccagaaactcgctttgcgaccttcacctattgtcaccttggtggcggaggcaaatagccttttgtccatttcgtcacaagggggaggtgttcctgcccaaggtttgtttgggctctcccaactgaaccatagccatcgcactctcaaagctcgtgcaaatttctctaagtccaagactcccagtccccaagtttggtgggtgcacatactgttggccaatttactttgcatttgcccccactaatctcttggtcgccagcccagaggaatctttttctaatnnnnnnnnnnnnnnnnnnnnaattttttgggggtttcagtgctattaggaagtatgttggtattgaggttagtactgaagagacaagggtcttccttcccacctgttgcaacaatttccctttccaacctgcaagtcgagagtggagcttgtccatgactggttggagatgcgctctcttgattcttcctattgtcaaaggtagtcctagatatgtgatggggaaaccagttcgatttccattgaaattattcagcacgtcctgaagatctatgttttcacatcttataggcaccactgagctcttgcttaggttcacctgtagccctgtggcacgtccaaagttttccagcaaggtgattagactgtccacatcagctcgacttgggttcagaaagattgctgcatcatccgcatatagcgatgttcggaactttgccaccctgtttgatattggcgacaagatcccttggtctttggccatatccagtatcgtttgcaatgggtcgattgctaatatgaagaggtagggtgaaagggggtccccctggcgcagtcctctcttgtgcataattacttctcatgttgttccattcagcattaccttagatgtggtggttgatagaattaaggcaatccaatctctccaccgtgtactaaatcctctccacggtagcatttccaacaaatattcctaggatatagagtcaaaagcctttgcgatgtccaacgtgaaaaggaggcttggtttccttttgttgtgcatcgatctgaccaagttgcgcacatataagaatttaccttgtatgcatcgtcttttgatgaaagcactttgggcatgcaagaccaggtcatccaatctcatcgcgaggaccttcgatatgagctttgccactgagtgaattaagcttattggtctgaaatcatgcaccagttgtggtgaatctttttttgggatcaatgccaaaatggctttgttgatgcatccaaaatttccgcctgcgagtctaaagaaactatcgaacatctgagaaatatcatgttttatgatgtcccagcaccccttgaagaatgccccagtgaaatcgtcaggtccgggtgccctctctgtcggcgaccctttcaccacattccatatttcatcctcagtaaaaggaccatccattgttccttgttgtattctctgcactcataacgcatcccaattaagtgtgcattctcttagtttcttttcgcctagtatggaggtgaaatgatcatgtagcagcttggccttgtcctcatgtgtgtatacagctgcatttctgtgttgtaagcagtgtatgaagttcttccttttcctagcattagcttttatgtgaaagaaacgtgtgtttgcatctccttctttcagccacctaacccgcgatgcttgttttattattgactatccataatctcttgcttttattatctttgcatttaactaagacttagaataatttggcagagaaggctggtcatgaagatcgctacaatcagacagtatatgattttgcttatggctagcaatgtagtccaaatcatgtgcacctcattatatggaaatgagacagatcgactctcattgcttgagttcaagaaggcaatcagtctcgatccgcagcaagcgctgatgtcctggaatgacagcacttacttttgcagttgggaaggtgtcctgtgcagggttaaaactccacatcgtcccatttctctaaaccttacaaaccaaggtttagttgggcaaatatccccttcacttggaaacctaacattcctaaaatttctgttcctagacacaaattcattcaccggagagatccctctgtcccttggtcatctgcatcaccttcgaaccatttacttgagcaataacacattagaaggagcgatacctgattttacaaattgttctagcctcaaggccctatggctcaacggcaatcacctagttggacaattgattaataatttcccccctaagcttcaagtgctgactcttgcatctaataattttactggaactatcccttcttcctttgccaatatcacagaacttagaaatcttaatttcgcgtctaacaatatcaagggaaacatcccaaatgagttttcaaacttcctcatgatggagattcttattttgggtggcaatatgttgacgggtaggtttccacaagccatcttaaatatttctactctcatcgatctttttcttaattttaatcatctaagtggagaggtaccatccaatatcctttactctcttcccaatctacaagtacttgcattggacttcaattttcttcaagggcatatccccagctcattggtgaacgcctccaacctacgtgaactggacatatcaagtaataatttcactggggttgtaccaagttccattggcaaactaagcaaactgtattggctaagtcttgaaggcaatcagctccaaacacacaaaaaggaagattgggagtttatgaacagcttagccaactgcactaggctacaaattttttcgatggcttataatcgactagaaggccatctaccaagttcgttaagcaacttttcgactcatctccaacgacttcatttatacggaaatgaaatatctgggtttctcccctctggcattgaacacctctcaaacttgattgatttatcattaggaactaatgactttactggtacccttccagaatggcttggaaatcttaaacagttgcaaatgttaggtttatatgaaaactatttcataggatttattccatcgtccttatcaaatctatctcaactggtatatcttggactacattttaacaagtttgatggacacataccaagcttgggaaacctgcaaatgcttgaagtattaaacatttccaacaataatcttcattgtataataccaactgagatttttagtatcatgtcaatagtacaaatcgacttatctttcaataacctacaccgaaaattttctactgacattggcaatgcgaaacaactaatatctttagaactttcatcaaataagctatctggagatatacccaatgctttgggtaattgtgaaagccttgaatatatcatgttaggtataaacagttttagcggtagcatacccatttcattaggtaacataagtaacctaaaagttctcaacttatctcacaataatttaacttggtcaataccagcgtctcttagcaatctacaatatcttgagcaacttgatctgtcattcaaccatcttaacggtgaggtcccagtagaaggaatattcaagaatgcaacagccttccagatggatggaaatcagggactttgtggtgggctaccagagttgcacctacctgcgtgtcctaccgtgttattggttacatctaagaacaagaactcggttatattgaaattagtaatcccactagcctgcatggtatcgcttgctttggccatatcaatttattttattgggaggggaaaacggaagaaaaaatccatatcattcccatcactcggtagaaagttccccaaagtttccttcaatgatctttcaaatgcaacagatagattctctacagccaatttaattggaagaggaaggtttggttctgtataccaagcaaaactatttcaagacaacattgtggttgccgtgaaagttttcaatctagaaacaagtggatcgcaggagagcttcattgcagaatgtaatgctttaagaaacttgagacatcgcaatctagttcctatcttcacactatgcggtagtattgatgctgaaagcaatgatttcaaggctttagtgtatgagttgatgccacgaggggacttgcataaattactatactcaaccggagatgacggtgatgcttcaaatctgaaccacattacattagctcagaggataagcataattgtggatttatcaaatgcattggaatatttgcaccataacaaccaaggaactattattcattgtgacctgaagcctagcaatatccttctagatgacaatatgattgctcatgtcggagattttggccttgtgaagttcaggaccgattcctccacatcttttggtgattccaactcaattttttcccttgcaataaagggaaccattggatatatcgctccaggtaatttgaaaattttatcttgcttttgtattactacatatttctttaacatacctagctatatgagctatactttggtcttatatatgcattttacagaatgcgctgagggagatcaagtctcaactgcctctgatgtttatagctttggagttgttctcttggagttgttcatatgtaggcggccaatagacgctatgtttaaggatggactgagcattgcaaagtttacagagatcaacttctctgacaggatacttgagatcgttgatccccagctacaacaagagttggacctctgcctagaagctccagtggaagtaaaggagaaagatatacactgcatgctctctgtgttaaaaattggaattcattgcaccaagccaataccaagtgaacgcattagcatgcgagaggcagccgccaagctgcacataatcaaagatgcctatctcagagggaactgaagaagtttttctggtaggaatacggataaggcttgtgtatatttgtattaagcttgggactgaagaagctagcagtgctattatactttgttgtttgttttcatttctctatgaatacattacaacaaaaattatcaacgagggatttcccagctggttgagtagatctcaaccattgtctcactaagacattgtgttccctttctcttagttacactggagaacaaatatttatagtgaagagtattgtttatttgtttctccttcatacaaggtcaatgaagtttggcaaatcagaaattcagaaaatactccctcagtctttttttatgtctaacgccattgaattttgaacataactttaataattgaattttgaacataactttaataattgaattttgaacataaatttaataattcgtttaattttaaaaaccatataatcattttttattacaagtacattaagcatggtttctattttttacatacttagattaaacgaatggtcaaatgtatatataaaaatcagagatttgttctggtccagcaaattatacctcaatgcaccagtacttggtggtacctgattgaatctaaccgcccaatgtccaagggcatgatgggaatggatcgggatcaggggcaggccctatagagactgcttttttggcagtagccaatctgaaccgttcaaaaaaaaaatcagacggctggctcacaccaccgcactagctagcacccaaaaggtcatcttcttcctcgagcggtagagccctctttcttctccatgtcaatggaagtgctctgtgcttcttcttacttcatgacaagttgacaactacgggaccttcgtacaaaccattgttgtgaaagtgttcaacccgtcaaggagattctatttttcgtgcttcatcatgatgttcttctatgaactcccataaagtgataatctgcactgccactgtcaaacgccaaggcagtaattaacctgcgagtagaccaagccaacctcgcctcctcctcgttcgatcctacctagctacccgtccaaatcaccaccaaaccacgagcatcaggcaagtaacaagctaagcagcacaactcctggccttgagcccttctcacccattgatacctccgccttgttggtgaccacgctccgggtgccgcctccaccgctccactcttgaagcccactggacatggagaggactaaagggttgttaattcgtagacgtcggatgcttcgtggatggttagatcaggtgctactgctaaagttgcagtaacaatagcaacttcacctgatccgaatccgatgggaatcatcctggactccacgccacccatcctctcgcaggcaccacaatccccccaacacttctccccactgcaaaatactccatgggcgtttgacgctgccgattcattccctcccatcaatgccgctgcagcacacctgttttgtcggcatgagtagtgctgagccatcagttccacctacatgcaggggcggatctatagtgcaatgaccaatgtcaggcgacactgatggcttttggtaaaacctatagcaaaactgattatctatatattataacaccatgatctaaacataattagtatattatgacactaatagatacgttatgacaccaacgaatcaattttctggatccaccactgcctacatggttgcacaagaacccacgcaggcttcccgccgatgtcgaggtgctgcagcacgccggcgtgctgtgtcgcgtacggcaaccactacttctagacaagcaggggcactagagatggttctcttcttccgctccgtcgtccggccgcggtggtgggacaagccagaccccgcctggacggaggacacacagtgacaatgcgatgcatgcacagtgaggattgattcggagtttctgactaatggtagtacataacagattaacagatatataggtacattactaatatggtactcccgaggattatgttgccatttgcaaatctctgcacaatgttgaatagttccacattggttgtggaagggcaaatgacctaagatataagtgggggagctcctcacctcaatggctagcttttagggtgggaaaaaccctttacaatcctacaattggtatcagagtctggctaggttaacatctctggcccgatggatacagtgtgtgaaggcccaatgtgtgaaggggccatgtacagtgtgtgaaggccggtagggcccgaatacggtgaagggctgagggacaccaatgtgtgaaggggacatggacatggccctcgacctcccgctttagggcatatcgcccagagagtgagtgcttgtttgctccattgacgacgactcccaggtgtgcttgtcttggtccggctcgtctgtagatagggacgacaccatggcagcgacggcagccaagggtcacacagcggcggcggcggcacgcatctggccatctgggggaggaaagacgccgctccaatccacttcccaaattttttttctatgcgaaaataccaccttacccttccaccggtgcggtaccacataaacgactaagcagtacatggtggtaccgatcaatattagccgttggatccggtccatctaacagctaggatttggtaccgcccaagcatgctggacagtaaaaaatctcacctacattttctttttgctacaaatcaaaaggacctaatgtgggctcttaattctcactagtaatctctctgagtctgtagtatcagcactgctggatgtaatttcattcaatgtaggtattgatctgcaaacaatccaggtcgttaacaacaacaacggttcaaaacaaggagcaaattgcaaaaatacgtactatcaacgacacagacagggaccattcgctgcatcccagaaacagcggacgaattattacagaaatccatgggcgtgaaaattcttgtcttttcaaattaggcttgttaaacgcatctataagtttttgcattcaatttttaccgtccgtcttatttgaaatttttttataattagtattttttttgttatgagatgataaaatataaataataatttactcgtaactcatgtttttaaattttttaaaattttcaaataagacggacgatcaaaattggacgtgaaaaaccatggttacgtacacttaaaatgggacggatgtagtactttgcttctactacatggagctgagccggtgagatagattgaagatgaggatcaaatcaacttcgtcaaacaagcaaatcattaattagcacataattaattaaattttaattatcgtgaacttgaaaaagttagatttattaataatattttaaaacaatttttatataattttttttataaaaaatacattgattagtagtttaaaaaacatattagtagatgccgatataaaatctatatcttaattagaaaagaattgggcaagagtatctatccacatgattgttgtggtgtcttacttccatttgataccagggtaatccatttcatcatgctcgtggcgtgcaatgagtggacaacagtgaacagttattccccaacaaactctttacgtatgtagttcttgccctcatgctacataataagagaggcattacataatttacaaacgattaattcactaaaggaccgttatttctcccaaattgcttgaagacaaacgtctgtgatgaggagtcacgtcgtcatttgactggagcaagatcgaaccgtctgagttgacttaatagcactgatggtaatttatgctatagaaccgttcctgatgactcagtaacacacgctttgcaaatttacactcaaatgacccgtccgtgatgagtacaacttgtatacaggactgaaagtgtgaaaagaagcgggcaatccttagcggatttgtgctatgaagtttgggcgtaaactcgtagcaaaatcaagattctgcagtaactaattaacgaggtggtggaataatcaatggggatgttgctgccatcgccacgacgatggaagccactggggggtcctgtctagatctacactctctgcagtcgatcgagacgcttttttttttttttggcatttgcaaatttgacaccggtttttttaattttgcaagggtgccactcgaatggtagttctagtggtatttttggaattttctagtggtattcttacaataacgattcaaagtagtgttaaatttgcaattgcccttttttttttcatcgttaaaacgacaatacaacttgttaaacgcccaacaataatgtccttttcctctctgaattgctagttacgaattgttttagattggattgtttgtgatactaagttttcaatttaaatagttgtatatatttggttggatatagaagtcaggtaaaatatacccttctctaaaaaaataataaaaaaaagaaaacgaagtcaacagtatagctatgcaaactaagaattagttgcggagtgcacaatttgttcatcatattgcatccgttttatttacgcttggcatacatatagtccaatgaatataggagttctctatttgttgattaactgattcttttaaatctcagttactttttttagaaacaaatacttttttcataataacaatgtgtgcttcaacattatatcctcacattttgggataccagattaaaataaagagagaataaaactgagctcctcgacaaggtgatatgaataaatcgagctacatacatgcatgcatgtatggttgacttagaccagtcagtcgtcgattgatatcgccgataaatgttagtcatggcaatgtgttagcacgtaccgtggtccgtgggtagaaacttacaatcttatccttttttttataatagaaatatattatatctccatgcctcataagacatacaactataaatttgttacaatcttgttatttgggattatagacgatgtattaaataattaaagcatataaaccaacaagatatacagtacatcgtgatgaaatgtttgcagtactttttatctttcgtgcttgggaaaatgggagatgaaacgaatgagactggagggtgtactttgagaaccaagagctgtctgttttgagcacatatgaacaataaaattaaaaaaaattgacttaaaaaaagtcaagggagtatattctaaacctaccttttggtagaaacttacttttacaagcatggcaaagataattcttaactatcttccaaaaataaaataaaaaaaggatgccaaacatgcactcgcgactgccaatcgattgattaattaggttgtcctcatgcaatgcaaatgtcgattgacgacgtctacccttatcggaatgacttattagcaaataaagactaatttatgagtaattagtaattcaaaagtaaataataatgtaaaataaattatgataaaagaagtacaaaatcataaaattaagttataaaattaaaattttactccctccgttttacaatgtaagtcattctaatattttccacattcatattaatgttaatgaatctagacatatatatctatttagattaatgttaaaaaaatatctatttagattcattaacattaatatgaatgtggaaaatggtagaatgacttgtatcgtgaaacggaggaagcagttcatagctataagcgtaaacgtaacgacgaggccagtcaatctcacagcgacttcttccacttaaattaatgtcgatctcaaactacccaagtctgacgccttcctactaaccaccttattattgtacaagctgcaactcatcgcgacgtcgaagcaaggcccgcaaagtcagtcagtaaagtagtagtagactgatgagattacgtttcaattggttcgttgtgcctataaattaaggcacataccatgcgtgcaagtatgtatcattctgccctcggttgctttactaagctagttttgttgctcgatcgatccatcggtgttccgcaaaataatttgttattttggattcaatcaatcaggtcttcagtcgcctttaaacaattggacagcttgattcgagtgccggcagcctgcagccgacctagctgtaagcatctctgcttgtttgttccggctatttcatttccataatacattaataaaaggggtaacaattaagtatggaaattttgttattttttacagcctaaccctgacataatatttgtgtctcgttaagtttatttttcacctatcttacacgtacatatcaatataaaattaaaaaaaagactataataactttactttatcaaatcccaatacaatagccttactttatcaaactttgatgcaataattactctaaaaacaagggccccttaaatcgtaggaatgaaaaaacggaggaataggaaaatataggattctgacaggaatgtaaatgtaaaacagaggattgcaaaacacagaaaaaatataggaatgatcgtttgattggatttcaggaaaaacacaggaattggatgagagagatagactcaaaggattcttaccaagaggttagacctcttgctaagttttctccaaaacataaattttgtaggatttggaaaacttcaatactttgaattaaagggctacatagtaaaatttcctatagatttcaatcatatgaaattcctttgattcaaatgtgccctaaacttatttaggacaaatagaaggagctaaaaccaaacctattacggaacagaggaaatgtatcactacttggctgagttctttaccccactttcccaactcacatatctcgttttccgcgcgcacgcttttcaaactgctaaacggtgcgtttttttaaaaaaaattatatatgaaagttgctttcaaaaattaaattaatccatttttaaaaaaattggttataattaattaattaccggctaatggatcgctccgtttttcgcggggaggagacgtgggttcccaacccgaaggagctaacagagtgttagcttgcttttcatcgcatgtgccattatggagcatagtacttccaagctagtgtaagactctgcatctaattaggtttcaaaaataaaagactctgcatctaaaacctgcattaactagagggatcagttcctcagacgaagacgggggtgatggtaacatcttgccatggtttggtcccaagtgttccagatgtgattgtagtggtcatttttggtaccatattaaaagttcatgcggatgaaggcctgtttataatctttggtgctcaaaccatggtatattaggttaaccgccttacacgaaacggtttactatacatacgtgcatatctggaattttataaacatgctgttacaggtaaccattatgcaattgaaaaatgctatgtgtccacggggcgataaatcattgtcgtgatactataatatgaatagattcttttttctttgatattttcgatacaccgttttatgtgacagccgaaaaggtgtttattgcaactattgctaacacagattcagtatcaccatgataggaaaaagtaagaattacaatagtatgaattaccccctaaacgacaaaaatagacatttgacatctccaattcatcgaaccggacaaattacacccctaacctgttccagagtggttttgatcctacgtggtgtaaacttggtgatccagttagctaaaaaaattataaaaataagtaggctccaactatcagctacatctctcccatcttctcttttcttctgccttcttccccttcgatctctctctctctctacctctggacggagcaggcaagagggcggtggactaactccctccataggctggcgatggcgacaacctccatccttcaacttgtgtgactccctccatggagctggtgacggtggcggtctccatcctctacggtagaggatgccgccccaaatatccatgctggaggcagtgactgcagagcttgctggaggaggaggtgacgacggagcttgctagagaggaggcactggtggtggagcttgctcgaggaggcagcagaagtacgcgaagctcactagtagacggcataacaagcatgctatcgtgtcgatgctttcccgccacatgcgttcgccgacgagggggtgaggggattcgtccggtttgatgaatcagggtgtcaaatgtctaagtttgtagtttagggggggtcatacgtattatcctagtagttcaaggggtaattcatacttttcccaccacgatatgcatatgtttcatatgattttaagcttgttgcaactgttctgaacactaaaaacactcgcaaaaaaagttattcctttcgaattatcttttgctcggccacaagtgtttagaaaggaaaacaaatccgaatcataattaattcctcatgtaggtaactaagtactacttcttaacaaattaaaagatgaatacactttttaacacctttactagtaatatactccctcagtttcatattataagtcatttgacaatttttctagtcaaactttgttaagtttgactacgtttacagaaagattcaacaacatctaaaatatgaaattagtttcattaaatctaacattgaatatagtttgataatatgtttgttttgtgttaaaaataatactataatattctataaattagtcaaacttaatgtagtttggctagaaaaaaaagtcaaacgacttataatataaaacggagggagtactattctattcgttcgaaaatacaaggtgtccttgttttccacaaagtcaatactttaaaattttggctaaaaattaaataaaaatacatgtgtttagtgtcatgtatatagtatcactaggttcgtatttgaatgtatatagtatcactaggtttgtatttgaaaatattttcacgtgaggctaattttgtagttgtttataataaaaactaatggttaaaaatacaatgttgcagaccatgtagaaacctaatacgtcttatatttttaaatggagagagtaggtgacatttttccatgtttctttacaagaaaaaaaactatttcttcacattatggactatttataatatcttactttaatttattatatgtagaaataactaagacctagaatttggcagtggtggattggtcatgaagatcattataattggactgtgtcttttggtgattatggctagcagtgtaatccaaatgtcacaccctaaaaatcaaaaatatataaattgttgtttaattggaattattagaatttattttaaaagcctagaagagaagatctaattttaattaataaattccaatataaaatagggccagataaaatttcattaaatactttacttaactctataattcctagatttttctgggatttatttgagctaaggaagtatttttaataaatgaaattgcatttcatgaataatttaaattgaaaaaggtttttaaaatcctcttttggctttgggccgaaagtcggcccaaaaccttctctctctctccctcggcccagtcggcccagtccgaccgcagcccagtccgcccgctcgcgcgcgcgcgtcagcccgctgacaggtggggcccacctgtcagggccgtcgtcttcctcgcaccgtcgcccggccgaaccttagccaagccgcgccgccgtctccttccaaatccggctgcccctttccgtttccgatgaaattagtagaggggaaatgatcttcgggatcttctctacctttttccttttggaatcgatcgccaattcggtttggaaatccgtggattcgagttcgattcggatcgatctctctcctccgaaccctagttgttccttcacgtcgccggtcgccgtgggccttcgtcgccgcctccttgcccctttaaaaggacccccaagcccgccgctacccgtcgccaccctcgccttcgcctctcgtcgccggtagagccctagcgccgtgtagcctagcgccgccgtcgccgccgttcgtccagccgtgcgccgccgccactccagtcgtcgtcgtcgctcgggaaggccgccgtcgtgatcgccaagtcatcgccgacctcgttcgcccctccgtcgtcgccgtaggccgccggaacaccgtcgccgtcgtcaagccgaaggtcgccaccgcttcttcctcgacgccgtcgccgtccgttgatctaccgccgccgttttggtcaccggtgagttcgccgcgtcgctctctacgtgctggtgccctccgttcgtgccgtcgcgccgtcgttcgccgacgagcatgcacgcccgagccgccgccggtggtgacgtcgtcgctgacgtcatcgtcgtcgtccatccgtgagccgcggtggatccgatcgatcttggccgtccgttttggataggatcgatctcggccgcccaatctcgtgaaccgccgccgtgcacccgattcaccgcgaaccctagccgctgacgcaataattcccttttccttttcaaaaataattcattattgcgtcataattcaattaaaatccatataagtgttttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgattttgctcttttctctttagattccgacgtttccggagagtccgtttttacaggagaagaatttgaagagttccaaggccagcaaggcaagtcacacagatcccaaacaaccctttgagcatgttgatcctgtttaaagctattgtttctattcaactattgcatttattttcgaatgtcattgggtggaattaacttattgtttgttatagcccttttgttcttgattactttattccttgataccttgggttattataacttgactagttgggctttatatattggttcagctagatattagatatgattgcttagccatgcttagaaacattagcactattgggataacttatggctcactattatttaatgatggcttaatgatagctcacgatggtcaatcgtgattggttaattaattaaattgccaactaaaacctgataatggtgagttgtgagcacatggttttgatggtcgtgctcatgacaattaaggaccggttcacgagtttcggttgtgaaacattaactgtgccaaccacaagccagcgtgggcaacggctttaccttttgtatagtatggttcattgcggagcaccagactgagaagtggcggagataagcccacgggggtcgctggggagtccatgccttgttttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctagccagagtaaaactattcgaatagctgtgcccgcggttatgggcgggtctaacaatgtctttcgtgattagtttcacacttctcaccataataaaagatgctataactggtaataatttgtttagctcctggtttggaatggtatattcctggtttggagatagatctgtacagccgggtatggttgttcaggatggttgggcctgagcagcacgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaggagttctacagtgatgctgctggtgtggaggattaggtgtagccctggtcaagctgcctgtggagtggagtcgtctgcgccgtttatcttttttttttccgctgcttagatctttatgattgagaggaactatctacctctgtaatgacattttattcgcttattaattagagtaataattgtactctattatcaatttgttattgtgtgcctcggctgattcctggacgagggttcacacacatataagcgtttggaattttggatagaaattccgggcgtgacaccaaaccatgtgcaattcattatatgagaacgggacagatcgactctcactgcttgaattcaaaaaggcaatcagtatggatccacagcaagccctgatgtcctggaatgacagcaattacttttgcagttgggaaggtgtcttgtgcagggttaaaactccacatcgtgtcatttctctaaaccttacaaatcgaggtttagttgggcaaatatctcctgcacttggcaacatgacattcctgaaatttctctccctatccaccaattcattcacaggagagatccatttgtcccttggtcatctgcatcgtcttgaaaccctcgacttgagcaacaacacactacaaggagacatacctgactttacaaattgttccaacctcaagtctctttggctcagtcgcaaccacttagttggacaattcaacagtaatttctcccctcggcttcaagatttgattcttgcatctaataatattactgggaccatcccttcctctcttgccaatatcacatcgctacaacggcttagcatcatggataacaatattaatgggaacatcccacatgagtttgctgggtttcccatactacagatcctctatgctgatgggaataagttggcaggtaggtttccacgagccatcttgaacatttttactattgtgggtcttgcttttagttctaattatctaaatggagaaataccgtccaatctctttgattctctgcctgaaatgcaatggtttgaagtagactataacaacttctttcaaggaggtatcccaagttctttggcaaatgcttccaagctgaaggtttttgatatatcgaggaataacttcactggggttataccttgctctattggaaaacttaccaaagtttattggctaaatcttgaaaaaaatcaactccatgcacgcaacaagcaagactgggagttcatgagctgcttagcgaactgcaccggcttgacagatttctcagtatctgataactgtctagaaggccatgtaccaagttcattaggtaacctttctgttcagcttcaacaattccttttgggaggaaatcaattatcaggggttttcccttctggtttccaataccttcgcaacttgattagcatatcaatcgatagcaataatttttcaggagtccttccagaatggctcggcagtctacaaaatttgcaattaataggcttatataacaattactttacagggattataccttcatccctttcaaatttatctcaattaggatatctctatctacagtcaaatcagttttatgggcatctaccaccaagcttgggaaatcacaaaatgcttcaagaattgactattggatataaaaatattcagggtatgataccaaaggagatattcaaaattccatcattgcttcaaattgatttatctttcaacaacctagatggaagtatcccaaaagaagtaggtgatgccaagcaactcatgtatttgaggctttcgtctaataagctatctggggatattcctaactctttaggtaattctgaaagcatggaaataataatgttggatcggaatatatttagtggaagcatccccacttcattagacaacatactcagcctaaaagttctgaacttgtctcagaacaacttgtcaggatccataccaccatctcttggcaacctccaatttcttgagaagctagatctttcattcaaccatcttacagggctgcagga

SEQ ID NO: 25767 - DNA, 29850 bp, Oryza sativa
  unsure (1)..(29850): unsure at all n locations
tgatcttgccaaagcaacagaggggttttcaacatcacatttaattggaagaggaaggtatagttctgtgtatcaagggaaatttacggacgaaaaggtggttgcagtgaaagtgttcaacttagagacaatgggagcacaaaagagcttcatcatagaatgcaatgcactaagaaaattgcgacaccgcaatatagttcctatcctaactgcatgtgcgagcactagttccaatggaaatgattttaaagctctattgtatgaattcatgccacaaggggacttgaataaattacttcattcgaccggagctgaagaattcaacagggaaaatcacggtaaccggatcacacttgctcaaagattaagcatcattgtggatgtagctgatgcaattgagtacctccaccataacaaacaagaaactattgtccattgtgatctgaagcctagcaacattcttccggatgacgatatgatagctcatgttggggactttggccttgcaaggttcaaaattgacttcatgggatccaatgactccaactcaatttactcaactgcaataaagggaaccatttggatatgttgccccaggtaatgctcatttccatattgtgtttttgtttccctctaaattgtgaattgtttcagcatagtatcatttcgagtaaaccgttcccatccatggcggtccatagagtatgctgcaggtgctgaagtgtcgacctatggagatgtctttagctttggagttgttctactagaaatatttttacgaaagaaaccaaccgacgatatgttcaaggatggcctcgacattgtcaagtttgtcgaggtgaactttccagataggttaccgcagattgttgacccagaattactacaagaaacacatgtgggcacaaaagaaagagtcttgtgttgtttaaattcagtactaaacattggactcttctgcacaaagacatccccatatgagcgcatggacatgcgagaagtggctgcaaggcttagtaaaatcaaagaggtgtttctcagtggcaactaaggtatatggccttgttatctatatctccatgattgtttctcatattatatgtgcattgttctttccttagtaaaataacaattaagaaggaaaactgatgctgagcttacattgcagatatcccaaaatcttaagtctgtggactggaccctgtagactctgtacttgtcaatacatctttggcaactgggatgagtgcctgaagctacatcttttatgtctcgctatatatacaactagctctgtactccacgaagttgattacatgcattttatttccctttgtgatgatgaccacaaattattgtacttgattatatttactaaactacttcttccgtctcacaatgtaagactttcttctagcattgcccatattcgtttagatgttaatgaatctagacatatgcatgtgtttgatttattaacatctatatgtatgtgggcaatactagaaaatcttacattgtgaaacagagagagtatcattgtgaaatggagggagtataatttaacggatgtcatgacacatgatttatgtaatttccaccaccgaaataagttgagtaactcatttaagcatcttgtaagagaagtgactaaattacacccacctcgcaagttatagtcttgatgtgttttactgttttttttataaaacaaatcatagtggtagaaaacagagacttatttgctaatatcctaagcggccatgtttgtggggacctaataaaaaataggactacctattaatctttcgatagacttgagcttcaaatcttacagaattttcaaccaatggatatagcttattttgaaagaattaacaaaaagaaagggataaacatttcaaaaatcataaatttagagaaaaaaacatttgtaaaatctaattttggtgcattgtaatagagcgtaagtgcactataactaagttctgtaacttaatataactacaagttgcccagcgaaaaaaatataactacaagttagatctacataaacacaaatcttgatgcaagatcttacggacaagaagaaaaatcgaaagacaggagcccaaaaatctgtagcaaagtgaaatagcaaaaccgataaaaaaaaaagcattcttatatgggcatcagatagactgttcagctctgcggcgagccatcgaacggcggcggcggcaatagtgaggatgcgtattggagcgtgacggctggagcttgtgctagccgatgccacatccgccatgcgagccggagttttaggtctccatccaggatcggacgacgtacggctaccaatgcggcgacctagccatgcatggccggcggcggcgatgagcgacgattttctccgctttctctggcccatatctcacggaaaatatatcaatccggcggccgcggcctcgattgatcacatcgccggaaaccagcccgacctgctccttgtcggcgatctgtaacctcaccaacgccaccgcactgcagcaggcttctactcctgcattttcttcgaatcgacgacacctatcagccagactgggattacagcgctgaggtttttgttttctgaaactctgaaccattttgtcactctgaatcttcttcagaactcttactttgtgaattggtctcgcagaatatggtgatttgttaactacagtgaatcatttacaacttgagttcagcagctgtatatctttttaagattggattaggtagttgctcgatctgttctataagcttcagtgcgaagtgacaaaggacatcagactaaaatattcagtagtacatatatactaatgttacaattccatgtccttgatcagtgaaagtgtactgaatatcagatgttactaatatatactacactaattttacaattacatatgtatttgatcaaggaaagtactaaccttaatccaacacaacaaattccagggaagcagtagaaagacttgacgaagatggacaggataggtgggtgactatgtctttgatcagtgaaagtgtgctgaatatcgaatgttactaatatatactaattttacaattccatatgtatttgatcaatgaaagtgtgctgaatgttactactaaccttaatcctacacaacaaattccagggaagcagtaggaagaaatgacaaagatggataggataggtgggtgactgaaccttgcgcactctggtacatacaacactcattacagggaagcagagtgcatgggagtggagatagtgctaaagccatcgacgttcgtcttcacccacagccatgcgagtggagcacttgactgacaatcacgatgtgttaggcagtcctccgcacttcatgtcttcaactgcagattgtgcatcctttctgaagaaaactggcgcctgattggaatctttcgtgcagttgactgcaaatcaagtctttgcatgccaagattgtgctaattaaagccacggtatccttctgttataaaaggaagcagtcgaattgtcgatgaccatgagccccatgagacaggctagctgctcctctcgctggtaatctcagtcatgcatatcaatctttcatttaattcgtttctgttcatcattttgttgttgggatagattggtgtatgttggattgcatgcttttggggatttgtgtgtagaatacatctaattatattcacagcacattctgtctagaaaggtaatgcatatatatacagatgatttgagacattttggttccattttatctgaggtgatgatcagcaattactaaatactactagctctgtttttttaatatatgacgtctttgactttttgacaaacgtttgaccattcgccttaattaaattttttatacggatacaaaaaaaagttaagtcatgcttaaagaacatttgaaaataaatcaagtcataataaaataaacgataattgcataaatttttaaataagatgaatggtaaaacatatcttaaaacgtcaacggcgtcatatattaaaaaaacggagggaataatacttgagattttacagtgtgtgtcataaccacaaaccatattagtttgcatgtctagcatattattacagtgcaaagtacattcagctcattaattggcacctaggagctgagggtttcccataacaatactcccctatatgttgattatgaagttcgatgagcgagctgacctctaagagcaagttttataattgaggtggctaacacctctaattccatacatatcatctccgtataacttaaaaggtaacttatataataggtaacctataacacacaaacctcaataactctaaaagaaaatctaagaagtgctatagacaagcgtctcaatctaagaaatgtcattgataaatctaacttcctagaaataccatcatatgagtgcctttgtcccaaaaatgtcatcgccattagattttcattagcagcccttcatgaaatgctataaaaagattattttaccatacgaattgttgaaagccgatgaaaacttccgccttttccgtcagtttacactaatttgtaggctgctctttacactaaattattgtaagttaacgaatgggagaatagctactttagtccctaaagtttctctgtaggatcagtttagtccctaaccttttaaatggtccaaagaaatccttaacctttgtcataaggcctataatagtccttgggtccaccaaaatcatcatatggatatgccatgtcatcattcatgcaaatctataatgaattgtccaatatacccttacgtatatcatagaaaaataaatataagggtgaattagacataaccataggaaaaaaatacctcttttttcacccttttgaggtatatttttgctcttacatgtaccatatatatttttttaacttttttcttttgttttttatttacctatgcataggaaggtgacatggcatgtccatgtggcgattttggtgggaccaaggactatattagcccacataacaaatttaaaggacttgtttagacaatatgaaagattaaggactaaaatgatccaggagcgaaactttagggactatattagctattctctcttaacgaaaagagcaaaagttttaatcgtaggggtaaaatggtctttttaaaccacttagcggatggctgctaatgctacctaaaggcgatagcatttcttggacaaaaacacttatagatggcatttctaggaagttggattggtcgatggtatttattggattggggcacttgttgatggtatttcttagattttctcaaactctaatactcccatatttgtatagtttgtataggggttgccccttatatgagggatggttccttccctctctcctttctccccacctcatcaaataagtctacaagacatcttaggagatttatagtacttgctctaaggtattggctcttactacttgggttcgagattttctagaggatgatgagttgttccatttcctgtagtatccctgtttggggatgtcagtcatttagaaccgaacagagacccttggatcgatgcctatatttgctctagttgcttactactccctccgtttcacaatgtaagtcattctagcatttttcacattcatattgatgctaatgaatctagacatatatatctatctagattcattagcattaatatgaatgtgggaaatactaaaacgacttacattgtgaaacggaggaagtagaaatctagaataaggaaagggtcttgcagaaggagagataagacagagggatgaaaaccaaatataaattgagtagcaatttcacaactcatcatcataataccagataatgtaacgattgtcacccatttcactgcaggattttgaagaaaatttgcatatctgaattgcacggcttttagaggactagagttacattatttcacatgcagtggcataaatcattggttttttctcaaatcttattgatctagaagagagagcgtgcgttcacttcaggaagtaaccattgaaatccctcaggtacttcgcatgtcaacaaataaatatttgccataacaccagtttgcaatttaagtttcgtgccttacttgtatcttaaccatgtcatcaggcacttcgtttgctagccatgaagtttattgaacccgggaaatttctcttggtgttcttggtttgcagtgcacatgttgtcatctgctcctctaatggaaatgaaacagatcggttatcactgcttgaattcaagaatggtatcactcttgatccacagcaagccctgatgtcctggaatggcagctaccatgtctgcagttgggaaggtgtcaagtgcagggtgaaggctccacatcgtgtcatttatctcaaccatagtggtcaaggcttagtagggacaatatctccttctcttggaaacctaacattcctaagatatataagtctccaagaaaatttactagctggacaaatccccctgtcacttggtcatatgcatcacctcaaagttctctacttgagtaataatacactccaaggagagatacctgactttgcaaattgttctaatctctgggcgttattgctgaatggaaatcacctagtggggaaagtacctacagatgcccgtttgccgcctaacctttattttctctggattgtacataataatctgactggaaccattcccacctctctatttaacattacgacattaactaaactttctataggatttaatcaaatcaatggtgaggttcccaaagaaattggaaaatcacgcgttctgcaactatttgctgcttctggaaataagcttttaggaagatttcaacaaaccatccttaatatctcttcccttgctgatctagatcttgggtccaattatctacatggagagttgccatccagtcttggtagttcactgtccaatctacaggggttggctttgggcaacaacttcttcggtgggcatatcccaagttccttggcaaatgcttctaagctatccatgattcatctgtcaagaaataatttcatagggatggtgcctagttccattggcaaacttcaggaactctccgtgttgaaccttgaatttaatcaactacaatcaagtgataagcaaggcttggagttcatgaatagtctcagcaattgcaccaaactacgagcattatcacttgcaaaaaatcaactagaaggagagataccaagttcattcggcaacctttctatgaagcttgaactcttataccttggaggcaataaactatcagggcgttttcctgcaggcattgcaaatcttcacagcctgtcaggtctagcactgaattcaaatcgttttacaggtccagttccagattggctaggaaatcttaaaaatttgcaaataatattcctagcggcaaacatgtttacaggatttattccatcatccctctcaaatttatctctactagaaaatgttgtcttggactctaaccagttctatggccatataccccgaggtttggaaagcctcaaagtactacaagtactgagcattccaaacaacaatcttcatggtagcatcccaagagagctcttcagcattcctacaataagggagatttggctatattccaatagattggatggacctcttcctattgaaataggaaatgctaaacaattagaacatcttgtgctttcatcaaataacctatccggtgttattcctgacacacttggtaattgtgagagtattgaagagatcgagttggatcagaattttctcagtgggagcattcctacatcatttggcaacatggaaagcttgcaagtgctcaatatgtctcataacctcttgtcaggatcaataccaaagtctattggtagcttgaagtatcttgaacaactagatctgtcattcaacaatctcgagggtgaagtaccagaaataggtatattcaacaacacaacggccatatggattgctggaaataggggtctttgtggtggggcaacaaagctacacctacctgtgtgcacttatagacctccaagttcaactaaacacttgcgatccgtagtactgaaagttgtgatccccttagcttgcatagtgtcacttgctacgggaatatctgtcttgttgttttggaggaaaaaacatgagagaaaatctatgtctctcccttcattcggtagaaattttcctaaagtttcattcgacgatctttccagagcgacggatgggttctccatatccaatttaattgccaggggaagatacagttctgtgtacaaagggagattgttgcaatatggagatatggttgctgtgaaagttttcagcctacaaactagaggggcacaaaaaagcttcattgcagaatgcaaaactttaagaaatgtgcgacaccgaaatcttgttcccatcctaactgcatgctcaagtattgattctcaagggaatgatttcaaagctctagtatatcaattcatgtcacaaggtgacttgcatatgatgctatactcaaatcaggatgatgaaaacggttcagcttccatccatattgcatttgctcaaaggttaagcattgtagtggatgttgcagatgcaatggagtacgtccaccataacaaccaaggaactattgttcattgtgatctcaagcctagcaacattcttttagatgacagcctaacagcacatgttggagactttggccttgcaaggtttaaagttgattgcactatatcatcttccggtgactcaattatttcaagtgcaattaatggaactattggatatgttgctccaggtaaatcctatttttcatggtacactatgtttcgttgggagtgttctcttcctattttaatgtttggacttaactattctcatgtgctatatgctctatgcagagtatgcaacaggtggtgaagtttcaaccttcggagatgtttatagctttggaatagttctcttcgaaatatttttacgaaagagaccaacacacgatatgttcaaggatggtctgaacattgcaacatttgtcgatatgaactttcctgacaggatatcagaagttgttgaccaagaattgttagaataccagaatggtctatcccatgacactcttgtggacatgaaggaaaaagaaatggagtgtctacgttctgtgttaaacattggactttgctgcacaaagccatccccctatgagcgcatggacatgcgagaagtggctgcaaggctgcgtaaaattaaggaggcctacctcagcagcaactaaggtaattaacctaattcaatgatatgcactcgctgtacatatttccaaggtagtttatcataatgtgtgtttgtattatccttttcttagctagtaaaatgcatgtgtaaataaacatagggctgatgctaagcttacattgcagataccctgaaatcatcagcagcatgtggaccctcagaccctgtatactctgtattctacacaatattggcaactgcgatgattggacggaacctacctcatgtgtcttgcattttccattgggtgttaatatggcactataagcttttttttatggcaatgtaacatacattttaccagtatacatttacgttgcagtatttctctttgtgtattgaggagagatataaaagaaatcacctttctgcttctgctttcttgttacgaaccagagatgagatctgaacaatagaggtagagcagaggaaacaggggagacagaacagagttggtagctttaggaggaaggattgtttggttatttcatattcgatgctttctctcctattacacgagtgcttatatggatgcactggttacagctgtcgagccaacccattcaggcccagagatccgaacattcgcctgtctcacacgcttaggacgcgcctgatgacgaaccgggtttgaagacgtagtcgttgtcggatcacaaacagtagccgtaacatttctggatgggtgtatcgtgaaagtctggatggatatcaatgatagtggtacataataccataaagaggacttgactgataacattatgaacattccagtaaaacaaaaatattgggtcattgctaatctgaaacgcttaggccttgtttggctaaggggttattagagaaatgatttcccatccaccaaaagatatctttaaatcctaactgttcattctccctcttccattttatcctaacccttcacttattttcttatcccaatcccactttcttattacattatccaaacaaacccttagtataatactacctccatattttaatgtatgacgccgttggctttttatccaacgtttgaccattcatcttattcaaaaaatttatacaattatcatttattttattgtgactcgattcatcatcaaatgttctttaagcatttatcatgatataaatactttcatatttgcatgaaaattttgaataaaacgaatggtcaaacgtttgtcgaaaagtcaacggcgtcatacattaaaatacggagggagtagatagtaggaacttgtttttgtaagatgttcgggctgccctcattagttgttgtacgaaatacaaacagggtgccccatatgaagagtctttaggctttacatgggccatgatgggccacagaatcgtcatcgtgagattccatctctgcagcaaagccagcgggaggcaacagcggcgaggcagacgcgaaggtttgagggatctgctggccaatgcgacccacatcctgagattgcatggctccgtccaggaatggaccacggctgggctaccagagtaccagtgcagccacgaccttgggatgttgccggccatcgagacgacgtccacctggtcctcttcctcgtcagtgatgtcagcttcgccgacatgtggctgacctccacctccgccgaattgatacccatcgaggaaacatatatcaactgtgctgggattggattactgctgaggtttgtctgtttaatttgatcattaatccatataaacttggtagcacacggatcggacaaaatcaggcgatataaactggctttgggctttacatggggctgtgatgcagtcgagccgtgcggcgatcggcggcggatggtttcagcgctccagccaggaacggacctcccggaggcgatgagcagcgctccacgccctccggatcaggtgaatcctactctcatgatataatgtttcccttttaagttgggagcgttttcttcctattttaatgtgttgacttaactactctcgtgtgctatgctctgtacagggtatgcagtaggtggtgacatgtcaacctacggagatgtttatagctttggaataattctctttgaaatatttttacgaaagagaccaacagatgatatgttcaaggatggtctgaacattgcaacttttgttgagatgaactttccggataggatattgttgggacaaaatccaacaagcatatatgtgtatcacttatgtattcaatatgcccagctgtgagcaatgtttacatatttatacaaggatgtacaaggggaaattatatcgctaccctaatcgctgatctatctaggcggctggctggtgggccagctttagggctctttggtaagctcctcggtgacaggagggctgcgcccattaagggagcgccgccgattcccaagggcgcctgctattacccgggtaaagacgtgctccgggtaatagcgtgcgctgtctgccctcgttagcggcatcagaggtggttggcagatgcgtagtgcgaatttatagcgtcccactacgcatctgatcacccatcttacgcccaaggctctcgaagctctagcttcctctggagccctcaaacagctccggagaacctagaaggctttggagtccttggatggctccggagcccacgggcaactacgggacaaacctacaaagggattttgcactctcgcagcgaaggcagacgatttacaatgcaaatcaataaagatggacgaactaggctagaactatgtgcaatattgaaaaagtgattcaattggctaaattagattgtgtgtagattcttcttccaattgaactagccttgtcccttatataaggatataagggttggtcttgcctcctgcagatcatcctccacgcctaactcaggataaaaaccaatggaaacccgaaacataccctcctgagtaaggagtcctgacacccaatgaaaatatagactcggtatcggactctaccggtctgaccacgcgcacaagtagtggtctgaccggccaacatatggcggtcagaccggccttgtgagggaaaccagcactcttccaaattttggtaatattttcctaatttaaacctaggtgccaaatttaggtgtaaacaagtcccaccttaatttctctcccctatccacacacattgtgttatattatatggttacaactactatggcttgataaagggtctaaacactgtttcccacttcagttgaataaattgctattctcgaatagcatgagtggtttagtgctaaaaataattttgtacaagtactgagttgttatatttagaattaagtttgaattatgttttagggctaagggagtagacgaaaaccaaaggctttcaattttttttttattgtagatccacggggttagaccggagggcacttgtacataactgcatatctgtgacggtctatcccgtgtttggtcttgcgcaccatcacaccgtcatcatctttaatggatcgaaataaacaccgatacaaatatacttgttcatacatatttcatgagcatatattacgagctcgtcaccgataagacctattggtgacggacttatgtttcggcacaaagtttatctttgtcgggtccaaacctaaccacgtggtgcatgcaataaccgtgtgcccctgtggcctgtgcagtgtgcatctatcagcagcgcatgtgttcagcattaatttgttcgacgatcaattctcgaccccaatctcctacagtatcaagcttgatgcatgcttattgacttgactcaagactcttcagatggtcgatatttagctaattaatgagtgacgatcgcgatcaatcctaggaaaggaaatggcactccgaggtacaattgattttaaaaaatcacatatacgtaacaacgataatatttacattatcataaacacacataggatatgacaactaaaaataaaacaacaacagactaacagggatactatcttgataggcaggggcggatccagcatgggtgctgggactcaagtcccctctatcccgctggatcaccattgatagaagaggagatgaaaggggaagaatatggagaaaatgaagggtagggggactcaagaagaaattaggagatgagtcccctcttaaatcttgttctagatccgcccctaatgataggcactaatatgggatatgaaccaagactccacttaaaacttctccaaaaatactctcgctgtaaagaaaaattgaacaagaataagtaccatccacaatactcagcaaacaacatcgaaaaaaatattctctccattttaaaatataagacacaaccaacctttaacccaaagaccaagaaataattattatcacctcatagtttggattaccctgataaatagaatacatgcacccaataaaattagagatcttcatggtggatgatttaaataataatattttagtgaaaaaaaagtggtagttaatgatatgcatgcatgctcaccttatattataaaacaactttaaaaagtagttatgccttatattatgaaatggagggagtatatgaataatgcaagggtataaggaattgtattatagggatgttttgcagtaaataagcattttaaagcagttgattatttaaacattttaaaacaaccatactatttttttcttttaaccagaaaacagtacgggagccccactatatactaattataagcaattacagggtttatgtacacaaggaagattacatagcgtccatccacggaaaacattgctaatttgctgccttcactactgcgaaactgatctttgctaggtcgacccaaaaccacaatagtcccggtttcaaaaagaatcgggcctaaagatcatctttagtcccagtttaaaaccccacagccattctatgacctttagtcctgattggtaacaccaaccatctttagtcccggttcatcccaagtcagtggcctgtcagggggctgaggatctttagtccaggttagtgtcacaaaccaggactaaatatcaccactttagtcccggttggtattaccaaccggaaaaaattaaacgcgtagtatataatccctctctctctctcttatcctctcctctacaaccggcctctcctctcctcagatcgatcccttcctcctctcctcccctcccctctcctcctcccccctcctccccttcctcctcccatccccggccctctcctccccctcctcccttgccatccggcggctggcggggttgcgctcggcgggcaggcgaccggcagtcggcggggccgcacacatggcgagtggcgagcggcggcaggcggcagccgctaccagcatcctttctctttttttttcaatttgtgattcactgagatatataattttgtgattcgttgcatggatctgagatgtataatctgtgatgtatttgatttgtgatatatttgatttgtgtgtataagtaacttaagatctgtgatgtgaatgttttgtgatgttactttgatttgggatttggggatatgcatcccactcgatttgggagaaaatacaggattaaactatggctagagaaacaatgaaaaaaaaagaaaaggagacctacgcactggtactgccgctgccctctctttagtctcggttggtgttaccaaccggaactaaagataccttctctctagtcgcggttggtaacatcaaccggaactaaagaggcatcttaagtcccggttgaaaaaccggaactaaagggggttaccaataagaagtataaacggtttctccacccgtgctttgagcagttactaatgtggttcagtgagatatttatgtatgtatgatgattgtttgttcgcctgtgtatattaagaaaccgccagagtaaatgtaattttgtcgcatattaatccggtgatatacattctaaacaagggagacatcctgtgcatatttttccggtgatttgtccactgaataacggaataattcagcggattaccaagtgtacgatcgaagtcgcgagctgggctacgaacgaaacgtattgggtcaaaaatggacctacaatagtagtcggactccgccgtcggactcgaggccaccattaccgctgctaactaacggctcgtttggcagaggtttaaattctaaatttaactttagaagaagttagatttgaagtgaagttgtatagcaacctaaattcaaactccacctttttagtttattttatgatagcgctccacccaatttcgctcctattttagataaaactaaaactatttagctagatttgagctccagaagagatggagtaggagttagagtcgtgccaaacataccataactttaggtcttgatgccatcgactccaatatatttgctgtaaaattggtgatttaagttagtaattggctgatttgctgttggctagtaattgttgctgctaaagtattatttgtagtgtttggtgctatacggctatgtattgctgttgatggttaaatggttaatcttggttggcttgttgctgcatgtttaatgtgtgttactacttgctccctccgtcctataatatactggctctgtttgaccacttgtcttattcaaaaattttgtgcaaatataaaaaacgaaaagttatgtttaaagtactttggataataaagtaaataaaaaaataataattctaatttttttaataagacgagtggtcaatcggtgtaaacaaaaatttaaaatcccttgtattataggacggagggagtactagtgtattccttatgtaaaatcaaatgtgtttttgattattattctgtgataaacaattggcatcggagattattggttttgttatttggaatttattttcgaagtggttttggagatgattggatttcacaggtgaatctacatgtactgctgtcatttatgtgtccggtcagaccgggcagtggttgccggtcagaccggcgtgtatagggcggtcagaccagcgcagcccacggtctgactgaccgacgctgtgtcggtttcggtttcgggtcatttgtttggatatccgtgattgtttcatgattatggcttctagatggatactatacgtatgttgatactgttgtttgctactaatgagtcaagttggagatagtttggtctcggaatatggtttctttgtttatttcatgtgtaggtgactcgatgcctcgggagagtatttgcggtgatggaccgggagtcggcttggggataagacgacgtctgtggtggtcagagatcatgcgggatacttaggctagagttgatgcacgtggttgatggagatttcatatggcatacgatggaggtattgtgtgtgtatgggatgcggagccgaatttggaaggagtccaaatttgttatgattggttatgtaaagtttgtttcttgtactagagggtttcctaaggtgtttaaaatttttagtataagtttggttcgtggctttaggctgtctatctcgggtataaatagagggagagcgtgaggcttccctgtatcgcttttgagagcaattgagttgagtttttcaattagggtttcgagtttagtcgaaatttttgtaaggaatgctgttggtgcactttgtaaacacagagagaagtaataaagtcgtcatccactttaagagttcttcgatttgtgtttcaccgggtttcgatggtctaaccggcggtcagaccggcggcaagcggcggtcagaccagcggcagcgacaggcgcagcaggcgacttcggcggtcggacctgttgatctataccggtcaggccagcggcattcgagcggtcagaccggcagatcaatctcggtcagaccgatctccatcgatttcgagggtaacttttatttccgccaaaagttttcagtttttgggtataccacccattcatcctccctctaattggcttagttattgtgatttaatccttcaccttactgctgcctccttctccctttgaggtttaatttcgggtatgggcacctggcgaatgcctcgtacccgtatgaggacggccggagacgggaaaacccctccccgtgtgcggggatgaggatgggaacgacagaaatttctcagtccggtgatggggatgtgaatccgacggatacccgatgcccaactcgcagaaaagattagtagtaattgatttgatttgaattgacaagaacgctaccgttgggcgttggccattaattagcaaactggtgacaagaacctgctgacagcctgccttggtgccatttgccaactagcatgagctgcccctgcactgcacggtgcacatcgacgcagcggggccgctattttctctttttatttttataaacatgtttcctggttgttaaacactccctccatcctatattagtggtcgctttcagttttttatttataaaatttgattattcgtcttatttaaaatttttttagaattatcatttattttgtttgtgatttgttttattatcaaaagtactttaagtatgacttatcatttttttatatttgctctaattttttaaataaaatgaatggtcaaacgttacaaacaaaaagtcaaagcgataagtaacgtgggacggaggtagtagattgtaagatattttgactttgatcaaaatcaaactattttaagcttgactaagtttgtaaaaaaaataataacatttttagcccatgacaaatttattatgaaaatatattcaattatcaatttaatgaaactaatttggtattataaatattactatatttacctataaacttagttaaatttgaaatagtttgacattgaccaaagtaaaaacgtcttataacctggaacaaggaagtagtatgtttggtaaaaaaattttctatagagaactatttaaaataaatccatttcgtaatattataataattaatacttgattaattatatgctaatgaattatctcgtgttatctgtaaaaaaaacttttagacaactaaaccgatctgaacttatccggctttgtgctgttcctgttaaggttcctttggaactcgctattcatctactttctctgttttatattataagtcattttaatttttctaatatttcttaacattaaataaatatattattaaaatatatttaatgttatattaattaaactatgttggtattatagacgttactaaattttcatactctctctattacataatataagggattttctgtcacatccatacaaaatcccttatattatgggatggagggagtataaattattaggcatatcttgaaaagtttgattaaaataagtcaaacggcttaatataaaacgagggtaggattttagttgatacatgaagctagacaaatcattaacggtacgagtaataaagtactaataattattacgaacacataaaatatatttattttatattttaaagaaaattctatatagaaatttttacataaaacataccactataataccatttagtagtttatgaatactcgcatagaagtttctttctccatttcaaaaatataagacatagaccacctttaacctaaataaaaaaataattattatcatcttctagtttaaattaccctaataaatactctatccgttaagtcattttgagtttggtcaaagtcaaactattacaagtttaattaagtttgtagaagataataataatatttttaactcaacacaaatttactatgtaaatatattcaattattgatttaatgaaactaatttagtattataaatattactatatttatctataaacttaattaaatttgaagtagtttgactttaattttaactaaagttaaaacgagttataaccttaaacggatggagtataatacatgcatctaattattagagatatttagtgtgatagatcttaaaaaaaggaataatttagtgggggcggagggagtatacatgcttgcaaatatgtatactcaaaatcctataatataagggattttaagtttttatttgtaacgtttgaccactcatcttatttaattttttttttgaaattattatttattttatttgtgacttgctttattatccacggtatccacggtactttaagtataacttttcgttttttatatttgcaaaaatcattgtaagtagggagtactaaatagccgtacttaatagctggtcagtctttagcgtgacttcggcgtcaaccatgtcactgcaccttgagcactgtgtagtgtgtactatgcatgctgacaacatgcacagacatgttggtcttctcgccaaccgaaagtgtaaccgattgcacgaacctgcatgactttgggtgctttgagtaatgtgcatgcactttgaggcctctttatttaaaggaaattcatataaattttaaaaaaatttattcctaatgaaatttttcctatatagccctttgaatcaaaggaatggatcttatggaatcctatgaaattcctatggattgcctaatgccatgcaagttttggaggaattttaacatgaggtaaaacctcttggaaactttcctttgagtctttatctctcctctaattcctgcgtttttcctgtggtccaatcaaacgatcgttcctgtgtttttcctgtgttttgcaatcctctgttttacacttacattcctatcaaaatcctgcgttttttctattcctatgttttctcattcctgcgattcaaaggggccctgactatgtcaatggccataaaccacacgtttatgattacgttagatacgcaacctaaccaatataaggatgttagatggtatattttttttaaaaaaagtatatatataagttatttaaaaaattaaataaatcaatttctcagttatataatagtaaataattaattaatcatgtgttaataagttttctcgtttcacatgtcctcgaaggttatgttgtttctccgcctttcccaactcacctatctctttttccatgcacactcttttcatactactaaatgatgtgtttttttcaaaaaaaattatatataaaagttactttaaaaattcatattaataatgcactaatgagccactccgtttacgtgtcgaagagcttactccctccgtcctaaaaaacgaatctagtactggatgcgacacattccagtataacaaatctgacacattctggtatgtctaaatttgtaatagtaggatgtatcacatccagtggttggttttttatgggatggagggagcagttaccaaccatcctgaaggaacacagccatttaatgtctttctatttggaaggaacaaatgtactccctccgtctaaaaaaaggcacacctaggtttccgtgtccaacgtttgaccgtccgtcttatttgaaaaaattatgaaaaaaattaaaaagacaagtcacgcataaagtattaatcatgttttatcatccaacaacaagaaattactaatataaaaaatttttatataagacggacagttaaacgttggacacggaaactcaatatttgtctttttttttgggacggagggagtatagccagtcaattacgtgcgtgcatgtcttgtactaatattttatactgaaagtgtgaccatggctagatgcttagtaaaatacaaaatattctttggattttcttcatgcccgtaaaaataaaaagggttaatttcatccatgccactgtaaatgttacaaatcaaaaatatgccactactattcacgttatctgcttggtgccactgtgaatttctaaaattggaaccatgccactccatcactcttttcgtcctcatgtctcccccccccccccccccgcatctcccctgccgtgccccgtttgccgcagcatggcccggcatcggtgtcctccgtggcagcgccgttccccgacctgatgcggtacgcgcggagttgcagctagcgcggcgctggcgcagatcctggacttcgcggcgcagcgactcgtcggggtctcgctggcgatgccgtgcccgctgtcgacgatgacacgatgtcatcaccgagcgcgtagcctcacgtcgtcacggagagaggatggggaggacaaaaagagtgacagagtggcatagttccaattttataaatttataatggtactcaacagataatgtaaatagtggtggtatatttttaatttgccgcagtggcatggatcaaattaacctaaataaaaagggtgtgcatctctataggtggcagtcgtaaattgcaatgacactaataagacacatcattagtgatgggtgcatgttgggaaatccagcatctatgtgaagttttcaggtgactagtcgacaacggctaggtaggttattacatatattatacttgtatgattttgatgaataagagtaataccagctttagccaacatgagtaggtttattaccttctaatgaagaggcggaaccttttgttaccttctaatgaagaggcggaacctatataaaaatccttgtttccatctttttatacaattttgcatatacccatactatgcaaataccgtagttgtgatctaaaacatcgacaaagctgctaatcaagtctctttaacacagggatactctgcgggtcaagacagaacattagtagactgttgtgaccactcactggaataacacaggaaaatctcacctggaaaaaaactgtctacaaattaatataaatatgtttcaatgcatttgtgacccattgttgtgaattcttattttccaataaatacttcacctttttcacgatactttgatatggattgttttctaaagcatgttttgtgcatggactatggttggaggctttatcagtcagctaataatctaggtcgtactccttctaaaaaatgaaccaggattggatgtaacatttcctagtataatgaatataatgaatctggacataagtatgtcctgatttgtagtactagaatatatcacatttaatactaaattatttttttatgggacagagggagcagggtattattgaaatgattcccattgcaacgtacggacagctaactagtaactaaaaattggaataataatataatgaactagctagctagtacgtagagtagttcataatgttacctgggttagtggcggagcatgcctaaaaaattttaggtgggttatacatggggtggtagttagtagcattcctacactaatcctagctagccgatgcaaggtatactgggtagcatgtgtatttttagttgttttatgatagtatattaattacaatattgcttgataattagattattagtatgtaccaaaacctacgtaatttttgttaaaggtttgttactggcagcagtcggcagtggcgatagatgaagctagtgctagggttaaattcctcactgcattggtgagtgcctcggtggttatgtgtgttcgtcgagctattcaagtttggatcgcttgagatggttaccgcagcgggtcaccaacggcatcgcacgaaaaaatcaagttatctaacgtaattaatgtgttgttcatcaggaattaggagacgtgctagttttgtctgacgattaaattgtaatgaacaaaataaagccttctcgttctgatcagatattggagtagtgtgtagcagtagcataaaagcgactttgaaatgtaattagcaatagttttagcaagtgattgaaaataactcatgggagctgtcgagctgatgagatgtcatgcactaagtagcagtaactgagagaaaatcattgagattaggtgccactgatgggatttccttaactaccaagcaacaaaccggaaaaaatcgaccactcggttatctttctggtaggcaagcagagtggtcgattttgtaatcgggattggatcgggcacggatattatcggatacgaatagaagcatggataatatcgagtataaatatggaacgaatatataccaagacgggtaagatctagatacccgaatatgacttgaaataatgtggccggacgggcggtagggtcctggcagcaggtaagctggccatcagatggcccaccatgccgtatggggcccatcgcctctaatcaaggtgaaaaaaggatactccctccgtttgaggttataagatattttgatgttggtcaaagtcaagattttttaagtttaattaaatttgtagaaaattatagtaatttttttaacgcaagttaaatttattatgaaaatatattttattattgattcgatgaaactaatttagtattaaaaatattactatatttgtctataaacttagtcaaacttgaagtcaaacttgaaatagttctgactttaaataaagtcaaaacgttttataacctaaaacggaggaagtacgaagtatacaaagtagtactattcatcaataccatgaatctggtcaacagaatataattcaactacgtgcgtcgcccctataaattaagtgcgtgcgtttactgatggctgcatattagtttgtgtgtgcgctaagtaatcgcccagttaggcggtcatctctggtgcttgttgcgcggcctcttccgtccacgcaatatctgcggttgttgctggatccgccggtgcttgcaaatattttgcaaatttctgctgacctgtaagcacacatctcatcgactccctaatttcttttggttctgttcaggctttgccaattccatacctcccgttcatatgaaatgcaccttgatcccaaaagaataattcaccagccgtttataagaaaaacctattatccttttaaagtaataaaaaaaaggagcccccacgttctctctcatgacttagaaattctgatattaatcggagaaaaagaaaattagaatccataagaaataaaatttaaaaataataaaaatttagaattaaaaatagggaatataagaagaggagactagagcccatacaagtatacaatttagaactaattgaaactcgaaattaaaaaataagaaaagtaaaacctagaagtcagagtccctatagaaatataatttaaaaataactaaaattggaattagaaaatacgaaatatcagaacaagatttcatagctcatacagaataatttagaaaaaaagacttaaattcaagattaaaaaataaagaatattaaaagatgagtttagagtccatatataaatacaattagaaacaacagaaattcagaattaaaaaatagaaatattgaaagaagagtccagagtccatataggaatctagaacaatttgaaagtcaaattgagaaaaaaaataaaaatagagcttagagtccatagagaaatacaatttagaaataactaaaattcaaaattaaaaaaaataatattgggagaagaatctagaatccatataagaatataatttagactctaagaatataatttattttataattttaaaaataaggaatagtggaaaaaacttagagtccatataggaatacaatgataacagaaatttggaactgaagaataagaatattgaaagaagaatatagagttcatataggaatttagatcagttgaaagtcagaattaaaaaatttgaaaaattaaaggtagaatttagagtctatataaaaatacaatttataagtaactaaaattcaaaatttaaaaactaactaagattgggagaagagtttagagtacatatagaaatacaatttagaaataagtaaattcgaaattagaaaataattaataactatcaatacaatacaaaattcaaaattgtgttgttatttgtaatatattttgataataaaatatgctatattatatgagaaaaaataacgatgttacatgctagttctttagaatggctactgtagaggcgtatggataacagtaaataaccaaattaaagaatacatcagtattttcttaacaatgtacagatataaaagaaaaagagaggaccctcagtaaattttcctccctccacattctagcaaaaactcaggaaacaaaaaaaaacagaaagaaaaccactccgatctctcgtttcgcgaagggacgaggcaaatgcgtcgtcattagcattgatgtcaagcatcatccacacacactggtgaagcaatcaagaagcgagacatgcagcctccgtacgagctcaaccttgtatatggctcgagctcgcgccgccgcagcgagttcgtccagtacgccggccgccgccgctagaccttgagcagttcagctccggtgatccggcccggctgcggcgcctcccaagctcgagacgttgaagccagcgtcgatgctggatcccacacccggccgcgccgcctctcccaagctccgatccgatattcagacgtcgatcggtgttcggagaccgcgccgcggccgtgggagattccatttccattggagggcgtgtcacgtgtgagagatagggggagatccgggttaaggttaagatgagatacactacataatttttttcccaaatgatcaaaatctacttttacatgcaattgagccacagtcagatcaaaagtgtctgcgaaaatcgctacttttttatatggatggcgcacccgtacacgaaaatctaattttcgcttgcggatgcttatatcatcctcactcaaaaataaaaatcctaaaaaaaatcaaaaccgtagctaggtgcggtccgccgccgccaccagatccacgcacgggtggcctcgccgccatcgccctcgccttctctgccaagtgggggaggaatgttcccctgcgcgtcgatggtgggggcggccgcgcgaccgccgccggtcgtgctcctcccgctactgtcgctgcccgttgcacgaggtcgctgctgcctgccaccgctcaagcccacccaccgccactggctagctagtcagctgtcagcacggctctcaggagggaagtcgagtgagagagagagagagagaggagagaaggtgagaaatgagatagagaggagtaatatgatgaagagaggggatgaatgaataatgataacttgaaaagaaaatttagtgctaagagggaaagaggatgtaagttagacttttagatggaccttgaagagcctcgcccgcgaaaatacatttgccgcataggaaaataggcttattttcgcatacagctccataagagattcgtttgtgaaaatagatttttttgcatgcaggcctttaaaagagtcgtatacgaaaatggaagtctatttttacagacgctaccagctatggtccccctaaaacctatatgggttctcgtacataaaaatcgttttatttagtagtgttaaataaatataatcacttacacttatagttttatatgttttatttttccgatatttatattcttgtgttttgattctagtgaacaggttagaaacgcatcgaaacaaatgatcgaatcatatacttttccacgaaaatcttataaaataaacaaccgtataaagtttttaaagaaaaataagcacaaggttatacctcatgttttctctttccaattactccaaattccctttgtttatactatgggtcaatcctacgatagtttttaatattcttcaacgtagaaattcaatattaatgcatgggcatgacatttaatttttacgttttatgtgtttttccaattccgtcggtggatttggatatcatctacttcctctgtttcacaatgtaagtcattctaacatttctcatattcatatatatgtctagattcattaacattaatatgaatgtaggaaatgtgttagaatgactgatttattaacatcaatataaatgtggaaaatgttagaatgacttacattgtgaaacagagggagtagcttcatatagcaagtcactataccacggattctttttctttgttatatatagaaaacgcacaatgtaatcacaagcaccacactcatatccttgcatcttttaacacatgcttcaaaaggcaggagtctaagcataattaacacacgatatttcacttcacgtcatgtagcctccttaccaagtcacatataaagcacttcgtgaccgtgggatggatgacattcttttgacttaatctctctaggacttataacacatttggtattacaaataatatcaaatggaaaaaaaatcatcaactacaccccgtcgagctgtacaacttaaatatagagaattatcatggttagggataagtcataacttttatcctatgactcacgggatatacggatatggcacaccttcgtatgtacgacaatattccgtatataaaaaggaaatcgacaagagactatggaaataatcgcgcgggtaggcacataacagagtcctgctcggagaggtttaggattttaccatatagtgcaaggtctgaggtctccgagttctacttggagatcaaggtgatccattgtataaatacataccccctaaggggtccaaggtatcgaatcatatcactagccaacccgtcaccacataagcaatctgtaggacttgaagcctactcgcttagagatctcatcgagactatctcgtaaaggatctcgtcggtaatctcgggatcagttgttcttcattgtactctgcggttttctatattaatctcatataaactggattaggttgttacgttacgagtggactgaactagtataacccttgttttcttgtttgcttgatatcatatcgtgtagatcctcgtaccaacttatcccaatacccacattatccggtctacgggtattgtcacaccccaatccggcaccgccgtacaacggcacctgataggagcgtgtcgtaggaaaaacggcgtgaaccgcttcctacgaaaccgcgatctcagtaccagtcccaggacatagcgctggtacccacggtgacaaatacgaatcattgcaatccttaaaataattagaggacttatttaccttaacttaggttgccgctcgggacagcccgagattacaaccgacgacacggacgaggcaacaccaacaacggcagcagcagcggaaacaacggactaacccccaacaccacaggcaacggctgggaactaggacgaaaccctaatcttcacttcacttcaacttcatcttcagagctggcagaactatatttatatagagagcaagggtgagtacttacgtactcagcaagccaggggaacttaggtggttaatgcaagtttcaaagaataggctgttatttttcaatcggttttgttttcaaggttttcaacaatctaagtgtgtgctttccacaaccagagcgagacaagtctcagctcagtcggggtgagaagtaacaaatttatttatcaagatttgcacaactcccagagttggcctcaaagctggttttcccaaaccaaaccatttttccaaacttcccaataatagtggtccccaaacgaccaatcacttccagggacttccggtcccgctgtcccccggacagctaattgcttcccaagcattaggtttcccaaaccttaacaccttttcataaaacagggtaaaacaaaaactacgctaaggaatcacctcacatccacccatgcccgtgggcacggctgttcgaacagtttaataacctctgcagagggggtacactttacccacacgacgttactagccttggtcacctagcccatgcagaacagccacgtctggtgactttggggctttcacgacaaggcatttcgaaagccgacacagggttaccatatgccaacgagaggggacccagaccaacaacaagttaggtcctagaccatactgcgccaggaagcccgggggttctccccgacaccaccccattgaatccacatgtctcttggcatcaaggctcccttgattagctatttactcagccagaggtgtcccattccacccgtgtggtcgcactattgtatgctcggatgtaattccaaaggaatcggtccttagatgcgaccgcacaagtattccgcctaggaatggccttgtgtcgcgagttttatttttaaaactcattttctttcataaggcaccgacccaggcgtcgggttttccaaagcttttgtaaaccaagttttacccaagaagttacttagattttaagtttgaaggcgaccgtcgatactcgcacagagtgcacaaatatcgaggcgcaactagatggttacaagggaacatgatataacaattaacaatggaaggatcagatgcaacaagttgggtaggcccaccggtctgccttgcagacggggcaaacagattaagtgcaatcctatcaatgcataatattttgcaagcaaattaattaagttcaaatataggctcaatatgttcaaaggtggcttgccttgcttagggtcttcacgnnnnnnnnnnnnnnnnnnnnnnnnnnnnnnnnnnnn

SEQ ID NO: 25768 - DNA, 1335 bp, Oryza sativa
  unsure (1)..(1335): unsure at all n locations
ggttcagactatggttcatctgaagatgaaaggttgatgatgccagatatttctgaagaagaagaagaagaaatcaagttcagttttaagagttttagggctgatgtagacatggagacacctgagttcaaggttagcatgatgtttgcagatgctgtagagcttaggaaagcaatagatcaatatactataaagaaccgagttgctattaagaagacacggaataccaaaacaagaattgaagctaagtgtgctgaaggttgtccatggatgttgtctgcatctatggataatagagtcaaatgcttagtggtaagggaatatatagagaagcacacctgctctaaacagtgggagatcaaggccgtcacagctaagtatcttgcaaaaaggtacattgaggaatttagagataatgacaaaatgacaccgatgagctttgctaagaaaattcagaaggaactccacttaacaccatctaggcacaagctaggtagagctagaaggatggctatgagggccatatatggagatgaaatatctcagtacaaccaattatgggactatggacaagaattgagaacctctaacctagggagctcattctacctgaacctacantttggttgcttccatactttgtatatgtcattcgatgcttgcaagagagggtttatgtctgggtgtagacctatcatttgtcttgatggatgccatattaaaacaaaatttggtggccatatcctaactgctgttggtatggacccaaatgactgcatttttcccattgcaattgcagtagttgtagttgagagcttgaaaagctggagttggtttcttgacactctaaaaaaagaccttggcattgagaatacatctgcatggacagtgatgactgataggcagaaggtatgacttcgtctgatttttcataatatacataacttacattttagttcctaactataattctttataattcgtttccaggggcttgttccagctgtgagaagggagttttctcatgctgaacaaagattctgtgtgaggcatctatattaaaattttcaagtgttacataaagggagacactaaagaaccaactttgggctattacaagatctagcactgtgcccgagtggaatgccaatatggaaaagatgaaggcattaagtagtgaagcttataagtaccttgaagaaattcctccaaaccaatggtgtcgagcctttttcagtgactttccgaagtgtgatatccttcttaacaataacttagaagtgtttaacaagtacattcttgatgccagggagatgcctattttgtctatgcttg

SEQ ID NO: 25769 - DNA, 22206 bp, Oryza sativa
  unsure (1)..(22206): unsure at all n locations
actaaaatttcaaagcatggagtagagatgcattgtagctactgcaaaaatggtggtcacaacaaaactagttgtaaacagaggaaggctgacttaaaacttcagaagcaacctatgcagcaaatggcgacttcatcaattgttgattcagaagagcttgtcatcactcgggtaatatttatacttattttgcttgtgtatttgtttatctccactaactatgaattttaaactcattgtatatttgtttcaggaacctgtcatcactcaggtactattgatgctcattttgcttgtgtatatgtttagctacactaacaaggaattttaaacagaacatatatttgtttcaggaaatgcacctgcttagcataccccagcaaaattctaactatctgagttcatctgtggtggaagcttttattaaggaggtgacaatccttcattaagttctcaaagaaaaaacaatccttcattaagctagcattttgtcagctaatagcaaccatcataaaattagtacataatcttttacaggctgctagcaaccatcaagaaagggtgaatccaggagcagtgccagagtctgctttcattgctactaataggagagaaggggttcaactaccactaaccacatcaaccaaacaaggcagggccacattgaggaagagaagtgcagcacccaagaagaaaaactctcccaagaaaaagaaacagtagtttatactatgcattcataaagttggttccatgttatcgattttgagctacattactagtgcacaatcaaattcatgtcaagttatgcatttagttttcattcaggttattcactgaattttattcaggatctcagtttctgttcaaaatatgcactcacgtgtttcattgtgttcagattttgtcacaatgtgtacaattaagcattatatccttgttgcttcagtggatttaatgttcatgctgttaatctgacggcacaatggcttaattccttgctgcttcaatgtctgcactgaagcattggagctaggcttcaaagttgctatatgaattgtcagagtctgagataaccgatgttggcctaaagcaagccactcaaatgcctaccgcagcatcaacttctaagctctcccactaaacttgacctcctcgccatctatcactatcgtcagtctcggcaatactgttgcagccactgccgtcaaacttgacctacccgttgtagccaccgtcggactcgactccccccacggcgtagctatcgggctcgacccccatcactacagccaccgcggattcgacctccccagctccccgccgctatgaacacctctcagattcgtttcactgaaaaattatacatgatcgaaataccaaacaatagaaggggttttctgataaaacagggccattgcttacgagcaggcaaacctgtccttcttacgtgaatgcttagttggcggtctactcatcatccaactcagcaaaattagatttgctattctatttagtcatagtccgcacgcacctatacaagtttgtgcaccaaaacgagagtttttcaagtttttacactaaattgcacccacctaacaagtttatgtaccgcggacacaatttactcttaatatttttagataaatggagccgagtagtgaagcaaaaggcaatagcaacacctccttaaaagtgccatttcagtgaccatacacactagtactccactacacacgattgagagttctctgaacaatgttcctgcggccgacgcctccgctctcgcgcgccctcgatccgcagcctccgcgccgcgcgcacgccgccgcccggtctcagtcggcgctagggttttgatctccaggaaaacgacgcatggtggtgtcagcctgggaggagactcactcatcctatattcctatccattcccttaggggtataaacgtaatatcatatttcctaaaaccttttttaaatttccttttgtattttttaacacaaaatcgtgggacccaccaaacggctgtcacaaatgggggtagacggctgcttcaaattaaaaagggggtaaaagtgcaaaccctaaaaagtgggggtaaaacagcaattggcttcgaaagtgggggtgtggatgcaattgcccctaaattttctccaaaatttatataggaaaaatttttataggattgaaatcatctaaaatttctatgaattttcctttgaatcaaagaggtcctaaatgttttgaaagctgcagttaaggtctgttcccccgaaaaaaaattaaataaatcaaggtctattcataaacatgcaaatttcaccttgagaaaactcatggagaagcgttagtggtgtgatgttgaattcatggttgtataacttcatccaataagatttaaataatactccctccgtctctaaatatataacgtcgttgacttttttaaacatatttgaccgttcgtcttattcaaaaactttttgtgaaatatgtaaaactatatgtatacataaaagtatatttaacaattaatcaaaatgataggaaaagaaatattaattaattaatttttcttaataagacgaactatcaaacatatttaaaaaagttaacggcgtcaaatatttagagatggagggagtattatccatgaatattacgcatagacagttcgtgggtacgtgagtgtgttgcgtttactgtggtgtgtgcatgtgtaaacttacggtataataaaagaaaaaaagaagaagccgatgaggacaaggcatgtttgtatcgtcgaccctccctattgcatacctgtggacctttttactggtgagattgaaaacatcgtttgcttgttagtttattagtgcagacaattttcaaaatttaagttagttttgagtatttatattaaaatttatttcttacattgacatttaaaaatatataacataaaagttttacctataaatttgattttgatttcttcgttttttttgtctgtttatcagcatagagtaaacaacgaaggttgaactgtatatttccagttttttttaagaaaaaacatgtatatttccctttccgccgacaaataccccatatgtagcgtcatctcgccacgaagcaacctatgtaggtggtgtttgaatctcctgagatatagatgaagatgattaagtgctctatgcaaaacgagatggtaatagcatgtgattaattgagttttaattattacaaacttaaaaaatggattaatctgatattttagaataactctcatatcaaaagttttcatataaaatacaccgtttagcagtttgaaaagcgtacactttaatccaaaatttcatcaattcgagtggggcagaaaccgacttgaattattattctccgtcccacgaagcgccgccgaataagatcacgctcgcctcctcctcctcctcctctctctctctctcatcccgtctccctcccgaatttggggtgtgtttggataatgggaaatgggggtaggatttaaagatgtctttttgttggtggaaatcatttccatttcccattagccaaacattgccttgcgatctcgcgacgaaccaaaccgatcgaaaccctagctagggttacgccggcccaccaccaccaccacctccccggccgccgccgcaatgtacaacggcatatatcggtctccagaccgcgcgggggtcgggcacgaatgggcacgtgcagaccaacaagttcttcatcaagccgcggtcgtcgtcggcgggcgggcccccgaaggcgccgcccccggccccggggttcgacgacgccggcgggatgcggaagccgagcaaggagatcctggagcacgaccggaagcggcaggtggagctgcggctgctcctgctgagggacgcgctcgaggagcaagggtacacggagggggaggtcgaggagcgcgtcgagcaggcgcgcaaggaggccgaggaggaaggacgcggcgcggggcggcggccactgccgggcaaagggtatgcgtagagatcgtcttgtttccgtttgttactgtttgtcatgtgtagtactaggagaggaaggctggtgactcatgcttaaaagttaataattttcgatatggtgtttggggttgtgttattcctgaaaaaaaattgttactcgtagttcaccatgctagcttgttcttgttactgtgctggctatactgtttgtctatgacctgacagtatcacagagcaaaaggaccatgtgacacaatggggagagtcggtgattactagcgtaggaaccctagtttaggtccttgcgacgcacacaaaagcgatttctgggttccatttctttctctgaatatccggggtctgacagcgagcgaggtcaccgccgcggtgttggcggcgacggcgtcggctgtgcaggagttggagtaggaatcctcgtgatcgacctcgagttcgccgatgtgctcgagcattaccggccaccgtgggtaccgccatctccggttgggtttccatggccgcggctagcggatttagatgagtttgactaggaatcaacggatggcactatgaaatttagataattttaatttctcgagagcactttgaaatttctgtttatttggacgcattaatattttcgagttcctagctcgatcgatctatccgtcgaattccaagagatctacaatacccaattaataaaatcgatggttcgattcggaaaattattcacggttgatgggcagagcgatggcatttccaaacagtttcatcgttaactacactgacaatgggctcgtaattctgtttctcatactctatcggcccggccctatcagcagttaatttgggccaggctggatgtggacatgtcagcccaccagcaacgaggcaggggctattttgcaaaacaggaccattagtaagtgtcatttttttcacaaaaatattaaggaccttcctgcaaaatgcatccccttccccggcgaaacttgtcgccggccagtcgccggagatctccgcgccgccttgtaccaccccagcgctacgctacgccggcaactaatacctccctaccctaacctcccatggccacctctttctcctcctcccagaggcggatctacagcagaagaaaaacatgtactgaaactgcttatccatatattataacaccatgatctaagtataattagtatagatatattataacaccaacaaaatgattttctggatgtgcacttactttctccctagcctagtcggccgccctccttcttcctcctcgcccaccttcttcaccggcgccggcgccgctgcttcccagcctctcttgccagcgctggtgcctgccgccgagccactgcctcacgtccatccaacccctccccaatttttttctgtgcagagctgagcagatctattgcctaattctttgtggcagagaggatggaacagtaaaagttaggacaaaattggaggtatacactacattcttccttgcatcttgcatcatttcataattaaataggatcaggacgccctgagagtccctgctgaaaatgttctgttccatgccgtctgataatactgcaagaactgcatccttttcttatataaatgcattagaaattacaagaatatcatatctctaccctttcttgcatgcgtttgatctggaagattatgttatattgtggtcattctggagaagttactggcaacctttagaataaattgtgggaggaaaatgtcatcatttttggcaacaatacaaaatatatccagtttctcataattataattcaataatgtcacaaagccaaatttatttataactttcagtggaaaaagcataacatatttgctactgcaagcatgcatgcctgctttctccatcagattacgtcagaatccttacaataaatacgagagaaaaaaacagcatgcaacctcatgtgccggatgttctacttcgtcagcgactaagttttgtcgctgataactgcctgcgaatctgcaatgcaagcctcaagcatcagctgtttgcatacttatttatatagtactccgtatgatacaaataatgccattattaccagagattgctttggcatatgcctccttaatgacatgtaaccttgcagccacttcttgcattgccatgcgctcattaggggatatcttaacgcagcaaagtcctgtgtttagcactgaaactaaacactcaatgcatttttccttcatggttacaggaatttcttgcaattgtttgtcgtctagtaattctggatcaacaatatttagtgttctatctggagagttcatctcaacatattttgcgatgtccagaccatccttgaacatattatctgttggtctcttccgtagaaatatttcaagaagaataatcccaaagctataaacatctgcaacagttgaaacttgaccaccacctgatgcacactctatagaccatttagaaaaggagagtttattgaattattccaaatgttaatgaaacttcaattaaaaaaatgttaatgaaacttgcatgaacaattctcaattgaaaatggaaaaaaaaagtatagtgctgtatgaaaatgggcggcacctggagcaatgtatccaattgtgccctttattgcaattgaagaagttgaatcagcagaagttgatgctgttgaatcaattttcaatcttgcaagcccaaaatccccaacatgagctgtcatattatcatccaagagaatattgctaggcttaagatcacaatggacaatagttccttggttattgtgatggaggtactccaatgcatctgctacatccactataatgcttaacctctgagccagtgtaatatgatttgaagttgaagtgttctcatcatcaccagttgagtatagtaactcatacaagtcaccacgtgtcatgaacttatacactaaggctttgaaatcatttcccctggaatcaatagttgagcacgcagtaaggataggaactagattgcgatgccgcacatttctcaaagcattacattctgcaatgaagctcttttgtgctccctttgtctctagactgaagactttgacagcaacaacatttctaccctgaaacagttgtgctttatatacagaaccgtatcttcccctgccaattaaattagatgccgagaatccatctgttgctctagcaagatcgtggtaagagactttgggaaagctgctatcaaatgagggcaaagatacagatttcctcttctgtttttctctccagaaaaacaaggcaaatactattgttacagcaagtgacactgttgtggctaatgggatcactactttcagtccaacagaatgcttgtgcttggttgaattcaaaggcatgacaggacattcaagcaggtgtaactctggtataccaccacaaagcccctgattcccatcaatttgtatggcagtcgtattcttgaacactccttttgttgggacatgacctgtaagatggttgaaagacaaatctagttgttgaagaagttctaggtcaccaagagacactggtattgtcccacttaagttattgtgagacaagttaagccctcttaggctacttatgttgcctaatgttatgggaatgtttccagtaaaaacattctggtccaacttgatgtctaccaaactttcgcagttacccaaagtacttggaatatctccagacagtttattagatgtaaggtgcaagtacatgagctgcttggcattgcctacttcagaaggaagttctccctctaaatagttgaatgatagccaaattaatgatattgttggaataccgaagatttcgtttggtacccaaccattaatattgttatgggaaatagtaaattcctcaagcacttggaggtatcccaagcttggtggtatgtacccatcgagctggtttgtgcttagaccaagttctaccaaattagataaattggacagagatggtggaatgggtccagtgaataaattgttaaataaacttagggtctgcaagcttttgagacctccaagccaatctggaatcacagttgtaaacagattaccacccaattctaaagcaatcaagttgggaatgtttgctataccagaaggaattaatcctgagaactgatttaatcccatgtgtatgtactgcagttgagtggaatggtttccaaaagaatttggcacattgccttcaaagcgattaccatatatggagaacatttgtagctcagtgcagttggctaagctgttcataaactccagatctttctggctatgtgcatggaatttattcagctcaagatttaaccaagacagtttggtaagtttgccaatggatctaggcacaaccccagtgaaactattgattgatatatcgatcagatttaacttggaagcatttgtcaatgaatttgggatatgcccataaaagaagttgccgcccaattggaacttttggagatttggtacagagtcaccaatattggacggcaactctccgctcagatgattggaagcaagggtaagttcaacaagagtagaaagattcaggatagcttgtggaaactgacctgccaatttatttgcacccagatgcaagtatactaacacaggtaactttgcaaaatcatctggtatgttgccatcgatgttattatacagacaactaaaccttttcagcgttgtgatattggcaacataaacagggatgggtccagtaagactgttgattgagagttgcaagctttgaaagcgttgaggcaaatctgcagggatttgtcctaccagattgtttccattcagccatagcaccttgaggttggaacagtttgcaagattaggtatctttccttgcaatgtgttgttgctcaagtagataatttgcaggtgatgcatattgccaagggactgagggatctctccagtaaatgaatttgcaggtagaaagagaaatttgaggaatgttaggtttccaagagaaggagacatctgcccaattaatcctctatttgtgaggtttagagagataacgcgatgtggagttttcaccctgcaggagacaccttcccagctgcaaaagtaattactgtcattccaggacatcagggcttgctgtggatccatactgattgccttcttgaactcaagtagtgagagtcgatctgtctcgttcccatataatgagctgcacatgattttgattatactgctagccataagcaccaacagatactgccggattgtggtaaacttcatgaccaattaaccaactctgccgaatttatgtcttagttatattcatatagataataaaagcaagaaactctgaatagttataaatactaagtgtgaaccaagcattcttttctggacaaaaatggaagtgtcacctactactttaatagtaaaggtgttcaaaaatgtcctagcaaatattcattctaattttgttaagaattacctgcatgaaaaattaataatcaggtatttcctttttctgaggacttgcctttcttaattgctcctacaccaaaaatacaagtcaaaacaagcatgtgaaatcttttgcccttgcatgatagctatattaattttgcagaatgggcgtcaagacatattagatactccctctgtttaaaaatagggctaattggatccgtaccattataatttaacaagtatttgggatataccactacttaccctttcacttcgatttccaaaccaaattaccttctcttgttcctcctcatcctcttctttcttcccctccctttctctctcctctcagctctggcatacagcaagaacaatccctagacaagcaggatgccaggacgcagtaaggctgcaacaagaacaaagtatttgtaatttgtgcgctacaaggttggagcaggatgctagagggttgcagcaaaataaagtatttcaacattggaaggctgtagacagggcttgcttgctgctgttggatccggcggcgcctcagtcctcacatccggagagcgatgtccggcgaggaggccgaggagccgtagcgcaacggcggggtgcgacgctgcggtggacgcggcgatgacaggttgaaaggggacagtagagaggatcagaggaaagaaaggatgaacgattgaatggagaagacaggggtagatttgtcctaaaaggttagaaaatactccctccgtctcttattgtgtgactacgttgactttttaaaatatgtttgactattcgtcttattcaaaagaatttaagtaattattatttttttcctatcatttgattcattgttaaatatacttttatgtatatatatagttttacatatttcacaaaagtttttgaataaaatgaatggtcaaacatgtttaaaaaagtcaacggcgtcaaacatttagggatggagggagtacagtaaaaagatatatagtggcatatctctaatactttaaaattgaaatgatataattacaaataggtgaataataatagtatatttctaaaccgtgaaatttataatgatatggattttccaactaacccaaacaaaaaataggctcctctattcaaatttgaactagaagtgcgcatttattttgggacagagacatcgagggagtatatagcacgtgtcaactgatgatcaaatctattctagaagacaagattcatgtttctgatcagtttttatggagctagtatggaggaaaatgatataattagatgaattccatacttaccaggaggccaaatgaacaaatgcaattcaaattttaatagcaaaattaaacaggaacacaagcgacaggagaagctcaaactcacaactgcgctagagagagaacaccagagagcggccggtctggctagctagctgcatcacgcacttcagttcattcatgccactcatttcacaaaattccttaatctacaactcttcaattcatttataggctgagcaaccaaaccatcgatgtagatatctaaccatgtttgaaacaaaagctactatgtaattttatacacagagataactgtcacgccaagaatagataatcctgttttcttgtcagtgctcgcatgcccgtcactaatgataaattccatcaggaaaatattgatttggtgcaagcgcaccgaaaaaaaaaatcagctttgtatcctgaagccttattcttgtactagtgactttcaccttcagtaccattctttccagagcaactagtcaatggggctttccatgcacggtgacctaatataatcatcttttattgtaaaacttagtatctctagatactataggtttttcgaggtatcaaaatttttagtgtaaaatttagataccttaaagtactttataaagaatcgtaagtttctccgcaaagaaaattgacaatgatgtacatcacccttaaagatgaaagcaccaacacaatagaactgagaggagttacttcagacaaaactataatttgacttattgaatttgattacataaattcgaaccaaaagtagatgagtaattcttttaagaaacgatgattgaagttctgctggatatgttaagtagatatgtcaatcacaatattataatactacatgttaaccatcaaatttatcataaaactatatattgaatcatagtatatgaaaactatagttttggtgccaatttcattacaatacacatatttcaaagtttcaacgggacaacaatgctgtccttttgcaataaattcaatgctaaatccataatttcacagcttcatggcttaagtacataaatttgtgttaaattttgggtgaatacccaacatgatccttgaactttcgcttaaggatcaatttagtccctaacatttcgtgttgtccaaacaagtaccttaagttcattgtgtgattcaatatggtccttagaccctctaaacatgtcatgtgtacatgccacatcatctatgcatgcaaattcaatatttaaatgttctttacacccttatgttttcatatgaaataaagaaaaactattgagaaaacacacaaaaaaaagcttttgaccattggcaaaaatatgtagcattgatagataaaaaaaaattaacattttttgttttatgattgcttctttttgtttttcttttctttatttgatagaaaattgaaggttaaaatggacatttaaatgttatcttacatgcacgaatgacgtggcatgtccatgtggcgttttaagtgggtgtaaggactatattaagccgcatgataatctttagggtcctgtttggacattataaaacatgaaggactaattcgacctctgagcaaaagttgaaggagtgaactgactattcatccttaaattttcaacatcaaactttgcctttgtttggggagtttatggtagctacaacttctagaatctttagctttctaaacggtataggttctcacctatattttgagagtatgtagtcatataatctaaaaaataaattaaaagtcagtagttgaaaaacccaatatttttatattgttataacctacttatcaggatctcgagctcctcaaacagggtgtgtagttttgtgactatgtagcttattatatgatttattatattgtagaatacatataatatttacaacaaggttctttttgcaagtaattaggatctctaccattggtataccaatatcaaaagcgcacagtgtagtactaccagaagtaatttacaacaaagtatctcatgcattttttttatgtctgtcgcacagagcagacagaagaagtttcaccggccttaatttccatcaacagtcatttctttctcaaactcatagggagccctaaacaaatcgttaattgtcatggcaaagaatgcatataggccctcaacaaattaaatcatcacaggccaaccccggtatctcaggtgatgtcagcggagaaaatagagattatgccctccttaaaaatgggtttcgctgaaataccatctttaaatatggtttcattaaaataccactctcaaccaagtggtattcgctacaatgccattttctccgtttcttcctaattaaaattattttgctataatttcataacttgactcaccaaaatgcccctggataaatcgatcgaacctgccgagtcctgttcttcgttctcctgccgaaagaagcaacaagttccgccctccactggtctttgttctcctgcagccatttccagttcgcccttcgtcgcagtccgcggccgcgcactgccccgacgcctcccttctgttgtgcatgtgctgcttgccgtcggccactattgacaccgaggaggtcgaccttgctcctctggccaggatgtgcgtactgctgattgttggtacttggtagctccctgtgtgtcacgcgaagtagcaagcctgtatattggtgtatgtatgatactatgcttatccaactgatgtcgtccgcagattggttctcctttgctcggctggcgggccagcgcgctcgaccatggactccttgcttgcgccgccgaggagctggcagggaaggggcgcggcggcacactgtctcctggtcactctccccgtcccgcttgagctgtgtcccaccctggcggcgccggcggctactatgccaggggaagatgggaacgaaagagagggagagaagggtattttggtcaccttcacgaaacaaaatatggaaaaatcgtttaattgtgaagaagttgaaaaaatggcattgtaccgtgttagtctagtttgaaagtggtattttaacgaagctaacttgtgggatggcattctagtgaaactctatcttgacaacggcaaaatgtcaattttctcgatgtccagcgtcgtctgtgctcgcgacggggtactccggattgacacgtgggatgcgctggtggtagcgtaggcgttggtggcatcaatcatggtgtccatggtccacgccatgttgtcgtcgtcgttcatccttagtgtccatgtcttgacgatgaaggcgccactggaatggtcgcagagggtggtgtcagggttcactttgatcggaggtcaccgaaatttctgaaattgtgaacaaaatttagttgaatttgaacaaatattaccaaaattcatgaaaaaatttaaaaatttaaaaatttcggccgaagtaatatcgtatcggaggggaccgaaatgaccgaaattttggtccaaaatttccaaccctgggtggtgtcgcaggtgttgccgatgtcgatgaacttcaacgtggcgccgcgtcggtgacacagacacttgggttcatcgtcaggcatcctcgtcggctgatgggaagtgttgaagtattgatctagtatctattccataagttaaaacattttgctatacctcatcaaccaaagattaaattttggttatttaattagtaaaattttttaactatagatgaaaagcatttgcgaagtaacaatctcacagcatatacaccttaaacgatgataattttaaaataaaaatatttatgatgagagaaatttggaagaggaaaaaggaaagaaaaaagagaagggactgcttatatttatggtgccacaattttttcttttaaaaaatagtcaaatgtaaattacatacacttgcattgtaattatattataatatttaaaaattataatgtggaagagagaggagagagaagagggaaggtgagaggatgacaatagggtccacgtggacccccaccattttttattgttttgtggtgtaattggcatgtgggccccatgattttattatttttccggattgaattaccacataagcgtcacgtcaatcccacgtggaacgaagacctaatcaaataagtcacgtcaaccaaaatcattgtgcaaaccgcataaggaccttatttcaactggttatgggagttgagtgacgcatcctatctatctagtattgtggttcagggacgaaatttagactcggcaacaaattaagatacctaaacttattaccaacaaaaataatcccaaccctataaatgggctaggcctcgtatgagccaatgctgattgggccaaacatcttacaggcccggcccaacggaacgcgcacgtttgtccttatctctatctttttctagaataaaatttctagccgttgcatttccgaagcttccaaatccgaacccacccggcgcctcctctcccctcctccaacgtctcctcgatcgcgagatcccccgcctctactactactagtctccacagatttcgtatcccccaaaaaatcccaacgcttcaaacccagcgagtcgcgccgccgcctcgtctccgatcgcggcgcacgcgcagatcgctagccctgcctgcagcatggcgtcggcggcggcggagggggaggaggccccgatcgcggcgttcgcggtgtccaaggggggagtcgtgctgaagaacatcttcctcaacgcgcccccgtcgccgctgcctgtggaggaggcggcgcgggggcggggtggggaggaggaggatccgccggtgatgttcgggcggcacccggagtgccacgtcctcgtcgaccaccccagcgtcagcaggttccacctcgaggtccgctcccgccgccgccagcggcggatcaccgtcaccgacctctcctccggtgagattccgctcctcccccgcgcctctcgctccgcctctccctcgatctccctgtgcgcgtggctggttttgattgaggcttcatttggggatttttggtggacgcgtgcgttagctcatttcgattatcactcgattagctcctgcgatgatggcgaatatttgcttgcgatttggatcaaaatgaggcaaaagctaacatggcattgacccatttttgtcctgtgaattttacacagtgcatgggacttggatctcgggacgaaggatcccaccgaacactccggtggagctgacagccggtgatgtactgcggcttgggagctcgaggagggaataccggcttcactggctgtcgctcccggaagcatttgacatggaggatctgctgccaccgctgctggaggaggataaggaggagcttagtacttgtcaggtagcagattctctattctgatcagtgccatagctgtgattattttgggggcatggttgttgcaatataagtgtttgttgaaatgctcaggaggcaagcaagcagttggagcctgatcaaaaggagtcagcggatactgagactcatcaggtctgatccccgtaaactcatgtaactggatgctgaaattatcagtgtgttttgtcatgttatcatgttctatagtttggtagaattctggacatatgtgttgagcgttttgaaacgctaagcaataggcttgattgccgaaattcatatgatgcaggcgatagaaatgtccttggctgctgctgattgccaaaataataaaatacatgctaaattctttcatggcaaatgactattagctcatccactttattgatactctatgctcacagttttatgaaatgcattacaaactattttgaagtctaatatgtgctactggattccctatttgctctgctctgttaattcttaactgataactaaataatccagtacccagcaattttgaattagtagttgcttagagtagtgcccctgcccctttcattggaaatgtcaagtttctaataaacgatgacttttagctgcttttgctatacactgtcgttctggagttctgcctaatgctattttagtgatgcttttaccatctatagaaatcttctgcgttgtggttttgaaaatctcggccacttcataatggcctaaatgcgttgtgcatgtgagcagattagggtaaaaatctatgtgttatattgggagctgctgattatattgtgcactatctaaattgctccaaagtgatttcatatggcttgcgaatggttgttactttagatgcattgattataaaaataactttcatctcaagctaaacaattagtttggctatttgtctgaatgttatacgcccatgtgttgcactggatgcatggtatatattttgcatgttgaagttaaatcctaccaaatcaaaatctccattgcttacagtcaaatactaatcgcactgttgacttaggttctactacttgattttctttctttccctttggaattttgagttcatattctggaaggctaactatctgatataattctcaggagacaagccaacaagttgtgtcagaacaaattgattttcatgctaatgtgattccctcagcaccacctatacctgagttcgctgatttatttgctctggaagaatcttcagttccagaatttgatgacagcagagagggaaggattgagggaaatttgattgaagagaaccatgttatatattctgttgaatcttcgattacacaaccaatgcttgccacagtggaagatgctggaagatcagtcaagtcaggcgaaaaggacacttcaaatgccaggaggtccaagttgaagtcagtcaaaaccctccgcattgagactggcagaagcaaggaaagaattactcctttgagttacagctatcagaaagaagaaaaccaaaatgagaatcctatatgttctcagaactgtgggatagaatgtgaagcctgcatggttttgtttaataattcttatgtcggagaagctgaagaaaaggaaaagatgaatatcttggacagaattatgatggaggagaatcaggaacagacaaatcatcttcaatccaaagaatttgtgcattatgttgcccctctgaatttggactatgaaacattttcagataatgaaaactgcgtgctgagtgttgctaaggagacagagcataatgatttcaactctgtgaattgtatctcacaagattcagtttgtgaaaatccacagaagatatcagaattattgcattttgtttcccctctggttntcaaaggcgatgacttcactgacagcaaaatcctacagctttgtgcttctgtacataacgagttgtctggtcccatcttagaaaatccattcatgcaagacatatctgatgaaaatacaaacagcaacaaagacacagggcatgaatgtttaacccttcttaacttggatgcaactctcacaagcaatgagaattttgctcaaagtaagatttttgtggctcctgaggactctgagagtgaaggcacaatcagtgagaatctatttgaaatttcgaacatgaaaggaaatgaagaaaatgaagagaacagtccatgggacaaggagaacatcaccccctttgtctcaggagatataatagtggagagaagtcagctaaggttgaagcccactaccatttcccaagaattgatggattccatttcccctcttaatttggaacataacgacttttcagatgatgaaagttccatattgagcattggagaacagatgaattcaaatgaacttatcgccaagaatcttatcccgctaacttcagttgatgcaaatatgcagaagagccatgcagggtttatgacaattgcacatctagatttcaaagatagcatccttacagacgaggaaacctcagtgctttctcctgaaaagtatgatactatatcccctgtgagacaaggaaacctgttcccagacaaagagaatgtgacaccagcctccagggatctgaagcccatcattggtaggaaggttcttggaccaagggtggataattcgctgtctgtagaatgcacttcaaaaaggaggatccatagacaagaacccaatgaatgatcagcaaagtccaaagtttgtcacgcagtagatgatgatgttttctattctgataaggaaaatttgacacctatatcttcaggaggcattaaagcaaggagatgtcttccaaagagcctcacagtggatgctgaccaagatcaagaggccttctactctgacaaagagaacttgacgccagtatcttctgcttctcggaaaacaaaggatttgtctgaaaaccgtgcacgaatggaaagtactatcacaaagaaaagggtggttgataggctccccttccagacactcttgtcgaattctcccttaagacacactagttcacttgatagtacccaggttaatcctagagcagttgatgtggcaatgaagttggagggtgaactgaataatgttccagtaagttcttgtcaataatattccattttttacatattttttccctttttttcttctgataaggaatctgaactaagttaatttttgttgctgaacagcacaaaggacaagagtctgaaaagaccaaagaaggaatgaaagtctggaccatggtaactgatatggaatgtcttcttgatgatgaatctaggaagtccatcatgctgctaagaggcttaaaaggaactcaattggtcataccaatgattggtaagttaagagctttatcatagtaaatttttcacccgtccacctacctttcggtctactagacatttaaccaatgctttaacttggttgcctgcaatatcttccagcgtatattctttttatgtactgtttatatctgaattcatgatctgtcattctgtcgtgctgcttagttctaacaaatatgccatgctagattttactacctgtaatccatggattttgtgatgttgagtgaatgacaagttgcttctgtagctttaactgtcttgctattctcttacaacctctgccccaaaatataagggcttttggctatgcatttatattgccaaaagcccttatattttgggatggagatagtactaaatagatgcaattaaccttgtatgtttggttcttgtgctgtttagcatgcgcacgctcacctatgtataaagtggtccattgcattgcatttctcactatgtttgtcgctcacagtgcaatatgctttattgagtttagtgcagttgtcacttgtaatccatacccttgtttttaactgaaccgactgcatcttccatgctatgcttcttgtttgttagctgaaagcttgtttacccttttgtcagtgatcagggagcttgagtgcttgaaaaagcgggagagattgttcagaatgttatcaaaggccacctccatgctccaatggatcaatgagtgcatggaaaaggagagctggtggatccatgttcagagttcaaccgagatgctgccagtagcaccaactccacctgcaacccctacagcgctatgcaacaatggagaaagagaaatctctgccggcaccttcaatccgatagccttgttctccccgagaagcttctcagatatcgtctccccgaaaacagaagatcgcgttcttgactgcgccctccttttcaacaaactaaaaggaaaccagaacatcgtcatcctgtccaacagcgtcacgcttaagatcaaagctatggcagaggtaaccttaaactccttaacttgactcggtccttgcagttcatgcaaattagagccactgaaccagagtataaaccatactccacccatttaaaattgagttcattgtgtttctgtcttattgaagggattcccttgcgagggagcaaaggaattcagggagaccctggtgaacccgtgctccagcaggttcatgtgggcggccagcgcgccgagaggttcagcctggtcgtgcctggacgagactaccctggaggagaactactacaacagccaccatggagccaggaggaggatcccaaggcccatggagcccgccaagggcctgaagctgatcctgctgcacaattctcactatgggcaggcgacgaacttcgtcgagaatcggccattggctccaatggcctcgtggtgaactgacgatggcacgatgccattgggctcagttaggccttgtgtgcctttgtatatagatattggatttcttcttcttcttggtatgtgattagagtaacaccgctggacttgtgaggtggattttgagggcggtggctacatttctgttggtatgatttccatgcctaatgaaagtctgaaagaaactagtatgacctgtgaaagttggaacatggaatggctgtttaaagtctccatttcacactagtggtggtggtggtgatatggtcagaggcatcttatctgcaagttgatcccatcctattagctgataaaatttggttccaaagcagcgctcaggatggaaaacctgcaatggctcacatggatatgatgatgagccggctggtgaggttcagatgtacttactcattactactcaagaactctggattcttatatattatcagtctgtagattctgagcagatagctaaactggacagcaatagaatagtgaccaagctctctttgctgggaacagaatcttactctactgctcaggaatgtttacatgcaataaaatactccctcccgcccataaaaatcaatctagtaccgaatgtgatacatcataatactacaaatttagataggcttttgttcagacgtggtactagaatatattacatccggtactagattattttttatggacaaatggagtatatatatcagccgtgggttcagcactgtcctgtaaaaagttacctttccatggagcactatccggggtcagtactaactaaagtttatgttttcaaccaaaacatgttggaaaccacacaatttcgatgttttgatatgggacaaaagtagattccaaattaagtttcattttgagaattcaaatttgaaacagtaaaatttgaccaaaatttatcaaattttggaaaagaaaagtcataccacaatggttcggaatccaatactaagtcgaagaggtgaaccctgatacaaactaaaaataactacgagatgttcacaaaatcgtcagggtcgactaaccccaatgattcgactgtagcgttgcccctgtcccggagttaatgaatatggctaaaatttgtgttgttaggtgttgtataatcaattaggttgctatattttggtaggataggagtatattgtttagggcaataatttaaactccattttttttctgagctaatagatgtttatgtgtaccacgtcaactgaacttgattcgtaacgttgacttcatagaagagagaatctatctacacttcaa

SEQ ID NO: 25770 - DNA, 2119 bp, Oryza sativa
tatctagacagagacatgtccagattcgtaatactatgatatgtcaacatggttattttttatagaacagatggagtaggcaactcgaacgatatgtcaacatggttattttttatagaacagatggagtaggcaactcgaacggtttcaaagttcaggagatgaaacctgggatcattggttgtgtgtgtggatggagtttttttttccctttcattatatttgcagcataaaattgatcaagttttttgaagactagatgaccgtgttgaacgggtcacaagactagattagatgctgctcagtttaattagcccacgcggagtgcttcaggttagctgtagacgtgcgtggcagatggtgctaagtgctactaacatgtgtagcagtagcactcaccttttctctctggtcaccatcttgaccatgttaaaagttggctcctgtttatgctattttgagaacagcgatgccatcttgaccatgttaaaagttggctcctgtttatgctattttgagaacagcgatgcaagatatttcttgtgaagtttctttctagctggaaaaaaaagtttatttcatccatcagactgttcttccatgtgcaaaaaggaataaaagataacaatgtcacagaaaaagatgggtgtgttcttgactctgtctcctgttgattccctgtcctagaggtatatttcaagaaacagacagtttctgagttggcatgcatagttatgatatctgttgagcttacattttcttttagctgttcaggaattagtgagaaatagtggtgctcgttacaccctcgattattgttctgtgtcatattttgtatccttctgtacatgactgacaaggaagagtaggtaaaaaaaaaattctgttgattacactttttccatcattgctagatttgcacatctgggtaaattgtaaattgtcgacatgaattcaaaataagtactagtagtgctatgaaaaccactacttgtttggtcaaaagcttatcaatgtgctcacacggtttgactgtgattaggaattgaattgaccaactaaacaatccccacaggaacaagcttggaactctcaacttttgaagtctacttcctcagtcccacgaagactgcattttttatttctgatcgtccgtcttatttaaagaaagagataatccaataaatgccattgacaagcgtccaacttcagaaataccattgacacaagtgtgagttctaagaaatactatcatacaaacgattttgtcccaaaaatgtcatcgccgttagggtttcatttattttacaccgttaaatacactgttcatcatatagaacttaatggcacaggatggacggaaccctaacgacgatggcatttttgggacaaagtcgtttgtatgatgacatttcttggaactaacacttgccgatgatatttttgggacttggacgcttgtcaatgacatttcttggattttcttttaaaggatttatgaattttttttaaaaaaaatagtcatgtattaagtaatattcatattttatcatctaataacaataaaaatactaatcatagaaaacttttaataagacgaagaatcaaacgttgtatctaaaaactgaaaaatagtgtctttgtgggacgggaagtagaatatagatcgatccaccacttgttacttgacttcaaagttttctgtgttcattcacaactgcttagcttgagtgactgaccaagtgtaacgcggaaaagcatcatgaatggccattacgtacagggtcattttctctgaaggagaacgatgtctcagacatggaagaggactgcactggccataaaattcggatgctgatctttaaaaaaaaacccgtagttttcaagcttttgatctactttacacgtgtaaatattagttgcccttgattgcgcatttcaaaagcgacaaatccttaatcattctgaatatcttcaagttttgtcacgttagacgaagtcggtttcgacgaaccgtaagacggatggcatgcatagttgaatttcagtttaaattttaaatttagggaataataaaggtggtcagatggtgcgaagtaaagtttaaagcttgttccta

SEQ ID NO: 25771 - DNA, 27174 bp, Oryza sativa
  unsure (1)..(27174): unsure at all n locations
ttgcacatggatttggaatttgggatagtgttaggtggtcctgaattctgatcggagctcccacctaccgacccaacaaattcgtgtctaggtggtgtttggatcagggacttaactttagtctctgtatttagacactaatttagagtattaaatatagactacttacaaaactaattacataaatgaaagctaatttgtgagacaaattttttaagcctaattaatctataattagagaatgtttattgtagcatcacgtagactaatcatggattaattaggcttaatagattcgtctcgcgaattagtctaagattatggatggattgtctaaacatccgatgtgatagggaaagttttagtcccatctaaacagggtcttaatcggtcttgattagtacaatagtacgaactaacagttatttagaggggccagtgctagaagaaaacacacttggaccagttggtcggccattcaaccatgacatgtctgtctgatagcactgcttcaaaattctaaaacaaattcgaaagcagacttcaaaggaatcataggatggtgctactaacttcggttttgaaaatacatcgttttgagcatgtttcaggttaaacttaaaaaaactctaaacatctagtacatcttatactgaaagtatgaaaattataagtacagacgtattttgattattataatttcaacatgctagtatataaacatactgtaaaattagcagtcaaggttgcattttgaaggccatatggatgttcaaaataatgttttcaaaactggaagaagtactgtcaagtaggcttttttttagctattttttaatcacacaaaatgcagaatgatgacaggatggatacctgatttactgaaaaccgtgtacaaaatgttgaagctcttatctggtgtacaaaaagttgaagaaaattaacatttggcaaggaagatgcacctgcccaaaggaatgagtcaagatgcaatggtatggaaagaataaacaagaagaagggaagtgtacgaaacaaagaaagagctaatggatccaatgaaacctttggacattatctaaaaaaaaaaacctttggattcctactgctgtctgagtcgtcctaaccttatacagcaacaatttgccgtgaactcatgttcagagaaaagaaaaaaaaatcgtttgtacccattgtctgaagaaatattccagatccgagattccagtaagtttagctgaaatatgaagaaaactagcagtgactaaaagaaatttgttctccgcataaaagactcttttcgagaggacataatattgataatatacaggaccaagagaagcagtttattggaaatgcaattacaaaataaaagagcatagagcatagggaaagcatatgaataactttatagatagattatagaaaaaatacatgaatttatggagaaatagagactcagagaaaaatatttcacaaggtcagctccattatttgctattcagcttatccgtcgtaaccaaaatttaaattttagagttaattttatttttaccgtactttattttttaatattgtcttttaaattgctaataacacatatataaaagtttacccatactgttttttatcgtaaatacgcattacggtttataatcggcttccttaaggcattccaacgaaactttataggattataaaatttgatatagacaaaaataacttacatagcaaatgctaaaaatttcatacacaaaacctactcgatttgaatctttttaggacaacgcttttcacttcatattataaaagctttgacttttttttgtcaaattttttaagtttgattaaatctataaaaaaagtatagcaatatctctaacaaaaataaataggatgggcgaacgacgggaattgaacccgcgcatggtggattcacaatccactgccttgatcaacttggctacatccgtcccttatccagctaaaggattttctcatatcatcaaaatatattcaatgttatatttaataaaactaacttgatattataaatattgtcaattttttaaataaacttagttaaacctaaataagcttgactagaaaaaaaattcaaaatgactcgtaatatttacaaacggagtgagtagaaaataggttgacacaaagaaaaatgtaaggaacagcaaaaaaaaaaaaaaaaaacaaacaagaaagaaaatagaaattcgaagagaaggttccaaccaagcataccatcttctccttctccttcctcctgccttcgttcttgtcttgtcacacccatggaggaggagaaaaaggcatagatacgacctggctgccctcacaaaaatacttcaccaaaccaccctcctcctcctccccctttaccatttccaagttccaacccccaaaaaaaatccaaccaaaaagcggagattttccaactcttatcatctcctcctcctcctcctcgtcatcgtcatcaccagcacacacccgagagaaaaaaatcctataaagaaatggattgagccatcacccaacgccgccaagatcctgtcctcttgtgtgcgcaacctgtagctccacctccacgcaggatcaacacccaaatccccccatcttcttttctttttcgtttcgtttctgcaagatttgcatcttcttcttcttcctccgaggagtgagtgacacctgagatagcgagagcgagattttcttcggtttttttgttcctctttttggccataaacctcccataaagctcggtttcttggttcgttttttctttctttcttcctctccttcgagaatcgcccgagtgtgaaatccaagatcccgaattccgtgtcttcttcttcttccgtagaaatcccggggtgggcaaagcggtgggatttctggagaggggtaaatgagcttccgtttctcgattggttcttgatcgcgtctcctctctctctcgaattcattagcttctcttcgattctttgatttcagggagagcgctacaaggcaagaagcttgggtgtccgtagtccgtacggttcttgatctggggtcgccgccaatgcagccggacccgagcgggagcggcggcgacggcaacgccaatgcgaaggcgaagctggcgccgccgccggtgacggcggcgggaggtcggccggtgtcggtgctgccgcacaagacggcgaacgtgcgcgaccactaccgcatcgggaagaagctcgggcaggggcagttcgggacgacgtacctgtgcgtggacaaggcgagcggcggcgagttcgcgtgcaagtccatccccaagcggaagctgctgtgccgggaggactacgaggacgtgtggcgcgagatccagatcatgcaccacctctccgagcaccccaacgtcgtccgcatccgcggcgcctacgaggacgcgctgttcgtccacatcgtcatggagctctgcgccggcggcgagctcttcgaccgcatcgtcgccaagggccactacaccgagcgcgccgccgcgcagctcatccgcaccatcgtcgccgtcgtcgagggatgccactcgctcggcgtcatgcaccgggacctcaagcccgagaacttcctcttcgccagcgccgccgaggacgcccccctcaaggccactgatttcggcctctccatgttctacaagcctggtatgtgtggtttcttagtttcacatttgctcattttggtaagcaattcgttgttgttattgttcatgtgtttgcattaaaattgtgtactgcttatgttgcattcaaatgactaagtcggagctttgtttatagcttgccttggttgaatcaattaagcttagtaatagttctttcatacattgttcatttggctgtcttcagattaattgaactcagcaatagttcttgcatacattgttcattttgctggaagacagcttacttgtctgctagattcttacttacttgtggcccatctgtccttctgttacaccctggtctgcactcatacattgggttttgggtttgaataaatgaggctgagatatgtgtgtggtatgacattgatatgataatgggagagggaattgaaacgttcttgggttctagctggaaactcaatctgtgcaagttagtccatttttgagaaaaggaataccacaaacagttcctacatcctagtactagtaactttgatgtaaatggcaatagtactgcttttgtggtttatctcatttgaactttttaatgcatgtcaaatattttttatgatattgtgatagttgccagctggtaattttcgcaaggaaccattaagtatttaagtgctcttatgattacgttatgtaaccttaaaatgggtagggaagaggtatctttgtctccatgtagtcactattcagctaagtctagttcaatggtagtgttatgtattgttggacatgagattggttgcaaattgcctaatttaggaagatgatgtgaaatgcagtgtcatacctactgctaccaccatcgccattgttgttgttccttatttgtttgtatctgtactgtgtattttgacttggatcttgtcaggaatgctgtatgagtcatgttaagtttatgaaactctgattttcatttcctcaggtgataagttctctgatgttgttgggagcccctattatgttgcacctgaggtacttcagaaatgctatggtccagaatctgatgtctggagtgctggggtaattctttacattttgctatgtggtgttccaccattttgggcaggtaaattatttgccactaaacaactaaattagtaggtccctccaaattctcacgtttccattgtcatattgtctcttgccttgcagaaactgaagctggaattttcaggcagattctacgaggcaaacttgattttgaatctgaaccctggcctagcatctctgacagtgctaaagatctagtccgtaatatgctttgccgggatcctacaaagagacttacagcccatgaggttctctgtaagtcaaccctgtttcctactcttactcgccataggtctgctttgcttaaatatgacataggtaggatgtcttcttttttctccttgtgatggcattgcctattccaggtcatccatggattgttgatgatgctgtggcacctgacaagcctattgattctgctgttttgtcaagactgaagcacttttcggcaatgaacaagctcaagaagatggcattgagggtacggagatttgtctataagtttgtgattcaattatttgcttatttcaattactctcaggttgaccttgtttgcctcatatatgaaaggcacctgacaagtctcattttctcccctgatttgtttgtaggaaatgaatctcactgttaacttcatttacttataaaagtcttgcatctgtggaattcaaaaaataattaagtgttgatatattctacaaccatgtgcatttttagtagagagagctatctgatctcttgaatcatgatgcctcttttcatccattgacaccacctttgtttgaacccaggttcatttggaatatatccagtaactattctgttcaggtcaatgttaactaagatgatgtagcaaactgattctttctgacatttgtttggggctacacgaaacctgtttccttggcagcccagacacttaatgcattataggcatcgtagtttttcttttcttttgaaatgctcgatctagcttgtgaaacatgcaatgatcatcttgagctctttacatattgttaagtatctttcattttgcaggttattgctgaaagcctgtctgaggaagagattggaggactaaaggagctattcaaaatgattgatactgacgatagtggaactataacttttgatgagctgaaagagggcttgaaaagggtgggttcagaattaacagaacatgaaatccaggctttaatggaagcggtaagtgcttctttgttagttgatccttcagggaaatgtaacttgcaggggccttctgatcctcagcattttgtatttcttgcatgctgtaatttttatgtctcgtaatttacatctcggcatctctcttgcctttgctaaaatggaaaagaaaaatccttcactaggaaagaaaggtgttttgtattaagatttaagatagcatgtcttgctgcttttgctaaattgtaatatgttcatttgtttcaggctgatatcgacaacagtggaaccatcgactatggtgaattcattgctgctactctccacatgaataagctagagagggaggaaaacttagtatcagcattctcatttttcgacaaagatggaagtggtttcataactattgatgagctgtcacaagcatgccgcgaatttggccttgatgatcttcaccttgaggatatgattaaagatgttgatcaaaacaatgtgagttgttcttatactctgcattctgtagtttgtccaatttttgacttgtttgttcaccaattgatttcttcacccgttttcaggacggacaaattgactacagcgagttcacggcgatgatgagaaagggcaatgctggtggagctggaaggagaaccatgaggaacagcttgcagttgaatcttggtgagatcttgaaccccagcaacagctaaactcctacaggaaggccatggctgttacatgccatcattgtctgaatctctgcacgcctcatcagctggactaatctctaagagggcaaagccgttgagtgaattgtgctttggcgttacatgagacgctgaagaattttcgtagcagtaatagctacagctactagagtgtaagagaaattggcgttatgtgatcgtaatatcctatcagtgtaactgatcttagatgatgctggagatgatagtacaatgaacagcttatatgtattcctgtccttgtagactgaacattgttgatagttggggaatgctcttggcatcaattctgtctcttctatctattattctatcgttagtacaggttgttgatgttaaatgtcactccaagttctaaacataattttcaggctctgctattgagcaatcttaaacttatgcttaaaatatgagccagtattcttaaacagttttataaaaattatagtaaatgtcagaaaacaatgtttaaatagctttcaaatgctgtgttctaaattgggtttaggctaggttaatcactcgtttaacgtaagcacgcttttcaaactgctaaacgatatgtttcgtgctaaaacctcatatagagaagtttcttaaaaatcaattgaagtttacaatatataatactttattaattatatattaatggtttaactagcttaatcctaaccgctatatagaaggcccctcttattgattctgaaacgggcctgtattttactccaaaatcacggcccatcaacgaaaatgggccgcgcattgtggggcccaaatctggataagaaggtgaggagagggaatccatccaaaatcctctcccttcccaaatgccgccgccgccgccgccgccgcggcttctcgccggcggcgaccaccacccgtcacccacctccgcgtcctcgccggagcacccgttcctctccgcccacctcctcctcccttccccctccccctccgacctcccctcccttcacctccctctcgccctcgccttctccttcctcgccgacccttcccccctcccccgccgcctcctcgtcgtgctccacgccgccggcggccgctaccccgccttctaccacgccttcgcctccgcgcttctctccctccccttcccgctcctcctcccccacccgcgcaaccgcctcctcctcgccgcctccgagctcgcccgcgcggcggcgccggggttcgcgccattgctcgtctcgctcctccgccgcctccccttccccggcgacgcccgcctgctcgatatcttccacgagcacgcctccttcctcgccgacgaagagccccagctcctcgcctccgccgtcttcgccttcctccgcctcctcgccaagaaccgcctcgatccggccccgcagtgtctcgagtgcagcgactgtggcgagtgcaagaacgcgaagaatcttgcaggatgcagggagaatctggtgtcgttttgcgcctccgtgttgcgggatcacacccaagtgtgtgagctgatcgggagggacctcgtgaggtgtctccatgaactggtgctcgtgcaggagttccatgaactgtggaaggactcgatgctgggccgtgcggcggagatctgccgcattggcatgccgggttggtgcaccgcgatggccgtctcaccggagatggagacgcagctgctgttcatgatgaacaatgtgaggtgggggaatcagaagaggtaccagctgtggtttgcgaggaagcatttgatggtgcctggaggggaggagaggatacccgacattgtccggttcatctgttgcgggtatcacccaacaaataaggttatgcagtctggtgtcattgcccgatgggcggtcataggttggctgctgacaagctgcaataagagctatgtgcaggcgaatgcaaaggttgcgctgttctatgactggttgtttttcgacgagggtaagggcaatctcatgaatattgagcctgcaatgctcctgatggtaaactcagtgtctcagtatactgatatcacaaacatgctacttgagttcttgtttcttcttgtcgagaactatgacgtgcggaggaaggaggcgattgctgagtgtgtaaggaacgcatttgcggtactggtgaagaaaggagtggtcccttccttggatatattgacatgctgtgagaagctttcaccgatgctgaggcagaaacttgtggcatttttatcttctgctagtcctgaagaaaccgaaaaaacttgtgggcaacccattgatgaggcttctaaagcaatggatttgaacaacagagtttgctcaaactagacccttttactgttcaacagagtagcatgttaggaatgaactcaacaccacttgcccgcaatttctccttttgggatcttcaggaagacctggaaagaggacttgaagattgtatggcatcacgtgtagaggtgaacgcatgctttgaaggtggaagaatacggattgtagaatgtggcttaccaacagctggtcatatgagcagagctacgcatactaaatctctgctgacatgttacatcgcatcacagacacatttgtttacagagttacagtctaacccatccagtgaactacacaaccttgttagcatactcatattcatggttatggagataatgaactggccttggcattggtttctcacctgaaggatggaaatggaatacatttaactggacacaatatgtgcttcatgccatgtatttacctttgttttaaatataacaaattcatgtacagcagaaaactaggtcttcatacaaatttacaatctgcctgaactgattgaagaaacctcaatatgagcttttggatgctacaagcctaagacaaaaatatacagatcttatgttcaaatgtgctgcagagacaacatgcactgcatccttgtgatgctgaacgtttttgtgtgggcgtgatatattttcttcagaaacatagccacaggtgtatgtgtggatgaatttctcctgagttataggagttcatccgatttaagtaggccacaattatgcacttgtaaatattttgtaactatcccagcttttgttattcaatagtaaaatctctttcatggtactttgtctctttccttttcattgagaccaataggtgccatctaccaacttggatctctgatatcaatgtttttggtgggtagtagaataatatgtcatttatgtttgttttttggccttcaattttctcaatcatctttcactctgattatgtgcatgatttctcccatccttgtattacattcagtagcttcagacatattagtggagctagggaaaggcatatctatcctaattgtgattatcatatcaagtgctaccacagatgatctgcaagactactacatggctggaattgtttgaaggcactcttggcatagacttgtcaaattagtggtgaatatgtcttctgcagccatctgtctcctgatctactagaacaatgtgtgccacagaagggacccagcatacaacaaacaactcactgctggagttgttatcacccaaacaccaacaggaaattcttgtgaatttcaatggtcaggacaggttcatggatgtcatatatcaggacatctccaccgtcgaaactcgaaagacgcctatgggcaacagttcctggtgaaatgcacccacagaaagccagaattcttcatcatccagccagggatgatccttatttatggaccgcgtatcgcgaagaagaaaaaactctgtttttacatggtacacaaaaaaaagggaaaggaaaatcatggggaggaaatcatgttgccagggtcaggacaaaggaggtggtggcaagaggattggagcaaccaaagcagagccattcatatccaggaggccaacctccacctcacaactcatatcccttttgcccttaaatctgagaagttgctgcacttctcaccccccctctaaggaaagactgcaaagaaaaggcctgtgtcaaggagagggtagtagcaccttgctctcctttgccttcagagaaaccggaagcaatggcgtctgctactctcctcaagtcatctttccttcccaagaagtctgaatggggtgccacccgccaggctgccgcccccaagccggtgactgtctccatggttgtccgcgctggtgcctacgacgatgagcttgtcaagaccgcggtatgctttctgaatatcatccgtactgttctatggtttttggcatgcatttgtttcctctttatatcaatgacaagtgaaggaactttatgtagttttatgatagatataagcactttatcgtcaggaaatcaaataggatgtgcagtcaagctaagttatatatagcagaattcagtgaacataaaacacttgttttgatataacatgattcaaatatactggcatctctagttcaaatctactcttcaaagttatataatgcatttgaaggaaaatttctatcttcaacttcacagaaagcaaaatagatatgatttgtgtataccaaatgaacttagagactcaaaatatactagtaatacatttgtaaactcgacatctgcatcaagacatgacatgggttaaccactagcagttgtaaggataaagcatgaagcattcatgtgtcctgcttatgttctatgaaccatctgcaggtcataattcagaagaaaagtttggaacttctaatcctacaacataacaagcatacttttatcaactttggataataaattcttaagatgagtttttcattcaattatggttcagaactagaagattaaaaactttatccttcttgctgtagaaaaccattgcatcaccaggaaggggtatccttgccatggatgagtcgaacgcgacctgcggtaagaggcttgcgtcaattggccttgagaacaccgaggccaaccgccaggcttaccggaccctccttgtcaccgcaccgggcttgggacagtacatctccggtgctatcctcttcgaggagactctgtaccagtcaactgtagatggcaagaagattgtcgacatcctcactgagcagaaaatcgttccaggtatcaaggtcgacaaggtatgaatttcactccaaactgacccctgatccttgttgctcattcaaagtagtatcaaatttattaaagctgttaaagaactgaatgtgttagagttgttattactagagaaaatcattgttctagattgaaggaactacaacattaattcttctgaatttgtgctcgatgtcagggtcttgtgccccttgctggctccaacaacgagtcatggtgccaaggtctcgacggccttgcctcgcgcgaggcggcatactaccagcagggcgctcgcttcgccaagtggtgagacaaatttttcacctacaaatataatggccagttacctttcacatactatcatttgtggatatcattccagtgtctgacatgaagttcttcatcttcaggcgcactgttgtcagcatccccaacggcccatctgaactcgccgtgaaggaggctgcctggggccttgcccgctacgccgccatttctcaggtacatatcaaacttgattacagaacaaaaactgcaagaacataataaatctctttcctgatgatgctgcaagcatgaacaattttcttgaataatactaggacaacgggctggtgccgattgtcgagcctgagatcctcctcgacggtgagcatggcatcgacaggaccttcgaggtggcgcaaaaggtgtgggcggagaccttcttctacatggccgagaacaatgtgatgttcgagggcatcctcctcaagccaagcatggtgacacccggtgccgagtgcaaggacagggccacccctgagcaagtatctgactacaccctcaagctcctccacagaaggatcccccctgccgtccccggcatcatggtcagcattctaccactgataaagaaactgaaactaaagcttaggaagctactaatattgctttacttcttgcaaaatggcttaacctgacttggaatgttgatcaagaaactgccgctgcaaatgttaaaagcttaacctgattcttcttgcaaaatggcttaacctgactggaaatgttgatcaagaaactgccactgcaaatgttgatctgctaattctgacatgattcttcttgcacaacgatactactaactgtctctgcagatgtagatgatcaagaataaacctgaaagtagagctgatcgataatattgattgattgttgtttggtgcagttcttgtcgggtgggcagtcggaggtggaggcgacgcagaacctgaacgcgatgaaccaggggcccaacccgtggcacgtgtcgttctcgtacgcgagggcgctgcagaacacgtgcctcaagacgtggggcgggcagccggagaacgtgaaggcggcgcaggacgcgctgctcctccgcgccaaggccaactcgctggcgcagctcggcaagtacaccagcgacggcgaggccgccgaggccaaggagggcatgttcgtcaagaactacgtctactaatccgatccaatccaatcaagacagtgaacctgctgctgctgctgctacgtactacagctactgctatactgctagtacctcgagggcactgtagccagtgtgtcgtcacagttacaggttgagatcgatggacaaagttaaaactatactgcattaattaattttaccttgagaacatacgtggttcatcatgtatttcatcacatgaatcttttctagagcgtttgatatacatacctcgtgttttgcctctgcaataaccttgtgtgtagacgaatctgtatactacctgtatgtgtggcctgtgaatcgatttggttactgcaaagttttgcgtatatatacatgcttgtgattctggaattattctggttacccccttagccttgcttcacaatctgttccctgctctggcaccacataaattgaagcaaaaattgtactcacttcgctgactcatgcccttcactatgatttattctgtgttaactctgaatacgatgcgtatatatgttgctttctttgtgttcctctagtccaaatttctattttggcatgaaaagatttataaaaagcgtgaaaactgaagatcatgaccaaatgctgattttttttttgtttgataacttccattaaaaatgcataaatgtgttattctttttaagtttctcgtgaacatgcttaaatagaactcgtgtggtcatgtccataagttgcatatttgatcccaaagtggttatcatttcggcccataagtggcacaatttcagtgcataagtgcatgcaattttggcctataagcacgttaattttgggtgcgggatgggaaaacatccattcagatatattggtatcctgatgcatcacaacttcacaagagactatcaaacaaggatttggtaggcgatcaaggacatattccaaaagaaactgagtagttggaaaggaaattttttgtctattggaggaaggttgattttgatcaattaagcttcggaatcgctatatttgtggcaacagttttcttccctcattacagtcaaatttctaatcgttcgattggttttgcgatttgtgctgacatagacccaggaacccatatcatcatgtccatatccagttccttgtcacgttggcaggcccattaaaatggcgaggccaaaaatgtttgaataatagcatttctcaacttaaaatgacagtacgtgaagctaaaattacatatataatttagaaacttacaaatgtaactttggaacttacattgcaatacactaaaattacatatgtaatttagggacttacaatgtataaatacatgctaactatttttcataagaaatatggcactatttttcataagaaatatggcgacataaatataggtagtcccattaagttttaagtagcctagctatatttatgatctcctttaattgaggcacctaaaggtacactcaagaatctaggtaattactggtctagattcttttgcagtgtgatgagcataaaaagaaatatagggcctgtttgggggagctttagattctgagaagtagttgtttggtagccagcttctgagaatctggaaaagctctgaaacccaacttctgacttcttagttcatttttcagaatctgtaactacagattctcagaagttgtggactgtttggggcagtttctagcagacaagctcccccaaacagggccatagacttgctaaatggagtgtcttatgcagacctaaagaatgtggggggtctcagaatattaacctcgaggtacagaagaaatatttgctaagcaaagttaattaatgaagaggggctgtggcatgatcttcttagaagaaagtatgtgtccaaaaagaatatcactgaagtagaaaagcgacgagtgggctctcattttgggcaaggttcatggaggctaagaaatcctttctgccattgggatcctaggagattaggaagggttctcaagtgagattttgggaggattactggtgtggtgataggccattcaacttactatattcttccttgtattctttggcaaggaaaaggaacacaatagtggcagaggcttagtacaacacctctaaaggattggtataaactggtctcaagagtttgtgcatttaatctatctgaacaagatgatctttttaaatggaaagttcaaaagaatggaatcttcacggttaactccatgtataaggtgctcatgtatcgagatatcatacaattctattatctggaagcctagatttccgttaaatataaagacatttctatggtatatgggagaagatgtcatgttgacaaaagacattctagttaaaaggaaatgaaaagggatcactgatattgtttatgtaatgctaatgagactatacagcatctcttttttgaatgtcaagtagccaaaaacatgtggagtgccgtatcttttttgggccaattccctatatgcccatgtaatttcacccaatcccttctacgcccctgaaatttgtttgatctcttatatacccctgagtttttatttggatcccttacatacccattccgttagttgaccattagtttgaccgttagttattgtagaaattactttattgtccttgttatattgttaaaagctagaaatgttttatgtgtaaattatttgagttgtgaaaaccaataaggaataaattactaaatatttgtgatgaatttttgaaaataaaacattatttcattaaaataaaaaaagatttattgtaaaaaaaagttctgcataagatttgaaaatacttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctggtgaaactaatgtatggatttaatcataatttttaaaaaataaaaaataataagttttattttttaagttgggcattaaatgattatattgcttgtattttgtataagtttatttttcatatgaaaatttattgggtaggtaccacacatatgtataggatgggtaatatagtcattttaaaatatttaacggtcaactaatggtcaactaacggagatgggtatagaggagatcaaaatgaaaactcaggggtatataagggataatgtcaaattcaggggtattgaagggattgagtaaattttcaggggtatatagggaattttctcttttttttatatttgatgaagagaggctgcaagatgttggaggccagagtgtgatgagcttcttctctaggcaaggatggaacttcaggggaagattacaagcttaatctttgtttctcttcttttgtaagggttggaactgtttaagtggtggtcatttcggtactgcccattatatctaaaaaaaaaagaagctaagctacctcagtttgtgtagtatttatagagtggtagtggcccaatggggaatgacaaagatatgtcataatttgctcttaaacccaagtttattagcttgcaatatatgcttaaaagtacaatctgcctatgatatgatgatacaagctactccctctgtttcaggttataaaactttctagcattgctcacattcatatagatgttaataaatctatatacgatgcttcagcataattaggagttggtgaggtcagccgggtcgagcatttgatcgccatggctggtctcaccaaggaagccggcgtgcgaaaggagcacccacaggtgcgtggtgagctccccgctcccgcgcaggtgcacctgatgcttcgccgccctcgtcgatgccgacaggtgcagcaggaaacccgcccagaacttgcccagcctcttccatagctcgacctcggcgccgccaccgaacgccgccacgagctcctccgatagcagcgcgccaatgtcaatgatgccctctcaccgtcgtccccattgcaccgcggcctgttggagtttaggatgagctgatgcggaagcccttgcatcgcgttgcacccgcgcatggattgtgcggcctccctcctcacttcatggaggaccttgtaggcgacgaggccattgtccggcaccagtgcctgcctgaccaggtacgcacggtagttggacagggtgacggcggtgacataatgcggccacacatctgcgagttcaccatcaccccgccctcgggcagagtgaggttatacaggtcgtctcgccagcgaccggtggcttgttgttccagtagtttgatctggcagaggctggtggcgatgtgccaggctagaatcttgtgggtctcgccctcgccctgatctctctttggatatgctcgatctgactgacaaggtgttcgatgtcggcgaaggcattcccaaggtaagaccgcaatagctcgttctttttctgcgccaactcctctggtgaactcctcgtccttccagccgccactgacgctgccgcctcttgagaattcaggagggccttgattgacgaaaacagttccatcttcacctccctccgcagctaccttgttctgtatgccaaggtgaaaaattgatttgaattatatataatatataggagaactacaaattggtcatccgttgataatcatgatcaaaatagcatggtgattgatgactaataaaggggtcatctattcatcaattaactgatttttaaaagttcgacacactcttttcaataagccacttttcaatacaatggtgcaaacctccgaccctctccctctcccttgcctacatgacccaacccgcttatactgctccccaacccaacgcaccaccatcctttcccttgtcagcatcgttgaggcccacaacccaacacaccaccattctcaccgtctccctccctcatgctcaattcaggtagaagacggttgctatgccgtggatcttgatcaacattatattcattggtcaactaagattttaggggaactcttctcagtgcactgatgaataacgaaaatggattcaatttatttagaagagatcgataaattgtttacctaaagataactcttgtaacgcgggctatgcttccagtccgagccgacatcactaggttgcactggcgaatattgcggtcccgtcggcttcgtcccctcccgatgagccagaacatgatcctcgccaccttctccatcatccaaagccgcagcccctggatccagcagccttgacgtcctcgcaacctgatgtagctgcagatgatcaagacattggtccactgcgagaagacgtgcacgataatctcccagagctctctaatgacaagtatggcgatgatgcagtgggtgacgaacactccatggctgatcctagcgaggcggcccttggcagtgaggcctgtgctaacactaggcatatcatgcactgcgtaggccaggtatgaggcagctgctgtcatcagaagcgatagcagcaacctcacgcaagggaagccactggcgaagacatcagcgtgcttgctgtagaagaagtcctggaggaaggacagctctacctccgtcacacggaacgccctctcgtagcccttcttgtcatctaggatggcgtccacaacgagctgccgggtgcctgcatggctggcctcatgtatggggaagttgaagaaccgacggcgcagcagcttgtacagggcgaaggagaggcacacgtccttgaaccggttgctgctgtcgccggcctcaccgagcagggcatcgctgctcccttggctccagaccttctccacagtgatgacctcctcctgcgcaagttgcgtctgtgtgaagctgggtggttcgacctttatctgctgcttcagcttctcctccccgagaacgatgtacttgtaccccgccatggtggccgggttggcatcgttggacgtgtgctgcgtcggcatcgccatgtagtcactgacaagcttcatgtcatcatctctagctctggcagccgcgctggaggtgatgtagtaccagacgatgcgcgaggcgtggatggaccacatgagccagagaggcaccctgaggtgtatcgccgtcttcgcccgaagctggttggccgaccacagcgaggtgagcatgtcgacgagggtcatctccttgggctggtacggccggccgatgcggatgctgtcctgcatggtgacgatgaggacggcccacaccttgaagaaggcgttcgccacggtaccttgatgggaggacgacggcggcatgagccccagggtgtagctcacagcataatggttcagtatccgcaggagctggacagcagggttgatgtacttctgggaggagaagcgggggccgatggaatcgacggcgaacttgatcagcagcagcgttgtcgccgccgccacccagaactcgacactggctgcaccagtggtgctgtcatgacggaacaaccctcctacagttgtggagatcaagtggaggatcgtcagaacaatattagccatcttgcatttgcacactactgccgtctgacgaagcctacttagcaagctaaacacacattagcaacttaactagcaagctagccaaacacattaacactgcttgaactgaaaactttggtatagcaacttagctagttaattagctcatcccaaaatgataagctcaactcactggttttgacgtcaagtcaagatgcttactttaaaaaaagacataacgctagtatatggttgtcgcgttcccatagaattttaatgactttataaagaaaagttgctgccatgacttattgcgtcaatgaaaaatgttatctatcacatggttatcgcaatatagcattttcaaatgggaaactgttttaagtcctgagcactggatgccctcattcctttaaatgatactccctccatccctaaatgtttgacgccgttgacttttttaaacatgtttgaccgttcgttttattcaaaaaatttaagcaattattaattcttttcctaccatttaatttattgttaaatatacttttatgtatacatatagttttacatatttcacaaaagtttttaaataagacgaacggtcaaacatattttaaaaagtcaatggcgtcaaacatttaggaaaggagggagtatcatacaatgagtccaatcatacaaagttgggcagacaatagtagcctatgaaaattactaaattagagaacatatactattgtcttagatattcctctataaatattcaaaattaaatccgctgcacacatctaactgtgagtgagattacaccttttatcgagaaataaaaattgtaaatccaaccataaatgagattgcactattctattttgttatttttacttctctctacatagattcactctagattaaatattatggagggtgtatgagacaatagtctatgttgtcatatttttaagaaaactttataactattaaggctatattgaaatactacaattatttgcagtcttactcccacaagtaggtgtggaaatggtcgagaattccacactgactaaggctcatttctgatttctaccaatatagcgctagtcaaaaacagtggtgggaacagtttcagtctttcaccatccctttcctcggtctgtattgtattcatccagaaattattgaatatctagacgccttaatggcacatacaaaatgaggttacaaaacttggggaggcaacatatgcgtgaaggttgtcctaacccaccccctttggtttgtaggaaaaatggagaaaaaaacatagtaacaagaattctatagaaatagaaaaaattcctgcacgtttcatccatttggtttgtacgaatggagcaaaggagaaacatagaaaaaattcctttggatatgtttccaaaggaaattcataggaaaacatagagctcttttttctattcatgcacataggattgaggcaaagcactcactgttctatgtacttggcctcaagatgcatggattaaaacattcaagtctgatttacatttacttactacagggtattcctgcattttcctcaccaattatgtgaacgtatgatcattcctaaatttatcacgtttttaatcctctgttttacatatgcatttttcccatgttttttgcattcctgggttctaaggagacctttgcataaattagagctaggacgcacgcgcaactagattcccgacatcctttttttccagaaaaaaaggccttctacaatatgaccgcactcacaaaaagttgcaaaaaagtagctgcaactatttagctcttgatataatcaaggtctagggctttggccagtattatttatttgcagtgtgtccaccagataacaaattaagagaagacacgcacaagatgcattaggcatacatgatgatgcgatgacgaagactagaatcttttgcatctaactaaaagccaaaagggagaagcacatacttgtttaagaatggtaaggttggttaggccatcaccaacccccaccacataatttatttaagaatggtaaggtgggttagaccatcatcaaccccaccagaattctggaatgatcatgcattatccttaaacgttaaactaaacaacacatcatcatatggccatccgacaacgccgccacaagccttcgagctttatgagccaaatacaaactttccttcgagctttatgagccaaatacaaactttcatgatgatttctctaacttcaatataaaccatcttagacttgtgtacaaattttaagaaaataacttgattgactttctttttggcttcatttattgacgtttcaaatatatggatttcctaatttatttgaggaatatcgttatttcctaagagcacatatgggagaaaagtggaaaaagttattcaaagtttcgaaatgaatcaaatttaggaaaaagttgagaatactaaataagttacatttggtatcgaagggaagtattacacagcggtttttgacagtctactgatgttgaagtaaggccatagctgtttgatagcttaatcataaatatatttagatgacattggctagtaaatacaagatatctatgataagattataagaaaatccaagaaacaccattgacaagcacccaattacaagaaataccatcgacaagtgcaagttccacaaaatatcatcgtacaagcgactttgtcccaaaaatatcatcgtcgttatggttccgtccatcccacgccattaaatgcaatgttcatcctatagcacctaacggagggctgctaacaggacctaacggcgatgatatttctagaacaaagtcacttgtacgatggcatttcatgaaactcgcgcttgtcgatgtcatttcttggaattgggcgcttgttaatggcatatctgggattttccctaggactattagcaaccaattataattcattagtccgcattgcatgggcatttttatctactttactcctaattttttttaaaattactaaggacaaaatgatatcaaacttaataatgattgcaaaatcatatgtagagtccatcctaatattcagttactttcatttttaatttaatatttaaaaaatccaaaagtaaataagtatttagttgcatttgtgctagagtcacaatttagtatgctttataacttaatgtttgcatttgtgttggagtttcacttggcttcaagtctcaattatagagtggttttttcatgatttaataggttcttgattccaaattaataaacatctagttgtgctatgttaggagtctcagttatagttttcacttgatttaataattaaaaattttggaattaatagctggtaggttgtactccctgcgtcccaaaatacaagggattttatatggatgggacacatcctataactacaaatctggacatatacaaatctagatagacttcttccctatctagattcgtattactagggtgtgttcaatccatccaaaatccaacagagatttcattactcatttttttcctggttctctaggggtaagacagtggttgcgtgttccctgtgatgggaggagaaggcggacagacgactcattgtaagatgtgggatgcttgtttcaatctaactatgtaagctttcaaaaaaaatgtcaagtacagaaactaaagtgtagagtatatttctaaattctaatggcaagttagacaataggacactcaaatagcaggaccagcacaagagtcccaaggcaggttagccacctgagggccgacttttagaatactggtgctaagctttactcctgtgaagggtgaatgcaaactgacagttctaagctttattccaatgacatgtggatgcatgattaattggcactacttagtgcaaaaggtagttgtggaatataattagtagaagaccactgaccatgactctgtgaagcaagttgactgctgcctgcagctaatgcatctttccagccggcgcaactacctgaagggtgcaatgataaaaggaaaaaggaaataagaaaagagacaataaaggaaatgacctcctttggtcaaggaaaaatactttattagtcctcattaatctttccgattgggatatatgagtaccgatttactaaagcttaagctttccttctgccagtgataccttggtagtgagcgggcagcagcggcagcttctgaatccagttaccctcaggtacgcatgcacctgcagctagcacagtcagtaatgtctgggaatacactcatgccctgcagcatgtagacatggaaagttcttacatatgtatggctgctcattgcatttttctttgattcttgattcactgtgcgtacgaaaattaatcccatttctcaaaaaaaaaaccatgggcttccttagttctttataaagctagctgggttcattcatcgaaagatctattgtctaaaaaaacaaacctagaaagcccaactcttacaacctaaaacaaaactagcacaaaaacaagtctctacagatcccttgacaaatgcagtagtagttagatagatgttatttctgcacttcaaattattatgtatcttgttgcaaaagaataagagcagcatatatcatgtacacactatgtgctaccagcgagatgaaaattgtccaaaatgtaaactcatatactgtttgcttgatgcattctccgtatcatgagttgttgcttgccaaaatgaaaaaaaaaagttaataataaaatggtccctagtgtaggagtaataactgtaaatttcctgtttatcttttacttgctcatcatcaataaattaacaaacagggccatcgaacaagcttaaaaattgaaaatggtggacgtccgtgctgtgattgaatcattttttgtcatgctgaaagagaacatctatgtcttgatccgcattgagtccttggtggcactggtgacattgatattccttgcaatgttcatcatagacttctaccgctgccgaactcgtagctcaatcttgaccaccattcttgaaagcatcgacgaattatctgatcagatagtagtgtacctcattggagccatgcaatccgcgaggtttgagaatgagctgttcccggtctgggccatcgtgctggtgagtctccgtaccagcctcggctatctctctgggtatggcatctcagaccgtgatcgacaattcatggagctggcaaatgtgatcaagttcataggggcaggggtcttggctggcactcgtggcttgaagtatgcaaggccactctggtcattttgggccatcctgcaactgaagagcatgtaccggttcttcgcacatggcatggcaaacgaatccttgtggcatggccggagctcagagtttattcctgagtacatgcgcaccttcattcctgaggaccaggagacaggcgtcaatcatgatgatagaaacacatcaactatgatgccaggcaaaaaatatctgatctgcggagagtccaacaaagacatcaccttaaagaagcctcaatacactataaatatcagcaacagcagcgctcagtcactggtcacactgggcaagattcaggagtacaattggaaggggatgaacaacagagatggagacagtaagtttaaagacttgagcatggccttctcactgtcaaggctgcttcggtgcaggcttgaagatgtgacactgaacaaagatagcattaacgacatgcagcatctaatcatctcggagttcattcctgacagccgaggacaacggcaggaggagaaggtggacgggcaccaggctgtcgaggctgagcggacattcaggatccttgagttggagcttgcatttgtcagagactacttctacaccctctacccattggtcttctgggaagggcttggttctctctgtttgagtctgctcctgtccgctgcaactttcgccattgccttctggctggccgtaggaatccgcaaggtctatcaacccccagagggcaatcttgtgctctgggtggatggatgtaattttgacatcatcatgacatgggtgttcatgttctgtgtgatgttcaaggagatctgggaaatagtcacatacctggtatcaaactggacaagattacttgtcctgtgcaagtatgtgcaggaccaggcttggtttgtgagtgaacgactcacgaagcatctagtaaggtcatttttcgagtcaaaaattggcgaaccatggcatggacgtatcgatcagtatgacttcttgcagcaaattacttacaagccaacattatggaaactggcaaatgtcatcaccctgggaaagattaaaggcaaattggatgggaaaaaaactggtgaagccatcaagatccctcaatgtgtaaagctagcaatcctacaggcaatccgccgcatcggcctcaccagtagaccgttaccgagagaaatcccatcactgagaagctacgtacatgctctcaagtcattctagtgtggcacatcgcaaccagcctctgcgagatcaagcttgcgcatgacaagaaaattgacttaaccaaacctgggttcttgtgttctgcctggtcgtacatgaaaaaaaagctctgctgcttctcttcctacccataccttataggcgagaacagtggcctgtctgctgggctcaaaacaaactaccatatcgcgatcagcttgtcacggtattgcgcttatctacaggtttttcgttctgaactgttaccagatagttttcttgtccctgaagtgctatttgtggaaaccttaaagcatgcccgcgaacaactcaaggattgtaacctgaaatggtgtagatataacaaactcatgggaattgcactgcaagcaacaccaagcagtgtagatgagaaattgaaaatgaacatactgcagcaaggtgttactctagccaaggacctgatcggaatgaaggatgatgaagcctgttggaagatcctagctgaggtttgggctgatttacttgtgcacatcgccccaagctggaatgcatcagatcataagaataatctcgagtctggaggcgagttcattactctaatctgggcattgctttggcactgtggcatcgaaaagagcagcctgtggcacaaggatgaagcatttgaaaacaattctcaagtacctcaagaaagcagtactgaaaccagaaatgttatacctatggatgagccagctaatgaggatggaatcgagagttcagaagagctcaagacaagnnnnnnnnnnnnnnnnnnnnnnnnnnnnnnnnnnnnnnnnnnnnnnnnnnnnnnnnnnnnnnnnnnnnnnnnnnnnn

SEQ ID NO: 25772 - DNA, 582 bp, Oryza sativa
gctggtcttactcttatggatcaaaatcatacaagtataatgtatgcaatgacctacctagccgtggagactagtcacctgaaaacttcacatagatgctggattacccaacatgcacccatcactaatgatgagtcttattagtgtcattgcaattaacgactgccacctatagagatgcacaccctttttatttaggataattagagccatgccactgctgtacattaaaaatataccaccactatttacattatctgtggagtaccattataaattaataaaataggaactatgccactctggcactctttatgtcctacccatcctctctccgagacgacgtgaggctacgcgctcggtgatgacatcgtgacatcgcagacagcggacacggcatcgacagcgagaccccgacgagtcgctgcgccgtgaagtccaggatctgagccagcgccgcgctagctgcaactccgcgcgtaccgcatcaggtcggggaacggcgctgacacggaggacaccgatgccggtctcatgctgcggaaaacggagcacggcatgagagactcggcgggggggggg

SEQ ID NO: 25773 - DNA, 399 bp, Oryza sativa
acttaaaacgactcaacagcttaacgttggcttgccacgccttacttgactgacaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgctactctttatgagaaagcgttcccgctttcagagcaatgttcaaagaaagctcatgaccaatttctagccgaccttgcgagcattctaccga

SEQ ID NO: 25774 - DNA, 746 bp, Oryza sativa
  unsure (1)..(746): unsure at all n locations
tcctgcagccccgcatctccaactagtcatggacaagctccactctcgacgtgcaggttggaaagggaaattgttgcaacaggtgggaaggaagacccttgtctcttcagtactaacctcaataccaacatacttcctaatagcactgaaacccccaaaaaattaccnnnnnnnnnnntgcatgattagaaaaagattcctctgggctggcgaccaagagattagtgggggcaaatgcaaagtaaattggccaacagtatgtgcacccaccaaacttggggactgggagtcttggacttagagaaatttgcacgagctttgagagtgcgatggctatggttcagttgggagagcccaaacaaaccttgggcaggaacacctcccccttgtgacgaaatggacaaaaggctatttgcctccgccaccaaggtgacaataggtgaaggtcgcaaagcgagtttctgggaatcaaattggatcggagagcaaccattgaaggagttagccccagccttatacaaccatgccaaaaggaaaggtatgactgtctacgaacgactagcaaatgaccaatggatactagacattaggcacaatctcacggtggatctagtcaaggaattcttcgaggtgttctaccacgtgtggaatagcggcgttgcactcacagaaggtgttgaggacaccataacttggcggtggacaccaaatggaaaatacagcgcaaagtccgcctacatagcaca

SEQ ID NO: 25775 - DNA, 702 bp, Oryza sativa
taacattacaggtaaatcacttatccaatcaacaattggaatatatcattatattcgatgaaaacaaatttttatagcaatgggttatacgacaatgacctgacgaaaaaatatatattgaaattaattgtattgcatatttaaattaattggatcatatatatatatattacttttagatctgcttgaacctactccttatacatacataatatttcgagtttctacttgatggatatagtttgtgcatacatacacaaatgatttattgacttacttcattcaatgatgatgagatccctattctagggtaacacgaatgaattatgaataatttcttaagaaatacatatagatagaaactttctactttcaagctctcatattatgtggtcgcaaagaatgaaaaagttacaaattctcaatagggccccactattcttctaacttattatacacttacgtgatatccccacatgattttccctctccatacgaactgtttgctcatcgataatgccgaagaatgacatatgcgcttatcgcatccacctccgaagatcttcgcaccttggctcagcctcgcattggagatcaagcagcgctcatatagggacaaagacaacatgcatggcaaggccccaccttctacgtgggagagagcccccgctaggatcctagagagagaagatggcggagaga

SEQ ID NO: 25776 - DNA, 712 bp, Oryza sativa
agtggcagaggcttacatcaacacctctatcggaaggtattgtacaggcttttggagattgtgcatgtaatgtatctgtgggggatgatctaaataaatggagcggtcacatgacgatatcttaaccgtcactgcatgtctaaagtgctcatgttttctgatatcatccaaacatattatctgccggcctatattaccgataaacataatgacatgactctggactatgggagaagacgtcatgtggacaaaagacattctaattgaatggaaatgaatgcggcacactgatatagtgaatgaaatgctgatcagactatacagccactatccttacaccgaaccgcatgcacaatcagtgcggagtgcctcatctattctcagccacttacttatacgcccatggaatatcacccaatcctttctacgcccatgagatacggtcgaactcttatataccattgggtgggcataagtatccataacatacccattccgttcgttgaccattagcaagaccgccagatattgatgcaatgactttattgaccttgcaatattgttaacagcatgcaaatgttttatgcagaagaaaatatggttgtgacaaccaatgaggactttattactaaacatctgtgatgatttgatggaaatcagacattatactatgagagcaggaaaagaactattgtcaaaatgagttgtgctt

SEQ ID NO: 25777 - DNA, 681 bp, Oryza sativa
tactgccagtaaagataattaaaacaacagcagtagcaggaagttccacgcccaatctaatttcaaaatgactgtaagaattcaagcatgaagataaataatggctgtcaaaatctgatatgatggcagtgatgtatataagtaaatttgatatgtcggcagtgatttgatataaaagtcgttcccctttcaattgactatacaacaaatctactccatcagaaattagaaatgttgttagcatattcagaaaaaaaaaagagtagagtttgatttagttgcagagcctctccagtctccaccatttttggtatcggacctgaaagccctgaaggtgctagttacagtcacagcacctttattttccttctggtatatctgcaagccttcgaaatgagtcaggacacaaataagctaatattagcattcgggagggatagaaagaagtaaaatccacaacaattttcagacgagtaatttcacatagaaactcataatttgaataaaaataatacgtcacatgtaaacaattcgattgtgaaatgtctaaaatttgcttctttcctccttggaaggcagaaccaggagttcaatccctaagacgatagaccaagagataaggaatatttacgtgaacacgcaataggtttgtgcgacagatcgcgcaaggcagcacgacgg

SEQ ID NO: 25778 - DNA, 1307 bp, Oryza sativa
aaggccctgaaggtgctagttacagtcacagcacctttattttccttctggtatatctgcaagccttcgaaatgagtcaggacacaaataagctaatattagcattcgggagggatagaaagaagtaaaatccacaacaattttcagacgagtaatttcacatagaaactcataatttgaataaaaataatacgtcacatgtaaacaattcgattgtgaaatgtctaaaatttgcttctttcctccttggaaggcagaaccaggagttcaatccctaagacgatagaccaagagataaggaatatttacgtgaacacgcaataggtttgtgcgacagatcgcgcaaggcagcacgacggggcgggagggcgaccctccggtcgagggcaaatgggcaggcacaggggtagggggctgtgcagtgaagtctttactgtgtatcgggcgtggcggcttaaatgacacgacgacgacgacgaatggaacaaataaacatatagggcaaagcttgagctattaacctattattatattttttgaaaaactcacctaatcctgtcaacgatgtcggccctgaggccccaaagttgctatccattggaaccctgaaatgcacaagtccaaatttattagagttcaatccagtacaaaccataaggcagaatctcagtgctgctgatggtagtttttttctcatcggttgatgtaaacgttcagaatcatagtcattcaacattcacaaatcaaagaaacttaatattcttacttatgagcatgacatgacaaaccacatagtcattcaacaatcacaaatcaaagaaacttaatattcttacttatgagcatgacatgacaaaccacgtagtcataaaaaatgggatattactacttgattgcaaaaattattacttaaggtatttgtgatgaaagaagggattcacaaagcttgaaacatgaactgatgataaacgaacacttgagctcattgcctacacctaacatttggtttaatacacggtaaaaaaattaaaccacgttgacaaatcagaattggaacaatatagggatgtttctagaacaagacgattcagatggcttgatcaaaaaagaaaatcaaaccatctcaagctgtatatacatggaaatcaaggagtagaaaccaggagttggccaggtgcgcaggcatggtctacgtcatcacatagatgattcagaaaataaatattatcagcagatttcctagagccaggttaatcataacagctggctcaaaatcacaccacggattgagctacttactggacatt

SEQ ID NO: 25779 - DNA, 7719 bp, Oryza sativa
ctgagctttgggcgaaagtttgctgatttgggccaagtttttgcccttactgttccttccaacctttagcttattatgtatacattttatttattttgttcagttgttttagcaatattcttcagtctgcaggaaggttgtgccctaatttaacacatgtgctggaatttacagtttaggtggaaatcgatactcgaatcctagttgcatattaatttgcatattactcgatacccaagtacccagtaaccctgactgcaaactaaactaatttggataagtctagttttagccttttaggcaccatcagaatggtcctggtggagatgcgctcgtagcgcagtggcaggggtcactggcacgcaccccgtcggcccgggttcgacccttgtcgagcacgctcaccaggggaaatatttacctcttccttcttaaaatcattgacaccaagttcttccttggtgtctaacttttcttttttagaatggtcctggtggttcatgaagtctttcctaaaaatccccataacttgaaaagtttttaacgcttcaacggaggagatattctgttattcctaattgcttttgtggtgctctatatttaaggactatggctgttcactcattactaatagaagttacaattctctctcatgatatccaacaaattatttattgtcatgcagtagtttcttaaattgcagtagtcccaaatcccgagtgtgtagccgctaatgcatatagcacggtgaggtgttttattaaatttgatttgctaccagctttgttatgtaagaaaatgatagtgcagtgtattctggcatgttgcaaggagccaaggatgttttcccggtgacgtactgatatgtgggaaaagaagtactagaatagaaagatcatcagtctgcaaattaaacgacttgaggaaaaaaaaggaattgcctattttacatctagtatgctgctaggacctttgtcctgggtttctgatatgttcattaatggcagaagttgcttgcttccctttatgcacaagaaattattttgtgtactctgttctttggacaatggataattaagccatgtgttctttgtcaagatccactattcaattgcagaaccgtggtgattgttactcacagaaatgttactgacaattttgttttcttcccctcttcaggaggagaagaggaaggcaatggcaaacgagttcgtggcgaagctgactgatgtttgctgggacaaatgcatcactgggagcattggaagcagcttcagcaacagcgaagcctcgtgtctgtccaactgcgcgaaacgctttttcgaactgaagatgctcatcgtgcaacgagttagcagccctaggtgaaaattcgcataggtcttttctgcgtcgagaatgtagaatctataatagttgatgctagaaactagagaggcatcacttgctttttgctgcattttatcagttttggtgtttttcctgctatacgttctcagtgaaacgattgcaagttttgctcttgcaaggagattaaaagcgctactgtactttgactacttttgacctgaaaagaatcagagacaagctcatagcctggagcagaaaatgtgttactggggtgtactgtcttgggagagaatgaggtgtgtgttgaagtgaaatgagttcaaccagctgatgcaataatgatcagaaattcaacacctccagtgttctgccatgaaagactcaagactgaactataccactgttcttttttactcagataaactacacatcaccgccgttctagttcgtgtttaagtagccacaattaattagttatcgtatattccagaggcacgtatctcgagattatccaacggtggatggtgtacgccagcgcttagtggcacactgacacgactgcatatccacatatacatatatacatttggcgatttcatctaggggtctccgatagtggaactgcctgtgccccttcaagctcccctagctactctcacgcattccccagcaaaggcgacatcctcaaggtacacactcctcatccagtgcttcttgatcagctttctctccattgttttttttccctctagaatcctaactaattttctgcaagtcctctagctagttcctgaccatctttttgtagcaaattcgtgtgatttgttagtgttcttatttgtgtgcactgtgtaaatgtctgcattgagtttaactatgggtttgttgaacaaatggatattgtatttgggttgcctgaatgaccacctcgaagttgcaatgcattttgctgccatctttttaatttggtgcctgcattttcggttaatttttaagggggagtaggtaggactttgaaatgttaatgcttttgtgggaccaattaactccaatcagaatatccatgattcatatgccatagaaacgtcacattgacacatttgtgtatctttagtgagccagcagtactcagccaacaggccaaagtatgcagactgttctgtttctgattgttcagaagttgcacttttctgattttgcagatctatttctttttattcgatttcttcggtctacgttgtattgcactgaacaatgcttttttttatattcatcttgcgcacttattcttagcatatcaaattctgagacatcattcatcatgctgaaatcatacaagtattatgttcagactatttaatgacttctgcttttgctactgccagaatttctccaagagttcaccatggagaactcggaagatgaagcagagagtgacaaactacccttagacttggagccattgcgctcattagcaccaaagtttcctactattttgggatatgatgtggaaactcaatcaactgatccactgttagtttatgccacaccatccataccttgctcctcatcagaacagcctcaagaagccccagcttcattttctctgcccttaccaaagtcacccgtccctataaaggctacacccatctcagcggcatttccaacaccgcaacatgaagatgaatcatcagatcaagattacaagcccttttgcaagaataaaaaaccagcgatgccgaagagagccaagaggccccagcaagctgagaaatccaatgatgctaacatcaagcgcagatcaataaggaggaacctggacaacgagttcaacttgtgctcatcctcatcagacaacccaaaggaatcggtggaaggaatcctgatgatgtttgattcacttcggcgccgtgtactgcaattggatgaaaaagaggatgcaagcaggcgggctgacctgaaagctggcactctcatgatgcagaacaacctcagaatcaacaatcataagatgatagggcatgtgcctggtgttgaagtcggtgacattttcttctttaggattgagatgtgcattgttggtttacatgcaccagccatgggtggcattgattacatctcttctaagaacaaagatgagactctggctgtctgcatcatttcatctggaggctatgagaatgacgatgatgacactgacattttggtgtacacaggacagggaggcaacagtcgtcacaaggagaagcacgatcagaagcttgagagaggtaaccttgctctcatgaacagcaagagcaagaagaatcagatcagggttgtgcgcagcgcacaagaccccttctgtaactcaggcaaaatatatatttatgatgggctttatcgtatcgaagacacttggacagacacggcaaagaacggatttaatgttttcaagtacaagctgagaagggaccaggacagcctgatggaatttcactttggaagatgactgagaagtggaaagcaaatcctgccacaagagaaaaggctatattgttggatttatcatcaaaggttgaacacctacctgtgtgccttgtcaatgatgttgatgatgaaaaagggccaagtcacttcaattatgttgctggagtgaagtatttgagacctcttaggaagacaaaaccattacaatgttgcaaatgtcctagtgtctgcttgcctggtgaccctaattgttcgtgtgcgcaacagaatggtggtgatcttccttacagtgcaacgggattgctggcaaagcacactccgatggtttatgagtgctcctctaactgtcagtgttctcataattgtcgaaacaggatcacacagaagggtataaaactgaactttgaggttttctggactggagaccgtggctggggtctgcggtcgtgggatcctatccgtgctggcacattcatttgtgagtacgccggtgaagtcattgatgaaactaagatggacatagatgttgaggaagacaaatatacctttcgcgcttcatgtcccggcaataaggctttaagctggaatttgggagaagaattacttgaagaaaaaagtacggctgtgataaccaagaactttaagaaactaccaatcatcataagagcaaacaatgaagggaatgtggctcgttttctgaaccatagctgttctccaaatctcctttggcaagctgtacagtatgaccatggcgatgacagctacccacatatcatgttttttgcaatggaacatatccctcccatgactgaactgacttatgattatggtacaagaggtgctccccctggctttgagggaaaacccttcaaagcttgcaaactcaaatcatgcctctgtggctctaagcattgtcgaggtttgttctgataaaagatatggaggctggtgtactaaagcaggtaaaacttgtttaacaatcgttccaatttataatttttaaaacaaaatctgcttcttcatgggaaatgcattcttccaacctatttatgcaactgaataatctcttttaaaagtagctgattcatcactccattcatgtaagtcaagaactctcaaaacaactctgtggttacagtcgcctgcagcacctatgtggcgattttcatgctttggtacataaacatctattttcaacttaagcttagcatgccatatatttattcaagaatgtatataatattgacgaactgaacaattagatctgaaactatggcaactctatttctcttgtgactgcctaatgcttccatcctacatttgcaggatattaaactactctatgaatggtagcataaagtgataaaggggctctcggtatttgtggtggtgggttagtggaaatgtgtagcaaggactgatgctttgcgtggcatgagatgagaccctcacattttgtgctgtacattgcccatgtcgtaggcgtgtagccactaatgcaattactatatcttttgctagttgctgtggtagcactaaagctctgttaacttagtggatgagatcatatggatgtgaagctgtagcactaaaccctgttaactctgtgaatgagatcatctgcattactgcatatcgttgtgctgctacgatgctatataggtcgtataggaaatatttgacttcatgtgcatatggttttgcagcttatgctgctgcttgatgatatgaagatcttttttttttgaaaaaaaaatcatgtggatgtggttatgctgttggtgtggaggaaatatttgaaaaagaaaaaagttatgctgttaaagttgctcgatgatatggagggtttttttgaaaaaaaaaaggtcatgtgcatttggttatgctgttgttattgagaaatatttgaattttttaaaataaaagaaagatcatgtgcatgtgcatgtgtttatgttattgttatggagaaatattttttgcatgtaattatgctgttgttattgagaaatattcgaatttttgaaaaaaaaaatcatgtgcatgtggttatcaagtgtttatgttattgttatggaggaatttttttgcatgtaattatgctgttgttattaagaaaaatattcaaatcgttgaaaaaaatggaaaaaaacatgtttgtgtctgagcccaggttcgaactggggacctttagtgtgtgagactaacgtgataaccaactacaccacccagacttgttgtcttaactgcctgtgctcgcctatttaaccagttcacgtttatttgacaaaatctcaaaatcattccttttcatatgaactatctagaggaagaatagaccacgtatgccccgaaataattctttttcatatgaactatctaaccacatatgcacgaattgcgcaagttataacaaactacaactgtttgaattctgacaactgatattgaactacgacggccaagtttcggaatttcatttcagttctttgaccacttgccatgtaacacttgatccgccatcaataaaatgattgtaaaaaaaaaaaaaactgatattgaaccatgcgaactacaaccgaatgaattgtggccctgtttagattccaacttttttcttcaaacctccaacttttccgtcatatcgttctaatttcttcaaacttccaattttagcgtggaactaaacacagcctgtgatctcaagcaaatgtgtgagaccagtacagcacatccccttaccacagaattatgagagaaatctacagcacattacgctgtataatgtacaatacaacacaacgagtatttaccagaaatctccacaagaacacaccccgtctctgaagtgatggaaccgggtacggtccctcatgacaatctctctaccatacacccgagatacaagctttgcgctctcatggcaatcggcacacacccggaggttcttgatgatcctaatgggagctcctggattggaagcgatcagagcaaaggcaatggcgagcctctcgctgtggtaggacagtgcatccgccttgtcctcctcctcgacatcaaacaacgcagatgaggtgctcgaccggtgtccgcactcgcttaatctggtctcaatatcctcaaccatggcgtatatctcctttgaggcaggatgcgtcttgtcacccaccaagaactcatggagaactccattgatgtctacaaagcttgatccagggctcttgtcaatgcccatggacttcatctccttcctcgccttcttagcgtcgtcccatcggttcgttgttgcgtagaagttggaaatcaggacatggtttccactgtcatccggttcaagtcgcatcaattctgcgatcatcttcttgccgagttccagcttgccatgaatgccacaggcccggatcagagacctgtatatcgcagcatttggcacgatgggcattccgtggatcagcttctcggcatcgttaagtcgaccagcccggctcagcatgtcaaccatgcatccgtaatgctcaatacttggctcaatcccgaattcgatctccattctgtcaaagtagtccagaccttcatccaccaatccagcatgggcacaagcacacatcacggacagcacagtgacgccatccaccggcacgccctcaccgtgcattctgtcgaacagggagagggcagcacggccatggccatggactgccaagccatggagcatcgcattgtagcagcgtgtgtccctgtccgaagcggctgcaaagacctgctcggccaggtccagcctcccgcacccggcgtacatctccacaagcgcggtggccacaatgcagttgacggcgagcccgcgtttcacggcataggtgtgcgcccacaccccatggctgacagcgccaagctcgccac

SEQ ID NO: 25780 - DNA, 10095 bp, Oryza sativa
tttcaataccacagtgttatatacgcaacccaagtggcaaaattaagctgcaagaagccaataaaaagtaaccatctcgcaatgttgaaataaacaacgagcataatcaactgttcagtctcagacttccacaaaccaggaaaaaacagtctcaggcatttaattttccatgtacagtacagaaatgataccctcaatgttgaagatgaacatgtggaggtacagaaatactgatcagagtgaatgctgccctttgcaacatcagatcattgaccattcactacaaaattaagttccatcgctaaaattgcagtatccaatgaatagacacccaaaagtgtgaagtagcctcacggtaaagaaagtatgctctacagccccctgaagaaatgtggttcatgtctactttcattatttagaatttggcacacttcgtgtggaacgagactttcttggagaatatgtggagtaatgttcagcatgcggccactacattgaaatttctccagcaaattgccctttatgtcgtagtgaaactgccaatcaaatccatcaaccaagacatcaccctcttgagaaacaatatgaagataccaaccatcatcttcttcaaaacggcgaatctctataactggcaattcaattcgatacttgtggacccataccatatgcttataatcttgcagaagccaaagatccacctttgatgatccaatatggctgtttgacatggcaaggctaccctcaatctcgagtaatgacgacatattgtgcatcttgaaaggtacatgcaaccaccgaaacacctcatcgagagtgtcgaacaccactatcttgttctgtccacctaagtgcggcagccagtgcaggtttccatgaaacaggaaaggctcgttgaactgagtttcctccttccctttcgccaaccactttctcagggatgctgacgatgaatggggccaaatgctcctctccttccctgagccaacaatgctgatgtagaattcagggcccaaaccaatttctcgataatacaatactcggtattcagaagaatggccatgagaatagagccccaggacggtgtcatgttgaagcgccggcgggaagacccaaagccattgacgtgtagtaggattgcagagatgcaaatagttgttgtaggacatgagaaggagaccatcgcaagaagcgtggacggtgaatgggctgtcttcgagtgagcagtcgtaatcttggccagtgaaccgggccagagactggaactggtgtgtgcggaagtcaacggcttcaacacagtagtccaggatatccaggtcatcgtggcgactgcccacgtcgcggatgaaggtgaggaggcgctgcggaggctggcggcagtggtggggaaggaggaaggcgcggtcggaggtgacgtcccgccagactttgcagacggcacggcactggaggatggattttggcggtagcaggagcagaatctccgacagaatttcttcagggaggttggcaatggtgagaggcctacgacgctgctgttcgggcagcctcaccatctccgccattgcaattgagcccccagctgacaatttggactaggaccctagtgctgctgcatccttggctccttgccgctctgaaactgaaatggccaaaaatttcccatggaaagagagcacattaggattccagaccgtcaagaacttgaaagaaaatacagctcaagatgggtgttcggatctcacatgaatcaatcatctcgttttgtgatcgttattcatcctccctccgaatcatcagagtaagtgactgatcataactgataaacaaacaagcaattaggactggatctgatcagggaaaaccaaagcctggactgaggctccaactccattccaccagcaaaagtatttaacaccaagaatcacactgaaatgaaaaggaagattaaaacactaatctaaaatacgaagaagcaaactaaactgaatcatgtctgtccctcagaatgcctattctcaacagtgcacatggaattatcgatcgatcggttccttcaacctcacagcatattgcagtggagggagcaccaactgaactgaatcaagtgctcagattactaaactgctcatcactgggacagaacacatgaaaatcttcgctaatcaatcaatcagacatatacagagacagaaatacaggggcaaactaaaatacaggtaggtagcaatggacagcaagggattggtacttactactccatggccttgagctcgagccaggcgggcgacgggcttccgcttctgctgcttccaagtggaggaggaaatggcgctaagaggccgcgccgccgcgccgcagtggagaggatgagaagaatggaggcggcgccggcgagatgggcacagttaggttagacctaaatatccccgcaaaaaaaaaaggttagacctaaataaatgtaggtgggccaagagcccaacaaggaagccgagagcccaaatatgcaaagcccatcatccattgctagcatcttcgtctacctcatcatcttctccccaaaattgcaactactagaaccctagtccagtgcgacccaaaacccaagctcctcctcacaccattgcagttatttgcagcatcagcgcaagcaccacccatgtcgatggcctccaccctcccgctcctcctcgtgcaccgctccacccctctgactccgaggcctacgggccgccgctcctccactcccgccgcctcacccttctttccgcctcgcctcgctccccgcgacaatcgcagtcgtccacccgcgcaagggcgtccgcctctcgaagctccacgccgcctcttgctgcgattccgcctccgccgccggagtcaccaccggaggaggagctggtggtggtggagcaaaaggagcaatggattggcgtctcctgttagcctggtaagtccaattccgcctcttcctgattcctggtgcctcctgcggccaagcactgcccatgttcatttgcctcgctttttgccatactcatatctaaatgcaaaattactgaaatgcgccatgatttgcaggtacctgctggctcttgataagcatcccatcaccactaaggctgttacctctgccgtcctaaccctgaccggagacctcatctgccaggtgacttgcagttgttttctacttcccgcattttcacatccatccattgcaaccctagtggattacttagtactacttaattggttgacgaacaatgaaccagtagtctccctctcttcttgtagagggcttcctgtcactctgcaatagcacattgccaggcgtgcttagatgggtattagcatcaaatggtcaaatcataccaattttccttcaaaacaacattgaaatgttatccattgctaataccacttggaaatcaatttaccgagttatggttcttttctgccttagctgcactcttttagtttccttgttttctaaatatgacatgatgtgaaattcttaactggctaggctattatggtcttatcaaatttcaggtccatatctttttatccaatcttgcgtcaaccataatctgaatatattgtctttactcaactgtgtcagtctttagcctatgctaatccgtaactcatatgattcctcaacggattttactccagcaacagtgtcctattccattattaaaaaacaatgtatattcctactgggttgcatccatggattgggcaaaatatttgatatttcatctgttcttgttattgtggtatcttgttacggtttcttacaagatatttactgttaccattgttgtttgctactgctccagcttgcaattgataaagtgccaaagctagatttgaagagaacgtttgtattcacatttttgggacttgtcctggtggggccaacattgcatgtctggtaatcgcaaccaatgtttattgaggtttaggatagcatgtgttctctgcccagtgctgtttgtttcattactcgttgccacatgcaggtacttgtacttgagtaaattagtgacgatcaatggtgcatcaggtgcaattgctcgcctcttacttgatcaggtatgtgcatgtccttttcctctttcccttctgcccccagagagagagtgttgctgcttgttctgttctagcttgtttctgcatttatgtatttattttttgacattttttttatctcctcctttcagttcattttctctcccattttcattggagtgtttatgagtttactcgtcaccttggagggaaagccttctcttgtagttccaaagctcaagcaggtgacatgaacctcttctgattgattctctcatttccatcgcagatcctctgcagtactgctgatgcagtagcagtggctgacatgtgggtccgggtccatacgtcagtatctgctactgtatcagcagtactgcagataatccccactgctccctgataatatgtatgtgcactcatttactgctagctaattttcaattgtaattttacaggagtggttatcatcagtgattgcgaattggcaattgtggataccctttcagttcttgaatttttactttgtcccacaaaaatttcaggtctttgaaatctttcacattttcatttcataaaatattttagagtgcaatactgtactctggagctgaatttgcttctttctgtctgctttagcatgactgaatgctgttctcaccttactgttaatttttccaggttcttgctgctaattttgtagcccttgcgtggaacgtgattctatcatttaaagctcacaaagaagttactgtgaaataggtaatctgggatggtatatatatggacatgttatatgatatccttacttcaggttcccatattaatttgttgaggcgagtgtctgatttaataacttttccaacaagggtacattggcgatagtgcatatatataacttatttcctgatttatatctaggtgatatcaactacatttcattacacgtagtagtaggcattatgtacgtctctgagcatccttttatttcctgttgttttcaatttcaccagccatgtgagacactttgacttgttcttgtaaccttgcacaataactctttgccagtgtctcttattcccggacttattttctgccacccctgaaaacaaccatgtggacttgttatggaattattgtagcttgacctccccaaagccacacaaaccacctttttgtaccttttgcaatttaaaatgatgttgattggttctaaaggtgccatttgttcttttgtttcttgtgaggaacaaccagtagtgtctctgaaggcaaaagaaatggataaggtcaaacaagactgttttgtcttgtaattccacatagctagtagtaaaataaatcaataaacccccagcctggatttgaatctgattttcttgttgtgtttaaatgttccagcatttctaattcactcgttgattagatttatcattgatcagtttatcagtactaatattttttgctctttgcattcgttctaggtttaggcagattcggatatatagttggcgacacggagaagtacgcagtggcttgtcgcagctgcagtttgctaacgaatgagctccacgtccatgcccggcgagcatagctctcttttgtgcccctaacagttgaggtgtagaaattctttggtagtgaaatatctagggcgtgttccttactggtattgctgtactgaaggcggcaaagtaagtaaccatatcaccgtgatggcatgcctgagcctgcaaacgcatggtgttgagatcttgtacattgttatatgtagtaggtcaagtgagtaggttcaaactgtcattatctgaagcagtggtgtactgtttcatcctgccaacgcggtgtgatcagtggttgtgtgcgccagctgactctgtttatctgtctggcaaacacagtcggtgcctgttttctcttgggcttgcatccttcctgtctccgttgtgtaagcaagggttgctgttgatccagctgacccgacagtgatgtgtttagcatgaacaacacagttctgccttctatttttctaaagatgttgcagcgatgtgtaacaatgttcatttatgacatgagcatgacgcaatgatgatgtaagcatttgtgtgtgcgcgcgcgcgggggcgggaggtaggtcaggtcaggtgggctgtgaggaatcacatgcactgtagaggtaaggcatgctgggtccaaacaaacaacaagtgagaagacattgatgaggacggcagcggagaccggagaggaggcaaaccaagcagtcaattgcatcgatcgttgcaagtgcaatggtggtgtcccctcctgcgtggccggccagcggccaacatccatccctcgtcgctctcactgcgtagccataaaaataagtgtgcttttacaccgttcatatctaatgtttaaccattcgtcttatttaaaaaattttataattaatattttttattagggtgaatacctaaaatgatccttgaactttcgcgtaaggatcaatttagttcctgacatttcgtattgtccaaacaagtaccttaagttcattgtgtgatttaatatagtccttagatcctctaaacatgccatgtgtatatgccacatcattcaaattcaatatttaaatgtctggttttgaccattggcaaaaatatgtagcattgatagctaaaaaaattgacatttttctttgttttatgattgcttcttcttatttttcttttctttatttgatagaaaattgaagattaaaatggacatttaaatgttgtcttacatgcatgaatgacatggcatgtccacgtggcgttttaagtgggtctaaggactatattaagctccatgataatcattagggtcttgtttggacattataaaacattaaggactaattcgacccttgagcaaaagttgaaggactaaactggctattcatcctttttattagatgataaaatataaatagtagtattttatgtgtgacttttttaaaaaatatttcaaataagacggatggtgaaacgttggacacggttactcatggctgtacgtattttgggacggaggggaaactatgaactacaaactcattagagtagccgcgaattttgactggcagctgcatgctggaccatgaattctccttcttgttaatttacaaaaaaatatgctaattctactattattagtaagttattagtagtacggtaaacgacatcgagaagtaattaggacagccgttggtttgtattgtactcctatgtgttaacatcgtccaggaacggacccagacttttggcggtttggaccgactgcctgaccatcatcacatcaggaccaggggctgctaagtgctagccagagccacacttgttgatggcacagcacacgtacactgcaaatcgaggagaaagaaatcacacgcagactcagtagtcaacagctcgtgcctctgattcttcctctccgttgatatagtcctttccttgtcaacttccctttttgcattgtattttaggggcaatctagaggtggttacttgtaagcaccaaacagctcagctctagatcaagcctacatatgtgtttaacaaatacacttcaaatttgttttttcttcccattaagcatgcatgttgattccacacccaatttgtttcttttttttcctttcattttccgccctgcgtgttttatagtactctttacaatgaattatatctatttatactatcacatcaactattgatagtacaattatgttaatatcacttctactgacgatgctactggtagatcaatgtaaagttagttgttagttgtgtagcggtggttttcagtcggtttttctgtaattaaccgtgcagttgtataattttcggatccggttttctttataaactgggtcaattatcttcttctaaatataaaagtggaacaaagttccgccttagatttcaaaaaaaaaaaatgttactcttccgccgaaccttagtatgcgtgtgcatatatgattgcaatactttatttttctaaaaaaaaacctggctcgatgattacgatattattattgttgtatctcacaatcaatcttttccaagtactgattctcaaccctgctctgctccaattgaactgttagcttcatcctaacgtatcttagtgtctaagcagcatttacatgctactgccccccacagtggtttggtgcattaattgattatatagctaaagctgaattaatgcactaagcacctctctaaaatgtactaatataaaaaaacatcttttgttacattttgttcaccaaatgatcagaaaccacatgttcagtgagatggtgctggagcagttgtactgttggaaggagtgtttatcaagactgaaaaccaatggaaaagcaagagccaatcaatcaaacaaagcaaaagagtttcacaagaatcaaatcctgcataaattaagaaccttgaggctgatgcagtgatgctggaaacagcagaaggaagagcaaaacgaacttaacagtcgcctcaattaaaagagaaggaactccaaattaaagttagatcaataaaataacactactgataaaaaaactcgtccatgtgtatatgaggcataagcttaaaattaacaaggacacgaacagagaatcagagagatagatgctccaacctgttcatcgatcttgtcttggttaattacagccatgaagaatcggaaatcgacaatatatgatctagatttacaggagatcccatgagtccaaggtggggaagccccaccacagttgcgctgctgctactgctgctgttgttgctgtaactattacctgctcctcctaccaacgccaccgacacgtcgcacggcgcggccgcggccgtcggctccgcgcggcggccgagcaggaacgccgaggtgtcgagcgtgggaagcatcagcgcgcctgcagggccgggcgagcccgctggagcggcgtgcggaggagctccgtcgtcgtcggcgagagagatggaggaggtggaggcgggaggtcgtcggcgccggtgacctggtgcaccatgcggcggaagttggccggatcggcgctgatgtaggtggtgggcaggcgccgcgacgggcgcggccggcgcttggcgatgcggcggctggtgctggcggcggcggcggcgccgcggaagtgacggtggagagtggcggcggacggcgggggaggcatgaggtcgggaggaagccaaggggaggaggaggtggaggagtcgagcatgtgcatggcggcggtgagcatcgacgatcggtggatgctctgctgcgagtgttgcgcgcggcgaacttgacaggggatggacggacggttgaggggagacaggggggtggcctatatatggacaacttttttcttatttttattagtttcaaataaatttagaaataacccttgatatttttcttcttaggaaatgaatcttttaggtatggtttggataccataccagtgttcaataaaataatataaatataatgataaattatgtcatcaaaatttcatatgcaaataaatttagaaaataatagtaattacagagaaaaaatgattatcatgaaaaaaaactcatctgtctttactctttcttacatgaaaatgatacatgtaaaaaaaaacttgcaaactttttataaaaactacgtggcaaattgtgacttcattttgacttttattaactaccaatcggctagatcaaatggttgagatcttcctttgtaagagttttgtaaaaagaaaaattagtatgtataaaccttactttttcttaaaattatcagggtttaaccttatctaggaaaatggaaatacattgccaatacttaaactttagcagatgtgcctaaacttaaaaattgcatgttcagttctaccatcttaatttaatgaaccacaacagtccaaacctcgtttgaacaaagttgaccaatgatgtggcgctccatttaggcaataattttccatccaccctccaccgtg

SEQ ID NO: 25781 - DNA, 1268 bp, Oryza sativa
gatggtcttgagcctcttgacacacacatgctcaggcgcttccggaaaaagatggctaatttcttcaacaagtgcaagcatcaccataagatcgctggagctatccaagacgtgaacaagaaagtcgaggaggtggctgcaaggcgtgacaggtacatggtggacaacattatcgccaaggttacaggtcctgtaccatcgatcctcgccttcaggcgctatacaaaaagacgacagagcttgttggcattgaaaagcagagtgaaaagctcgtaaagatattatcccttggggatgatgttcatgcctccgacgagaaaatgaagattgtctctattgttggatttggaggactcggcaaaaccactctttccaaagcagtatatgacaaacataaactggcatttgactgtggggcttttgttccggttggtcgggatcctgacatgaagaaagtcttgagggatattcttattgattttgactacatgaatccaaatgtgatgatattggatgaaaggcagctcatcaacgaactacggaaactcatccagaacaagaggtatgaacatctacgtattcatcagcagttcagcatgtgaattttgttttagtacctgaacatataagacctcaccttcaatgttgcatcgccctttttgtaggggcatgtttgtatacagaaagcacaaatgcttatgcttgcttttgaccaagattcgtgtagaaaaagttaacccaaagtgctacaattatatcataaagcattgtaaggtagcacaaacatatctaaatttaccgaggcaggactaccactacaatagaataattgggtcacgcacagcctaaacttgaatgtacacatgagcagatgagctgaaataagaatattaatgggctggtgcattatagcatattatttatgttgtcaatgcgcatggtcatgaacaattgtttgagaaaatcatttgggtatgacatattaggctataaagcaaaatgcatccaaaggtaactgaggcacagtcaagttgattggacaagaacattgagaatatgattgatatctattatagttatagattaaggtttagttcgttttatctgatagatcgtggatgatatgcggcatatgctttctaagctgatatacagtatggctattataaagagtttcttccatcaacattgtttaaaaaaagttgtatacaacttgtaactttataatatttgatttattcaccctagatcgactttctacaaatggg

SEQ ID NO: 25782 - DNA, 682 bp, Oryza sativa
  unsure (1)..(682): unsure at all n locations
gctgcatccttggctcccttcccgctctgaaactgaaagggccaaaaatttcccatggaaagagagcacattaggattccagaccgtcaagaacttgaaagaaaatacagctcaagatgggtgttcggatctcacatgaatcaatcatctcgttttgtgatcgttattcatcctccctccgaatcatcagagtaagtgactgatcataactgataagcaaacaagcaattaggactggatctgatcagggaaaaccaaagcctggactgaggctccaactccattccaccagcaaaagtatttaacaccaagaatcacactgaaatgaaaaggaagattaaaacactaatctaaaatacgaagaagcaaactaaactgaatcatgtctgtccctcagaatgcctattctcaacagtgcacatggaattatcgatcgatcggttccttcaacctcacagcatattgcagtggagggagcaccaactgaactgaatcaagtgctcagattactaaactgctcatcactgggacagaacacatgaaaatcttcgctaatcaatcaatcagacatatacagagacagaaatacaggggcaaactaaaatacaggtaggtagcaatggannnnnnnnnnnnnnnnnnnnnnnnnnnnnnnnnnnnnnnnnnnnnnnnnnnnnnnnnn

SEQ ID NO: 25783 - DNA, 704 bp, Oryza sativa
  unsure (1)..(704): unsure at all n locations
nnnnnnnnnnnnnnnnnnnnnnnnnnnnnnnnnnnnnnnnnnnnnnnnnnnctaagtaacactagatattccttaagtactacttcaaaaaactcttaaaggcaccatctagtatattgtatatattgctttgggtccatgatagtgcggagtttgctgttttaaaccttatttgtatctatttgtttctttcctgctcatttcaatattggggttaacaatctaacttactgtcatccactgacgtgtatggctggctgttcagctcgtatggaggcaatgatgctgtcaaacccaaccaattgccggccacacatgtgggcttgcaaggcgcacagtgtgcaattcatgatgcagatattctcgctcaagctatccaatatcactgctgctgttgatggcccagttcacttgtatggatactttgctgtccgggatcatttggacccgctacgcaactacatcttcaaccgcaccagggatgaccctttcatcatgggataagacaatggcgttgattcggataattcattgataccaatgtcaggccccaagagaggcattggaaaccaagttcgtgtgctcatcgagtttgacatgaagatcaagaacggagagacacaagacgatgattttcagctcatcgatggtgccatcatctgcagcgaattcgtgcttcccgatagagtgtttacgcaacggat

SEQ ID NO: 25784 - DNA, 871 bp, Oryza sativa
agcagcagcaagagcagcagggggaggagctccatgcctcgcgcgttgtggcgccaaccaaacacacacttcgtcaacttcaaaggggaatagattttgccgatttggagggtataaactaaatttgttaatatatcaagggtgaaatggtaattatttcatctcatgacatatttcgaagagacccctgtaacaaccaaaattactggtcttggtggaatcgcagcggcctgcagatctcctcttctccgactcaatcattcgccctgcgctgcacaaggggaggggaaggaaaggaaaaccaattggatctctcaattaatcgggtcaggagcaagcggcctccacgcaacgcgggaggtaatcaggtagtgcgatgccactgcttacctgcttttctgttcttaatttcgccgatgttttcccctctactgaaatttctttaaactgtctcgaattgtcgatgcattcgcggggaagggaaattttctgttcttgttcgtagtttcttggctcaacctctccatcggctgcagtttgggatttcaatttgggcgccaattatgggtagctttcggtgacatctgactgttaggtttgtcagcactcaaccaaatggcctggccgcgagtttgtgcaaatttctttcgtccttttgttgaattgggcgtaaatttgatgtatgctcttgcctacattacttgtagttatgtggaacacgccgagcagaacaatttcatggtcttagtgtactctgatacaagtaatgttttcttgagtttggtgggagatgtcaaactttgtttgctagcactagagatggttggttggttttgtacttgtatttcatgttgacctagagcatgttttg

SEQ ID NO: 25785 - DNA, 715 bp, Oryza sativa
  unsure (1)..(715): unsure at all n locations
gtcatctattaaaaaatggagggagtatataattagaaagaagattgctttggttggctatgcaagcatgccaacgagagagcagaccagcacgtcagagcttgggctttggatatgggctcaacagggaagcgatccgtttcatcgctaaaaaaccgttagaggtcaggagagaaacgtttcatcgtacaaacatcgtacaaaaacaatcgtacgtatagcagtgctgatagcagaaagcatattcacaaatcttgaagcacaaaggaggtaaacaaatattatttggctctgtgacaataatctaacatctacaacactataaaaagtgatgtctaaacggcacaagtaggttggtgcagtagcgcgtaagttgcaacttaaaccttgaagtattaaaccttgatgttcaccctttggctctagaaactattcctctacattgttatcagccactgaggagtattatctcaacattgtagtattacctaccaacagagattgttttttttattttacattgacaacaagatccttgataccttgttctttgaagaggttatatgcctccgtccaatctgaaatagtaaaacaacgaacaaatcgtaagtgcaaaatatataaaaggtatcagaaaatccctatcagaagtttcannnnnnnnnnnnnnnnnnnnnnnnnnnnnnnnnnnnnnnnnnnnnnnnnnnnnnnnnnn

SEQ ID NO: 25786 - DNA, 725 bp, Oryza sativa
  unsure (1)..(725): unsure at all n locations
atcagatagtatgagaattttcgattaagacaaaataccaaaaggatttgtttttcgtaagcatgtttgtgttccagcagactgcagaagaatttattcatgtccattcagaagcaaattatgttttatctggaagatcgatcaaaataagtgcatatattacaccaaaaataactgaagtacctctgttactaacaagttcagcccatattccaccagcccctgcatggttgatttcctacaatattagccaagatcattatcatcaggacatggtggaacatgtataatctacctggattattctgggcatgctaatgcacttgagcatcctaacaaaaaagtgccagaggaaaggatatagtgatacagtgcaattgtgaaaaacagaattactgtatatgtctcacggcttacctcaaaaaatattccaaatagtgtgtcagggatctgtcgagcaagttgcggtgaggcatcaaccttgaggaccgcagtctgggtcgcatgtaagtgtaactctgaagctatacacttgcagccgagggagaacagaagcaagaagaagaaaatggtactcatgaaggattctctggaagccatacttggagctgtaaacactagtgcaggccgtgtgtctgttgaacaaataaagccagaagatgatacagtatnnnnnnnnnnnnnnnnnnnnnnnnnnnnnnnnnnnnnnnnnnnnnnnnnnnnnn

SEQ ID NO: 25787 - DNA, 673 bp, Oryza sativa
  unsure (1)..(673): unsure at all n locations
aagataaaagaaattccaagcttttccatctaacatctccttcattagaccagaaacatgcttgcttgcaagctacctgacaatgcaaccgtccacggactgattgcatatcgtacaaaaatttctgtaacacaaaacagcactagtcaaacctgaagctttcatggaaccaaaccatctctagaatgagcttgcactccaatttgttataatatccaataaagcacacactctctcctggtattactgtagtaatgatcaaatttcaatgttcagaagaaacaccattaaatcatgaattggatttaaaacatgtgtccttccatgtaacatagtcctacagagacagctgccaacagcagtcgatgcaaacttctggttttcatttggtataacttaaaaaggatgaaatgtgcaaagatattgcaaatagaaatggatgttgtagaatcaaatgcgaactgtttcagagctatccacaagaatagatataatatttctttatagtactaacagattattcccaagtaacaaaacagcatgcagatcacatgagagcaatgcaatgacgaaaaaatcattagtagagataatcctatggatatatatacaatagagcannnnnnnnnnnnnnnnnnnnnnnnnnnnnnnnnnnnnnnnnnnnnnnnnnnnn

SEQ ID NO: 25788 - DNA, 798 bp, Oryza sativa
  unsure (1)..(798): unsure at all n locations
nnnnnnnnnnnnnnnnnnnnnnnnnnnnnnnnnnnnnnnnnnnnnnnnnnnnnnnnaattgatgaataggatggccattttttttattattaaccttttttgggtttaaattttaaataaacatcccaaaacttatttttaaaatttaaaacttttaaccacgccaccccggctggcataacgaaactaaactatcataaactatcatgttcatcctcatttgacttgacaatattatttcgccacatcagaccagccagtaccattaaaaggtctagttttaaaattaaattttgtaagagttcatttttaaattttaaaaaataaaaaggttcgaaaaaaaagttcatcgatggccgacacgagacggcgactcgatgtcgatggtgtctcccatgcaatgatgtaacgttttccttcccgtgatctcctttttccgggacgcattggttggcatcgttggatgaggaatcattttttgtagcacccactttaattaatttggcagtgagccagtgaccgtgacgcagatacatgaggatgcactgatgcagcacagcagcgaggccggacaaacataccatttatcgatgacgttgataccggtagcccacatcgctggtactacttatattactcccattcatccaagaaaaaaaagttaaattctaatggtctttaaactgatgaagataaagttacgttgatgtatataaaccgagaaggttataggaaaatagctaattaggttttaattttaattataatagacttaccaaaataaatatattaatattt

SEQ ID NO: 25789 - DNA, 1333 bp, Oryza sativa
gtttagagaaaaacaggtgatccctttagttcctctaagatactctctccttattttgggtttagagcattagagtatattggcaatttggcatatctctgtatttggaagtttagtatttgtcatcccgatactgacttatccctaagaggcttttcttatctcgaagatagtttcttaacctccaagccatgcatgctatataaacagcccttgaagcttaatacaataattattcatcttatttcgccaatccctctcgtttacacagaggaaatataaaatcatgcatataatgttgtctccagattatgcatgaacataaaagatctttgaagggattcctagacaaatggttaatttgtctctacaattattatctcattcttctacttcaccacagaaggaaaataactatttcagaaattataggaaaactagtatgtataaatttctaatttgtaaatatttctttttgcggggaagaggaagctttattaaaaaaacaaatatttacactgaattggactttgcttgcttctttgcagcgatgtcattcagatggcaagctatgcaccactcttcgtgaatgaaaatgatcgcacgttagtattcatggtttagtactttactttgtttaggattctagcatctgttctctctttgacaattaatgtgtaaatctaaaaaccagctggaacccagatgcaattgtcttcaactcctggcaacagtatggaactcctagttattggatgcaaacatatttccgtgaatcaagtggttctgtgattcatccagtcactatcagctccagctactttgatttactggcagcatctgcaatcacctggcaggacaatgaggatatctttctgagggtaaaggtaaaccaaccattccagtttctccaaacttgtataccattgcttgaaatcattgatcgacaagcgccttagtgtttagaataatgtagtttcaacaatataaaattgattgaagcaccggttacttgcgtaacatctgtcttatttgttctactgctggagtaatatgctcatatatattagaacatactgattctatctgcagatagtaaactttgggccaagtgctgtgaaccttacaatatcttcaagtggacttcaagctggtgtaaatgcggcaaaatcaactgtgactgttctcacatccagcaacttactggatgagaattcatttagtgaaccaaacaaggtaagatagtcgttatttgatcactatttgtttcataattatgcactgaaatttagcagaggacagcttttccattacaacattatagtctgttagg

SEQ ID NO: 25790 - DNA, 2577 bp, Oryza sativa
  unsure (1)..(2577): unsure at all n locations
tgacctcatttgatctggctatgttttagaacacaagttgcagggtggtatattgggactgggaatgatgtaatgtcttaatatttatgcaacttcttttttttttatagtgagggctttatttgaactttagtatgtacaacaaatttgattttagtatgaaccacctcttttttaattttgctgacagaatcagcaagcctggcagaacagagagggattgtaatcacccgtgtagacatccactcgtttattgcatgtcaactaaatggttataaaaatgtttcaaaaaaaatttgacaatatggtttaacatgtaatatatcactccacaaactacaagttataatttggcttccataagttgtaacaaaaacaaacaaatttaactatgaatatacgtaaactatttagagtttaatttgttgttgagtaatttcactttagaccaccttttattaggatgtttcgctttggaccacccttaaaccaatgtcttcattttggactatataatcttgctgttgtttcactttggagcacctcgactctcttctaaagcatatcaatgaccttgagtttgctcctattcgttaataaactttctcactgtagtgctcatctctgatgacagtgcttataccattatgttaaagaaatacataaataatttagttaaaattttaaatttgtagctgaaagtttttaaaatttgagttgaaaatttttaattgaaagttttaaatttggtttgaaagttttcaaaatttgagttgaaagttttcaaaatttgagttgaaagtttttaatattcgagttgaaagttttcaaactcgagttaaaatttttcaaatttgagttaaaattttttaaaaattcgagttaatagctttcaatatttgacttgaaagttttcaaaattcgtgaagtttcttaaaatttgactttacagttttcatgagttaaaagtttttaaatttgaattaaaatttactcaaaattttcaatttaaaattaaaccttctgttaaaaagtttaattaaacttactaatcaatcacggtaaaaaaaatcagaaatacagtgtcaagcacgatagatccggatatgctgaaaaatcgagcgcgaaaaggaaccgagacagtagtcaaaagtaaattactatgtctcctattctaggcataggcctactatgtctcctattctaggcatactaggagtaggcctgtaggatccatatgtcttctaattgtggaaacattagagaagataaattagggaatacataaataccattagcagcatgtaaaataaaaaaaacatgtttaagatactccacttgcgtgcatgctaattttctctaaattgcaaatccatttcaacctccctttatctttgtttatttgagaaggagatatggccatagagggaaataaatagctaattatgttgagaaaaaacagattagataatcgatctctctttcaggatttcaattcccaacgaagaaactcagcggcaggcttggcaaggccgaaggagtcgtcgtcatccgcggtgaccggtgacgtcacgttgctcttgccgaaaccattctcgcattcctgcaccgctggccgacttctccagcgctgaaatcgcctccggcaaccggccgccctgcacgtcggcgacgatgccaggctgagctcgcagcacgccggcgtacgccgcctggcacgactggaggcaccgcctcttggcgtcgccggcgccgccgccgccgccgttctggaggatgccgtctatcttggacttggtgctcgtcgcgttggccgtgatgaggtcgacggtgacgacggcgtagtccttgaagccggcggcgtcgtggctccggttgtcggagctgagtgcgtagatgcagaacgtgacgctgaccaccccgctgttgccggcgacggtcttgcatgcaccgtacagggccgagtcgatgccggcggcgagctgagacgccggaaggaggacggcgaggaggaagaggatactgacgccattaatggaggacattttcagtttcctacgtatactggtggatttgatcttcgatcaacctatgtaagatgatttgttgaattggatggttttctgaactcccttgcgggtgagttatatatgcacaaattttgcatggctttaaattcccagttaattagtgattatgtggatatgtagaatcaattattgatatattcttcccagttaatttctccctccaattatgactgcctgccgcgaattgatacatgcgtaaatttcattctattgattttgccatcaaaacgaaaaaattaattatgtaccatccaaatttacaatcctttcgaaatttactgcctaatataaaatgtcactccacaatattgcaaaggaaaaaatgtcacccattagattgcaaaggataaaatgccactcagtatactttaccactttgagcagttttgagaccaaaatgccctcaccgtggannnnnnnnnnnnnnnnnnnnnnnnnnnnnnnnnnnnnnnnnnnnnnnnnnnnnnnnnnnnnnnnnnnnnnnnnn

SEQ ID NO: 25791 - DNA, 1174 bp, Oryza sativa
  unsure (1)..(1174): unsure at all n locations
nnnnnnnnnnnnnnnnnnnnnnnnnnnnnnnnnnnnnnnnnnnnnaactttgataggttccttcacgaaatttataaatgcaccttacaaatctgaatgcttggagttatatgagatgatggatgaatattgcagggtaaagattatgtcacctttgacaattaaatttaatgtcgaatgatttttgcgcatgtatactccattttgttcgattaacttgatatctgaattgtgttttaggagcctatggacctgtttggcacagctccagctctaactctacccctcctggagctggagctcagccaaacagtttcagctccaccaaaactaggagtggagctaggtggagctctctcacaaaataaactagagttgtggagctgggtttaggcagctccacaactccactccaaacccaactcctggagctaaatttaggagttggagctgtaccaaacaggccctatataagattatggtgtgaaatacaaaagggtcaagcatgtttctcttgaaacttctgataggcattttctgataccttttatatattttgcacttacgatttgttcgttgttttactatttcagattggacggaggcatataacctcttcaaagaacaaggtatcaaggatcttgttgtcaatgtaaaataaaaaaaacaatctctgttggtaggtaatactacaatgttgagataatactcctcagtggctgataacaatgtagaggaatagtttctagagccaaagggtgaacatcaaggtttaatacttcaaggtttaagttgcaacttacgcgctactgcaccaacctacttgtgccgtttagacatcactttttatagtgttgtagatgttagattattgtcacagagccaaataatatttgtttacctcctttgtgcttcaagatttgtgaatatgctttctgctatcagcactgctatacgtacgattgtttttgtacgatgtttgtacgatgaaacgtttctctcctgacctctaacggttttttagcgatgaaacggatcgcttccctgttgagcccatatccaaagcccaagctctgacgtgctggtctgctctctcgttggcatgcttgcatagccaaccaaagcaatcttctttctaattatatactccctccattttttaatagatgacgcc

SEQ ID NO: 25792 - DNA, 716 bp, Oryza sativa
  unsure (1)..(716): unsure at all n locations
aaggaaccctagcaaaagcagaaggaagtttggggatgaaatggaattgacgagggcattgagcgaggtgaggtgggggaaaatgtgttggcgattggcgggaagaggcgcgaggagacgcgggaagagaagaagagattggcagcgcagcgggccagcggagcaggacggcagaacaggacaggttggcgtgtgcgggccgaatacaaggcccatgtgatcgagcccacccattgccgttggtgagaattgagcccgacccaatcctacccgcccaagtatttcaagtgtagccgatgcatggtttaagccgaacgggaaaggacaaaagtttattcgaggcgcctcatgttgttgttgagtttcaaaatcgatttttgaaccgtaaaaggggatacaacgcatttctaactttcaaaaccagtacaaacaagattccttcctttatgtattgtccctgattttatctgacgtggaggccgccagccccatctctctccccgttagccgcccttctctccactgcccgtgtgtcggccaacatcggtctgtagatcatagatggaagaaagagggaagtaataagggttggttgttgatatgtgggtcctattattatttttattttctgatatgtggccccttgatttnnnnnnnnnnnnnnnnnnnnnnnnnnnnnnnnnnnnnnnnnnnnnnnnnnnnnnnnnnnnnnnnnn

SEQ ID NO: 25793 - DNA, 657 bp, Oryza sativa
  unsure (1)..(657): unsure at all n locations
ctatagggcgaattcgagctcggtaccccataggcaactacactttgccaacccgatccgatagcgacacctatagataaattagaaaattagtaatttcattgttaaattttgaattactttgatatacttgtccttcaaatggaataacatacctgagagcactggttgaacactattcaacaaaatagagaaagctagaaggggagcaagatcagcgacttcatctgctactgccttactttcagtaaatatgtatgcaaggcttccacggaagaaaaggaagagcacaaacaacacaaatcctatcaagaaagaagtggtgaccacattgaaaatggcaaacttagctcttcttgcactcccggctccaagttcatttgccacccgcactctaaaaatatacatgcattaagtatatgtcaaatttatggttcatgttgcatcagttagatgaaccacatagtgagtgacagctgagatcgtgaagttaccctattgcagacaaaaatccgatagaaatcatcatctcccaaccattgatattaaggctacaaagtttgcaagtgaaaacaacaatgttcannnnnnnnnnnnnnnnnnnnnnnnnnnnnnnnnnnnnnnnnnnnnnnnnnnnnnnnnnnnnnnnnnnnnnnn

SEQ ID NO: 25794 - DNA, 2498 bp, Oryza sativa
gtgtaatctgaattattactgaagataatgcgaattattgcagctggaggaatatgagaaggagaggtcggagatggagggtgtgtcgagggaggagtacctggcctccctccgccgccggagcagcggtttctccaggggtgtctccaagtacagaggcgttgccaggtaggactactgattaattaactctaattaatctctctctctctctctcttgacctgaatgatgagtcagcatagcattgctagctagggtggcattcatcagctggcaacgtcatttgccagccgtgtatgctctgcatgcatgctccatggtccatggcctcttctttcttgtgtcagtttcgtgcaatgtcatgcatgcatctaggaaaagtcagaactgcaaaagttttaagcttctctctttcttgatgaaatctgcttccaatatcagttactgtattgtggtgccagtgctaccaacttgctgtttccattttgttcagagctagcagctgtctgttagtaattcatttctgaactttttttttgtctggttttgttcaggcatcaccacaatgggcggtgggaggcacggatagggcgggtcctggggaacaagtacctctacctgggtactttcggtacgtattctttcatccaatctttcatgctctttgctcttctttcttggagcccacttaccttaatcaaatgttgattactagcattgacaagccgctcttgtttgttggagaatttgcctgctgtaagccggccacctaacttttaccaaaatttatgatggttgatcaacccatctgcgaaattaaatggcgtgtttttcttgtttcccttcgatgtagatttgaccccttgcttttcttgaggattgcttactaggtagtacttcctctgtctcaaaattgagacagttttagatttcaatataattttcgggatgctactttgaacaataatatttataaaaacaagttatcttaaatgaaagagttgcatattatgatactagtttgagtaaatttcataaaactgcagatattttgtacaatctatcacaaaactacagatttaagaacttgttttacaaaaatacagattcagtggcttcgtttatcacaaaactacaggtactttgggcaatatatcacaaaactaaagatttaagtacttgtttcacaaaactacagatttaatatcttcatttatcacaaaactacaagtttaatggcttcatcatcacaaaactacaagttttagcattgttaaaacttgtagttttgtgataatggagacactaaatctgtagttttgtgataaatgaagacactaaatgtatagttttgtgataaacgaatacactaaatctatagttttgtgaaacaagttcttaaatctgtagttttgtgatagattgtacaaactacctgtagttttgtgataaacggagacactaaatctgtagttttgtgagacaagcttttaaatatgtagttttgtaataaattgtgcaaaatacctgtagttttatgaaatttactctataatctggtaacattattcttacgtgattgctctttttaatttttcattattaatagttaaagttaaaaatgttgatttaggactattctaaaaatgcttatattttagaacagagatagtagtatatattattctccttgtatgtttttgaaccacaaactctccattttactataaattaagtgagctggtgatatcactgatatggaagcatagtgttgaaacttccttttcttttacttaaaaaaatcagaaaatattttcctgctgtcaagatcaaagaccatgagaccaagataccatcctgtatgcaatccccagaagactgcccaatttgccctagaaatagcataaaaacaagccccatgtcttgatcaccaccatgtcctaattactagacaaaatcctagtatagatacattatatggtacatgacttggaaatgcatgtgacaagcacgtgagtggtgctgcaatgccagtagtaaaaaccagatggtgcatagggatcttcaattgttcatcactgccggctctttccactagagctagctgagtgagtcagcagccagttgcaagtgctcacttcacgtgcatggagaatgccctactaggctattaccccccctgtgccaaactagatcaagattcaagatccagaaccacacagatggattcatcactactttcatcacaactaaagaaagaaaaaaagggaaagtgaacagtgttcaccgattactagtaaacagaaggttgccagcacagttctagttaccaacaatgtgggaaaagtcatgccagatctcagatggtgtccagcacatgtcaaactagaaagtgaaaaaaaatgtgaatatgggatgcaattcagcatctctcagtattaagatccaatgcattcattttctaaagtcttaaatctatacagcatgacctgatcaa

SEQ ID NO: 25795 - DNA, 1896 bp, Oryza sativa
  unsure (1)..(1896): unsure at all n locations
nnnnnnnnnnnnnnnnnnnnnnnnnnnnnnnnnnnnnnnnnnnnnnnnnnnnnnnnnnnnnnnnnnnnnnnnnnagaaacatactgggtaatttctagcaaaatatattaaattttccaaggacatgaacccccctgctctgcaagcattagatacttcaaaagattagttgtcgaggttcaagcggtgttgataaatgcatgacagcttatatatatatcctaaaatcattactagggattagcgaaacgaacctaaaatcagttgctggatcagaattctgccagcccatctccttccatagatctgatttcagaggaggaagttgtcggctgggataagctaatctccaaagttctttcagagcatcctgtcatagaaaaaatgaaatattttactatcatgaatgttagtatatgaattgttcagtttatcatttcttctgagcaagaaaattggtgtcccattggtgagaacaatagaacaagaataccaaaggcctataggtagttaggtacagaagcggaacctgatgcttgacagaggaactgtcaaatggcacatttaatctctgtctcaagaacctcagtctctcttcctataaagtaaacatggaactgtcaaaaccatagtatcatgtaaaaaagttcctaaatgtaaaaacttgaaacagtcaagaataacataaagatgccatcgatgctcctgtagaacagaagggttggaattaataaaccaagtcaagaattcatttgaatttttaaagcatgcaattcaactactaaatgagtgttgtggaagaaataacaagtttcatggatgttaccatgatattgttcatggatataccaacatttttgtccatgaataatcacaaaagcaaacaagaacttttattattgtaaaaaacgataaaaaataaatgaaagatgaattgagcatcaaagatgtcgagagtatgctcgaaacaactcattcaaatgcttaaactactgaggaagaaaatatattttccttcatacttcagtaaaaggtttgaaatatctcaaaatatttacatgaaattaacatgtcacatctgatactcataagaattcatgcttttgatgggaaacttaacccatcaatcatatggtattttaaatggaaataggagatctgcatgtgccagcactgattatacctgtagtggactgagatcaagtagaactgcctgttcatcatgtgaaccatgggaagcacaagacctactaaagaactttgctagcaatggtccaaactgagagagcgcatttcctggaaaaaaaagaagatttttcagatagtaaatgttctaaaaggtcaagtttaagcattctgctgtgtacattcaagagggcagtaagacactaaaaaatccacttctctggaatcatattcatgatagttacctatctttcttacagattgagcaataaaagtcgatataacatgcatccaaccaaggcgctcttgtccttttccatcccataaatttggctgcatattaggctcatgtctctataaaaaaaaagtacgagaaaaggggtaaggcgcatgaagaactaaaatgcggttaataacctggattcatatgatttggagaaatttcactaacctcggatttgctttcatgagttctgtttcctagaagaggttctcttacagaatctggtatgatcgtctccatctgtttttcgcttctatcaatatcagcagtgtaaggcttccttttaatggcttttgaagccatactattttttcagtcagtgtattgcatgaatcatgcctgttatgtaggaaaaattggaacgccaaagagattattgaaaaatttatattgaaaccaaccaacccatagatagtggcaccaacaaa

SEQ ID NO: 25796 - DNA, 2614 bp, Oryza sativa
  unsure (1)..(2614): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaggtaacactggtcacataagaaaatattgatttgcatagcctgatacatgtctttttttccacttacaagtaccttcaacttcgttctttgatgtagcaatggactgaaccttgttaggcattcgttcctgctgcactctagatttcctcctcttgtatagtttcatgcgccgaataaattgttcatgtgctttctgcagctccccaacaggctctgcaaggctattgaatacattgataaatggtaagtggtacctttaatttgcaaggtacttcgtattgatattaattttattgtgaggtttcacttgcaaactgcaatccaaggatttgttactccattggtttgcagtaggcggatctaagatacgtccattgacaattgaattgagtacatgaacttttttttatgtgtcattacatatcagatgtttcctttaggacatattagatgtagctgttgaactaaattttaagcaatgataaccgcaaaaatatggtaccagcaacaacaatggtggtaaaaatcttacttctgggttcccaagcggtacatgttctcagcatcctcaaacctcttgtgcttctcataatacagtgcataagccatataaaatgcggatctcttaaggcctattctgttcttttccatcttctttagcaatggctttgcatccttcacatagtccatctacaccattgaaaaaaaaaatggaaatatcacaataggacctttcagtccaagaaaatattcatatcaaaagatctctgttgtgcgtaacaaagcctagataataagctaagaaaatattcttatcaaaagatttatgttgtgagtaacatacaagttatagtatgagcaagcaaacaatagtacgaaatgaagacatcagattgaaatcgctatcgaactattgcagattcaattagcacagggcaaagctcgagccccaaacaaatcgattttggtgtggaactgcaaccaaatgaacctcaggctatctcaacagatccccaatgaaatgaaatccactatatatgacaacatcagtaaaaaggaaaggaagcatatggcggataggtggatgtagaagaaggtggctgaccagctggatccagacgcggaggtagcggggatcgtcgcggtagcgggcgtcgtcctggaactcctgggcgcacttctgcaggaacctgggcagcttcgcccgcagcgtcgccggcggcagcgccgcctccatcttcctcatgcccctagcaaacaacgaatcgatccatcaagcaacttgcatcgagaaggggaagcgatcgattgggagtggtagagagagagagagtaccggagccatgggcggagggggtcggagccggagtaggagcggatgtcgcccaccaccgccgacaggaggtctttctccttgtcgccgccgccgccgccgcagtgctgctcggtggccgccgccatgggaggggtggtggattggagcggcggcccgccggccggggtgagccaacacgagacgagagggggggtttttccgggtttgaaatgaaagggtggctagtttcgaatctccttcactcgtgcggatgacaggtgggcccactaccatccttgacatatgccccacctgtcagccagacaactcttgtcgccgcatctttgccaaaatccagtaatgataaattttaaaaggcagttcaagcatgggcattgcagatcacaaatttacaatcaaggtaagataaatgagcagccccatcgtttcgcttatgttaatacttataagtcaaaatttaaaatttaaaattaattttaaaattgattttgtgatttttttattatagtttattttatagcatttgcttttgaatcgctaagaatatgtgtataaaagttttacttataaattaaattttagttgctaataagccatacagataagcataaccataagcaaaaggatgacactgctcattggttccaacttccaaatttgttcaaaaaccttctgcgtacagtacaaaaatggatatgtctgctcaagatttatttaggtaatactgtgaccaaaagaaccccacaagtcacgactcacaatcaactctgcggttcgacctacaagacatagatttcaagccgttttgtggaagagatcctggagatcaagtatgtcagcaagaactccagctgcagtggtatcattgccagctccagcgccctgaatcaccagaggggcgctctcgtagcatctgctgtatatctccacctgcccaagaacaaagcagcgtcacttttacgtttcacatcactctctaccaacagtaaaaaatcacatatcaaacattctttaatcctctcaaaacagaaaaatggatttcatcagggtaccgagctcgaattcgccctatag

SEQ ID NO: 25797 - DNA, 1640 bp, Oryza sativa
  unsure (1)..(1640): unsure at all n locations
nnnnnnnnnnnnnnnnnnnnnnnnnnnnnnnnnnnnnnnnnnnnnnnnnnnnnnnnnnnnnnnnnnttttctacgaacagggggcctgctcaattacaagcggtcttctaactggaatgtacgacataacacatgcataaatatagtgtctatgcataattagaaaatttcggaataagtgatttaggggttaaaatctttcaaaatcaaagttctggtatcatagaaaacaactgaactagcagccactcaacaaagctaatggctacataaactaaataacaacttccaagatttggagggtattcatttcattttcagactataagatacataaggtgtataattcatcggaatccccaataatcctgaacacaagtctatggtgatatccagtgacctatattgtagaagagtgtcggtccttatccatagaatccatgtagccaaaatattatagaagtagaactaaagagaaaaagatggttccaagtaatgcttcgggcaaactatcaccaagaatggtatcaacaagaaatgcatcattttaaaccaactaggtttttttgaacagccagaataacaggaaaacacttgctacaagtctcagaccctcagttatattagcgaaaacatcagcccatgcacaccaacctatgtttacacaaaacattagagtgcaaataccatcaagattaattatatgcatacattaatattctccatgctaatctgttgccccagaagcctagctaagatcaatgcctgcattccaagatgaacttgttagacctcatcatctaattgacaaagaatgaaataatcaaataaaacatctgaacctgaacataaacctcccttatgtcaatgtctatgcaaggttattattgaaattccaaataggataagtgcatgatataggccttcctgaactttagtatttatgatattgatgtgctagtgaatatattttggatcaaatcatggtatgacacaattaaacaaaaaacagatacacagcagcagctcatgatatattagttcatggacttaggagtagaaaaaaattgtggcaatggttaacaaaggcacatataaagtgaattatgaagcgtagcatgtaattcatcagatgaaaaattaaccttttctagctacgtccatcccactgagatcatcacgtggatctaccaaaattgaacaactgagtaagtgcacttatcacaagcatcagtagactttcggtaaatatgaaatctgtaattacagataaggaattgaatactgagtacacattgatgttataatgtccaatgaatgaataaatttttagacctggttctgtatagccaagagacttggcagttttcacaacttcactaaatttctttccatcctccagctcactcatcacataaccaagtgtacctgcagaatcataggaatggaagtgtacattgctctgctatttggaaaacagacaccttttacaaacaaataaaataataactgtgtaccactcagactgccaacaatacgagaaactggatctccagaggcaataatacgagtcacagaagctattacaggcagactggctccaacctaagagtaggaatagtaaatatcagcagagaccc

SEQ ID NO: 25798 - DNA, 1801 bp, Oryza sativa
atatcaaatttacttatatacatcactgccatcatatacagattttagaccagccattatttatcttcatgccttgaattcttacagtcattttgaaattagattgggcgtggaacttcctgctactgctgttgttttaattatctttactggcagtacagttattatcatggaataatctgttttaataatcttattttagatcaatttgcaaatccatttaactttactcgatttcgcccattaacataccaatcatttcctagaactgcagataacaacttattaattactgttagtagctttgaaaaataacccttagataaaaattaaacatgtagattgaagtatttttatttttatttagcgatgcactgaactttttactgtataatagattgcggtggcatggagatacacatgcaagttgatagctgatagcaatgagtaaatcgaatagcttctcagttcctcctctgcattcagacatgctgagcaaccggcgttgaggaccttgttggcacccgagaagaggttgttggtccggagtggtactgaaggtatgctcttattgtgattcactctttagcacatgttatagtatctaaggtgccatataaactagcaaggatgaaccagaccggcagagattgttgccaagcaaatttgatggcacatgaacacaaaattgtgatttttgatagtttgcattataaatgctccttcttgtcctgaggcccttttccttaaatttagtttacatgctgtagccaggcaatatttcctaaacacttcaaaatggatagaggaattcagaactgagaggggcagtgatttctataattgtgctggttaggaacaaaactaatcatgttgacaagaggtgagtggttcagaagttttcttgttttctgtagccttttcatgttgtcttgcttatctgatggattttgctcactgaaactgggactcactgaattgaaggcaaattacatagctcttgcttatggtcttctgtgttggagcacatcttccatgggtttgtggatgtgctcatcctgctcaaggttgactatagttttggtcagtaaaggggatgcagttagtgattgagctagaacagacttacatgtaatagtcaagttaatcagtgcattgcttgcagtttcaatgcttacaccacaatttcattccctgcaattacatttacattttaagctttgttttcttctatactcccaaccactgaactcgttttttaatgaaaattcaacttgctttttgcaagttctctctgtttttttgcaatcggaaaaccgtcacatgttcaacacaaaactatcacttataagaactgtaacaagctgatggatgaactttgataggttccttcacgaaatttataaatgcaccttacaaatctgaatgcttggagttatatgagatgatggatgaatattgcagggtaaagattatgtcacctttgacaattaaatttaatgtcgaatgatttttgcgcatgtatactccattttgttcgattaacttgatatctgaattgtgttttaggagcctatggacctgtttggcacagctccagctctaactctacccctcctggagctggagctcagccaaacagtttcagctccaccaaaactaggagtggagctaggtggagctctctcacaaaataaactagagttgtggagctgggtttaggcagcttcacaactccactccaaacccaactcctggagctaaatttaggagttggagctgtaccaaacaggccctatat

SEQ ID NO: 25799 - DNA, 14354 bp, Oryza sativa
  unsure (1)..(14354): unsure at all n locations
nnnnnnnnnnnnnnnnnnnnnnnnnnnnnnnnnnnnnnnnnnnnnnnnnnnnnnnnnnnnnnctacatcttactaggttcttaactaatcaccacttttctttaatcaatttcattctagccatgaatgatcagaattgcaacgttgtcgatgagggactacctacgaagtggatgactaattagaggtcctaaatttttttttcatatcttaatttatgccaatgcattttaatatgtttaaagatctttcactcgctttttttcttttttgaaaaaaatgtactcttactttttattaactagcatggtggcccgcgcagattgcgcggctagcatcattatattttctcttatataataacatatatgttttctcattatattattcaaatatattaaaataacaacataattttaaattttgcaataactttacaaaactactaatgtgtaatattcatattgtattttatatacgtgttagttattaattatttttaatatcaaattttagttatttgtaaattatatatattcatatatggaccctagactcatcttttaatatttctttttttttaattccgaattttctgtaaattgtatttctatataaactctatgctcttcttctaatattatttatttttatttctgattttttattatttctaattgtatttctatgtggactctaaactcatctttcaatattctttaatttttaatttcaaatttcagttacttctaaattgtatttctatattgactttaaactcttcttcccatgtttttcttaatttcgaattttagttatttgtaaattgtatttttatacggactctaaactctacttttaattttattatgtttattccctaattgtatttccatatggattctatactctacttctaatattccttatttttaattcggaatttcagttatttcctaattgtatttctatatggactctattctctacttctaatattccttatttttaattccgaatttcagctatttttaaattgtatttctatatggactctgccttttctttttcttcgattaatgtgagaatttctaggccatgagaacgaacgtggaagctcctttttctattcttttaataatataatagatttaactagaatgagtttgtttcttcagctttggtaagtagtactactaattatggccaccttaaagagggtgataatgatacgaacatactcccttcgtctcaaaaaaacccaattctgggtttgaatatgaacggagggagtatgtttcgggcattacaaattctattttttccacataacaaaaaatcactacatcacaccacaattctttttctaaaatttatttctttaaaaaaaattcttctgacttaggtaaaataccaccactaatttattcttttgtttcttggcattttctaaataccaatttgtgattcgtataggggactcagattattaggtacggccccgcggaattgtaaaacaaaacacactactcctcgtcattctagcattttctttatagacaaaacatgaaggtatggtaaataccgaactaccctattaataacagcaatgtttgtacttcatattagagttaaatgggtattttatgcaagtgcaatagttgaggggtaaaataaacttaataaaatgtctaaatataacagtattgtactctttttttttatttctttctgtatgccagaacatgcgctattacctagtacctagaactatgtagaatgaacatgacaatcttcactgccacactgctgaccaaatcctaggagagagctacttgtaattttatagtcttgttgaaatgatcaattgattagaggatttttttttctttttttatactttggtagtactaatacagtttttttttttgcgaggaagtactaatacaaactttgacggaggcacaactgcctcatcccttgcgatagcaaggaaccatgaagaaccgatcctcttttgtattggtgtgctctgtttatgatttcaaaatgtgatcgatagctgaaatccctccctagcgtttccattgataactctcgtcgttaacgttattgccaaaaaccgatgaaagtcagataaattttgttaaaaagtttcaaattttttttaatctttggccaattatggttgaatacagccagctcgataaggaccacgacaaatatcgcatttgaatccaggctctactctgttgagatatttttgttttattttagacaccaatcatgctatagattagggcctcgtttagttcccaattttttctttcaaaaatatcacatcgaatctttggaaaggagcattaaatataaattaaaaaactaattgtactgtttgtatggaaatcgcgagacaaatttttgagtcattaacccatatgtactaatgacggattaattaggcttaataaactcgtctcgtggtttctaggtgagttatgaaattagttctttcattcgtgtctgaaaacccttttcgagtttcgatatttagtcaaacgtcaaacgtgacacctaaaaattttcttttcgcgactaaacacaccctaagcctagatagagccaggcagtgtgggggcacagagatgtctcagagccatagacagatgatccattccattcgatgattaaatactgtagctacggataatcaatcccacgtgtatgtcagtgggccccgcgggccgcacccaaccgccgcgccgaaccccgccgcggcaagcaactcccccgtccgtgccgccgcgcgcctccggcatccgatcaccatcaggcggccgcgcgacctcctctgcttgcgttgcgtgcctccccacgaggtcgaggtacacttcccttcaaagccactgtctctctctcctcctctcctctacttaacaccaaagcctcggtctgtgtctgtccgccccccaacgcctcgccggcgcccagcttctcttccttccttccttgttgaggtctgaggtcttggatggtggccttatggtgagcgattttggtgaaatcgtttactgctcccccctgcttgacttcttttgtttccaattttgtttctttggttatgcaaacgaccagttcgatgaaatgaccgagtagaaggcaattgattggtttttgtgtttgtttaccctgatgatgagatcatttgaaacctcagctttcctaatccttgccaaattgtctggcgtcaacgcttttgtgattttctaaacaaagcaaatgatttggttatcttgtaagcatggttttggacatatcactgtcttgtctatgtttgcctttcgtttcttctaatggtatcgctgttttcatgccatctagtaatagcatctacttgtccgatgcctatcttccttagttgacttctcatactgtatcatcttctggctttatttgttcaacagacacacggcctgcactagtgtttacagctccaagtatggcttccagagaatccttcatgagtaccattttcttcttcttgcttctgttctccctcggctgcaagtgtatagcttcagagttacacttacatgcgacccagactgcggtcctcaaggttgatgcctcaccgcaacttgctcgacagatccctgacacactatttggaatattttttgaggtaagccgtgagacatatacagtaattctgtttttcacaattgcactgtatcactatatcctttcctctggcacttttttgttaggatgctcaagtgcattagcatgcccagaataatccaggtagattatacatgttccaccatgtcctgatgataatgatcttggctaatattgtaggaaatcaaccatgcaggggctggtggaatatgggctgaacttgttagtaacagaggtacttcagttatttttgttgtaatatatgcacttattttgatcgatcttccagataaaacataatttgcttctgaatggacatgaataaattcttctgcagtctgctggaacacaaacatggcttacgaaaaaaaaatccttttgttattttgtctttaatcgaaaattctccatactatctgattaactaaattatgttttccccataaactttaaacatagttatctttttagtactgtaaacttgacacacaaaactttgattaagagcataaactcgatggaaaataatatgccctttttttgaagttatattgacatttagggtttagtataaccaacttatgagttttatgcacaggttttgaagctggaggccctcataccccatcaaacattgatccatggtccataattggtgatgactcttccatatttgtggcgactgatcgaacgtcatgttttagtcggaatactgttgctctaaggatggaggttctctgtgataattgcccagctggtggtgttggcatttataacccagggttctggggcatggtatgggcttatatatcgttgttctttagtttgttttcctcacagtattgctgccattttctttccttttctcataaaattaacaagtaaatcatggacctccacatgttctgtttcgatttttcatgtagtgatagctcttttgtgcacttgtgttagtaaacatttgctttcctaacttttgcaatgcttcttttccaatactctgatcacccgtaattgtcatatcaacccgcagaacatagaagatggaaagatctacaatttagtgatgtatgttaaatcaccagaaactgtggagttgacagtttccttaacaagttctgatgggtcgcaaaatttggcttcaactaccataccgttagtgccttttctctcaatactgggacaggagaacaaggatgtttgcccattcccattagttttgaaaggattatattgttgcagggtttctggtgcatcgaattggacaaaactggagcagaagttggttgctcaaggaacaaatagaacctcaaggcttcaaataacaactaacaagaagggagttgtatggtttgatcaagtatcgctcatgcctgcagacacttacaaggtacattatattttgttgtcaaacttcattactggaaaaggaaaacgatgccatgggctttttatgctatctatgtatagtgtatgataacactttaagtcttcatgggctttttcaagtgcttccaacatttcttttacacatacagggacatggttttcgcacagaacttatatctatgatgttggacttaaaaccacgattcttgagattccctggtatgagctatattttcccattgaaaatcaagttcttgatatgtacatatatgccagacatgtctgggataattgacttgatttacattcaaacaattgtaggaggttgctttgtggagggggaatggttaaggaacgcattcaggtggagggaatctattggtccatgggaagagaggcctggacactttggggatgtttggcattactggactgatgatggccttggatattatgaatttctccaggtactagtttacttgacattattcctgcctttcattttcttatcacgtcctaatcatatattgcctttgagttctatatttttctaatgaaaactttgaactccacatcaaagctttctgaggatctgggtgctgccccaatctgggtgttcaacaatggtaataattgccatattttttatatcttgatcaccacagctgacctcctgaatcgacactaaactctttaaatatcaggaatcagccataatgatgaagttgatactgctgcgattgctccttttgtaaaagtatgttctgaactctctattttattttctgtcaggtcagatgcaccttgatttgttaaatagtttccactttagaattcacctgtaacgtcctagctatggctgcacttccatggatatggcatgtgagaaaactgatactatctttactgccatcatagtagtgttccatcttttatctttgcatatctaaatattaaagatcctaagaatgtaactgcatatgatgtgtctcattgaatgatgctaaaactcttgccttattttctcactattgaaatagagctgattatttgtgtaaaaaaggagatggttttgggcttgttcttttactctattagttctcaaagttcttttcaaaaaaattaattcacaatgttcacaaggagtgatgatgtttaacctgaatttgcattctggtatacttacagataacaatgtacctaccaagaaaatactaaatatcttttcttgaattgaagctatgttacttgtcgtaacaccagttttttgtttgggaacatctcttgttgtctctctacaggacgtattggacagtctagaatttgcaagggggaatgcagattcaacatggggttctgttagagctgcaatggggcaccccgaaccattccctgtcaaatacgtcgcaattggaaatgaagattgtgggaaaaaattttaccgcggtgcattcctcaattactttcttattttatcacttcaccatataactgcataaattgaagagccttgtctggaataaattaaggtgtatgatcgaataaaagatatgtacatggaccatgctaatcctgtaattttttttatgaaggtagtcactcaactcactctgtaaataaaggccgcaacttctttatgcagttgtacctgtttccttagaagtggttcattaatttagtcacataaatctccatagcaaaaccttacagggagacatttgttttcactattttaatctgcatataatattactttttttatgccctatgttctccttttcctctgctgtacttcgccaagccaatggtacttgtagtaatatatgttctatttttttgttgttgcaaataaactaggattagtaacacataaaaacaattcctggtagcaaacatactaaaatgtgattattttcatttttagaaaatttgggatgtaaatcatttatatttgatcataatctccaatgataaggcacatgtttgacttgaattgtgtggagaacaactgttgaattctcattttaggtacatgcatgatattctcttatccattatacaggtaattacctcaagttttataatgctataagggaggcctatccagacattcaaatgatttcaaattgtgatgcttcatcaagtccacttgaccatcctgctgatttatatgatttccatgtaaactactcatcctcttgagttgtgttctccagcacttctcattctttgtcacaaatgtcaaggcttttcccatttattaaattgaaacaattccttttttctaggtctatactgattctaagactttgttttcaatgaagaatacatttgatagatcatctcgtaatgggcccaaggtacgttgtatgcccggacttccattgtcgtggaccttttttcatttgtggatatgcttgtagaatagcactgtgaaatctcccatcttcatctaatattttacattaataatccaggatttcatgacatctctcgtatatttgtaggatgaccttggtcatctatttctcaacaataattcagtaatgtccacagttcatctatgtcatgtgtgatgatgtttacatgttttggataatcttggaacctcattgcatctcttgcttattcacttctatctttcttcatatatgttttggttgcaggcttttgtcagtgaatatgctgtttggagaagtgatgcaggtagaggaagtctacttgcttcattggcagaggcagctttccttactggactggagaagaataggtgatctttccttgaaacaatcttttctttctgggtcttgtgacagatcacatttgagctttcctctgggtagggctttattaagatctactaacaaatgcaacaagatattcattgtaacttcttgttggttctttgcagtgatgttgttcagatggcaagttatgcaccactcttcgtgaacaacaatgatcaaacgttagttttgatgactccatggtttctttatttgtgtttttgtttatttaacaagtactgtaataatgcttcaatcaaacaatcaggtggaacccagacgccattgtatttaactcctggcaacaatatggaactcctagttactggatgcagactcttttcggtgaatctagcggtgctatgtttcatccagttacaatcacttccagctactctggttctctggcagcatctgcaattacttggcaggattctgaaaatagcttcttaagagtaaaggtaagaaattttgttctaaacctactctacatctgtaggagattgcgtacctcatgaattgatcttgaaatctcctgtgcagattataaactttgggtctgatccagtgagcctcacgatctctgcaactgggcttcaggcccgtgttaatgcactgggatcaactgccactgttctcacatccagtaatgtgatggatgagaactcttttagtaacccgaataaggtaagcaaacatttctgacttcttactggatgtaatgcacatatcaatgtctagtagagtttgtggttttggtcatctgaagccaaagctttgctcatgacaaccaatgcaggttgttcctgtcaaaagccagctttccaatgcagcagagcagatgcaagtcacgcttgctcctcactctttctcctcattcgatcttgcgcttgcccagtccaaactcgtggcagagatgtgaagcagcaacacaaggttagcgacagaaacacaagaaatacacgagatgtgatatgcgaataccagaatgctgtccatatatgtgcatgtatcttgaagcactactgtatagtgtaatacacagggaatgatgaataaaattcactcctggcttacttccttcttttcgtttcttttcttttcttttcttttttttttgctttctccatatttatatcggatgagactagatggcgcattgccaccgtgttgctttgttccaaggataacaaatatgagctctttggcctgggaaagagaaaataatttggtccaaggataacagatttgtagagaatatcagaatttgattaaggatttgaacttgaactgaagttggcatttaaacttgagaaaattaaggctcagattatggactgagaatttgaatttaggattgagcagatccaaatggagtccaatccatattaggatggctgttgattctttgtggttatgtttcactgtaaatatggcatgttccccatataggtatactgactagtcatttacattgtgggaagctgagtagagaacaaattcaactggtggttgataaaatcatgatgggagaaaagattggagagggaaactttgtgtcttttgcattgatgagaactgtttcagtaaccccggataaggtaagcaactgttttctacttttatctctggatgtaatgcacaagtcaatgtgtggtataattggtggttttggccatctcaagccacagcttcgatgcaggagcatatgcacttgctcctcattcgttcttgatctgggccggtccaaacaaagtggtgctggtggcagagatgtgcagctgcaacgtgcacggggttagcaatagaaatgcttgtgctcattcgtcttcctcgatatgtttctgtcgaatgaatcaagatgagaagataaagaagaggaaaaaggaagaaaatatgcatgggctggctgtacattttggctggaacccatgtgaacttgtgaagtgaactagtaacttgttggcaattttagcaagtgactgactctctctaactaaagcatttaccagcagtagatcgtgcaacctcaaataatcattttggatcgtttcgtgtaactcaagtagtgtagttcatgtcacactaactcaagcctcccttggcagaggaatttctgtggaatgaatcaagatgagcagataaagaagaggaaaaatgaagaaaatatgggctctggctgtacatttttactggaacccatatatgtgaatgaacttacctggtggcaattttagcaagtgacttactctatctaactagagcaatttccagcagtagatatggagcaccctcgaataatcaagcctccctctcgcaagtaacaacgtacccaatccattgatcattgtggtcgcagagagaatgatgagagtgtgcccgccggcgacgaggagcatgctgtcccggcaagccattgtcgtcgtcgtcgtcttcctcgttcttttcttcgtcggcggcggcagcagatgcgaagccgagacgttggagacggcgtctctccatgtcgattactctgtcgctcgaagaatgccggacactctgttcggtctgttcttcgaggtgactagctagctagctacgtctcgtttcttttcatttctttcttctttttccatttattctcctgcggatgctttgcttttttccttatcgaaatctgtattattattatttgtgcaggagattaaccacgctggaagtggtggcctttgggctgaactcgtcagtaacagaggtacacgtacaccacattatactactcctattttatttggcttccgagctgaagttgaccattaaattataaagaagagcagtggagtggtatcagccgttggatgcccatccaggctgattgatcgtcttcaacctccagctcatagacacgatttgtctctcttctcctttttgtttttctagagctcttctcttgtgaagttgagcattaaattaaagagttaattttatttggatcatgttttatttttaaaatttcattttggtttttggatcatcctatgttcaattttttcattttaaataactttatctttgttgtataatggattactcaaaaccacatcttcagcacttcaatgattttgagcaaatcgttaacgacatgctgatgaactttcatacttatatgcatgctatatctttgccgaaggaaatgatagacatggctaacaaagagagttagggtgtccattatgtaataaagataaaattatctagtccaaagtaaaaaaaattgtgtatagggtgatgcaaagtgaaacgtttacgcacaaagtacaattcagtcttaaattagaggaggagatagcagtggagtgctgtcagccgttggatgcccatccaacggttgatagatcgtcttcaacctccagctcatggctacgctctctctctctctctctctctctctctcctctcttctttcttttcatctcttgtgaacgattccctcctgcctcctccctccccgcacctgcacctgcacctgcaccatctccggcgtctctcgcggccggatccgccgcctcctcacccaccgcaccggcggcgccaccccaccgcctcgccctaccgcccaaggcctcccctccctgaatacgcagccccgatgaactgctcctccctccacaaaccccctaccccgccagatccactccacggccccaccccaacacaataccctaatccattcgccctctgtcgcgccggggaggaaagccaaaaggaggaggaggaggaggaggctcatcggcgcagggatgctcgagattcaccggcgacctcgttttggttgggggtggtgtgtgtctgtgtgcgagaaggctggaggttgaagaagcaacatggatggttggatttgtgaattgtgatcttactgccaagaatatttggggagaaatcaatcacctcatgtatagcaatgttgaataagaaaacattttccccctcaataaataaataaataaataataatatttgaagtttaactttaactgaacttttgtctaatttcttgctttaggttttgaagctggagccaacacatcaaacattgacccatggtccatcattggagatgaatcctctgtgcacgtcacaactgatcgctcatcctgtttcagtcaaaatccggttgctgtaaggatagaggttgtctgtgacgattgtccagctggtggtgttggaatatacaatccaggattctggggcatggtataagttctctctcagcatatagcagctcattcccatatgaatatgcaaaatagatcttgtaatcgaaagaatcttttttctgatgatagtttaaagtatacggtgctgccaccgaaggtaattatagcaaagttattattcttatcaaaatactgaagctaacagataactaagctaacctattttttgtttgctttcaatttgcattgatcgcataatgctggttttctatcttattgccgtgcatcacttgcttggaaagtgtaatcagtgttatagcttttcgtcaaaccattttcacttttaccttctgatattttaatgtgattatgatcatttcaattttcagaatgtagaagaaaggaagacatataatctagtcatgcatatcagatcattagaatcggtggagttgacggcttcactcacatgctcaaatggatcgcaaaatctggcatcaaattttgttcggtatatattttttttccttagcactgagattaagaaaaagctttctcaatttctcgctctctctctctctctctctctctctctcttgttcgctagctaactcataggattgtacatcaaatttttcagagaaactgatttgttaaattggacaaagatagagctgcagttactagctcatgggacatgcagaacttcaagacttgaactgacaactaggagaaggggagtgatatggcttgatcaggtgtcactcatgccttcagaaacatacaaggtgcattgccttttatcttcttattgctattgtcatcatagcttgatccggaatctgctatcatcttatgaagaatggagaataatattcatgtactgaccccaaagatttagtcactagtataagcatgccaggttcaatgggcaccctcttcaaatcatgtatgctatttgacatttttcaagaatattcgaaaaaagtcatcataaaaatggtcagttgttctcatttctatctgacaaaaaaaaaaaattaacttatctgtaatcggtagtcctgtagagatgtgagatcaacttattgttccttaatctagccatgcttactattagttcacaggagttgttgataggcatttttcttccatgtatgcagggccatggttttcgccaggaactcatgtacatgcttttggacttaaaaccacggtttctacggtttcctggtattatgattgttttccaactggtaatcaattttggttgccctgtaatttaatcgctggcattacatttggcagggggttgctttgttgaaggcaattggttaaaaaatgcgttcaggtggaaggaaactattggtccatgggaagagagacctgggcactatggagatgtttggcactactggaccgatgatggccttgggtattatgactttctccaggtatggattgattaatgtcaaatgagttctctcttggtctcatcatatctgatcatttgtttacttcgaactgttcatgtcttcataaatcttgctgaagacttgggtgctgctccagtcgggtgctcaacattggtaaatattctgcatctactttgtcttgttttactttttttttaatcttttctcctcgcataccaatgaactgctcggagtttttatcttgtgatttagggatgagtcacagtgatgtagttaatggaactatgcttacaccttttgtaaaggtatgttttcgataccctacaattttttgaagtatggttgagatgaagattggcttctcatgatgtaacagaaaacagttataacttgtgaatattacataaggcattgcatttattgtcatcccatgtttattatttcgaaatactttgattttcttgctacaggatgcaatagacagtcttgagtttgcaagagggagtaaagaatcaacatggggctctgttagagccgcgatgggacaccctgaaccattcccactgaagtatgttgcactcgggaatgaagattgtgaaatattcaagccgacataccaaggtaaattttgactaaaacaaaatagtatgtttatggtccttcatgtcaatgctgtgataattaccaaaattcattattctgttctctattgatctgcaacaaaagcgctatttcatttacctgcaactcttttgactctgagtactataatggaagtattctaggaaaaacaaatgnnnnnnnnnnnnnnnnnnnnnnnnnnnnnnnnnnnnnnnnnnnnnnnnnnnnnnnnnnnnnnnnnn

SEQ ID NO: 25800 - DNA, 1116 bp, Oryza sativa
  unsure (1)..(1116): unsure at all n locations
tatggttgagataaagattggcttctcatgatgtaacagaaaacagttataacttgtgaatattacataaggcattgcatttattgtcatcccatgtttattatttcgaaatactttgattttcttgctacaggatgcaatagacagtcttgagtttgcaagagggagtaaagaatcaacatggggctctgttagagccgcgatgggacaccctgaaccattcccactgaagtatgttgcactcgggaatgaagattgtgaaatattcaagccgacataccaaggtaaattttgactaaaacaaaatagtatgtttatggtccttcatgtcaatgctgtgataattaccaaaattcattattctgttctctattgatctgcaacaaaagcgctatttcatttacctgcaactcttttgactctgagtactataatggaagtattctaggaaaaacaaatgaaaataggttaattgtctagcctgttgttatgttttgaaacagacacactttactagttgcatgtgaacaaagctaaattgactatcaattataattaatgttgtttcagtacacttcaatgctctactgctatcaccaatatcctaattttcctgtgatatcatataaccatataattatgctgaacagaaaattaccccaagttctacaatgctatacgagaggcttatcctgacattcaaataatttcgaactgtgatggctcgtctaggccacttgatcatcctgctgatctgtatgacttccatgtaaaatactaaccgaagctaatttggttgtatcattctccctgttttaaaattatgtcttactgttttctcagacagtcaaaataaccattgattatgctattgtttcactccaggtatttgtaagcgagtatgctgttaataatgacaaagggggtgatgctggcaatggaagcctccttgcatcgttggcagaagctgctttcctcactggtttagagaaaaacaggtgatccctttagttcctctcaggatactctctcctttatcttgggtttagnnnnnnnnnnnnnnnnnnnnnnnnnnnnnnnnnnnnnnnnnnnnnnnnnnnnnnnnnnnnnnnnnnn

SEQ ID NO: 25801 - DNA, 643 bp, Oryza sativa
ccgctacaagaagctcgcggcgaggcccgcacgccgccgccggctccgccacgcgtgctgcgccgccttttgcgcgggcctcctcctgctcctcctcgccgccggcttcgtcggcgccgtctacctcgtcttccgcccccgcgcgccgtcttctccgtcgcctccctctccatccggggactcgacgccctcgccgggtcatcgttgactccgcagatcgacgccgccgtgcgcgcggacaacggcgccaacaagaagaccggcatcgactaccgcggcggcggggaggtgaccgtctcgtacgccggcgagcggctcgccgccgggccgtggcccgcgttccaccaggcgccgaggaacgtgacggtgttctcgacggcgttggccggaggaggcgtgagcttcccggaggagcagaggaagcggctcgccgcggagcaggccgccggcgcggtgcccctgacggtggaggcgatcgtgccggtgaggttgaggttcgggaaggttctccggacgtggacggtggacgtgaagacgaggtgcgaggtgacggtgaacaagctggcggcggcggcgccgccggcgaacagggggtgcagggtcaaggtccggccgctctggtggtggtggtgatcgccggcgg

SEQ ID NO: 25802 - DNA, 655 bp, Oryza sativa
  unsure (1)..(655): unsure at all n locations
agccatcaagctcagctacttgatcgatctcctttaaaacggtagctgagagccttcctaacctgcttcccttcatcaattctgatagctcctctgccactcaagtacaattattcccattaattcgctccattgctgcacaattaaagttagcagaagctgctaggagaaatggagaggccgggtgatgaacatgatgactgcaggacggttcctctgctggagcctaagcatgctcatggcgaaggcagcaacaacaagcaagaagaagatgaagaggaggttgggtcgttggggcggcgggtgttggtggagagcaagaagctgtgggtggtggcgggtccttccatctgcgcgcgcttctccaccttcggcgtcaccgtcatcagccaagccttcatcggccacgtcggcgccaccgagctcgccggatacgctctcgtctccaccgtcctcatgcgcttcagcggcggcatccttgtaactatcctctctacccactacacttaatactatttaattacattttgtgtttaaactaatctaaactttgttttccaaattttccatcaaataactctcaaactctgcccaatttnnnnnnnnnnnnnnnnnnnnnnnnnnnnnnnnnnnnnnnnnnnnnnnnnnnnnnnnn

SEQ ID NO: 25803 - DNA, 2011 bp, Oryza sativa
gcttcttgtaaaaatgttctgaagaaaaataggctgtgttctacccttcattttcccaacccacctctctcgttttccacgcacacgcttttcaaactgctaaatgtaatgatttatgtaaaaactttctatatgaaagttatttaaaaaaatcatataattcatttaaaaaaagttaatacttaattaatcatacaataatacgagcttcgttttgcgtgccccaacccctcctcccaaacccagccaaatctgcattgtgcgcatgttcattctctctgaattgcaaaacccatcccctgatcgttgtttatttgaaaatgagataaataacaaatggctaaatatgctttgagtaaaaaacgactacgtataaacatcatctctatcatggttcgtcacggatgagcaaaacgatgagctccgcaagctggaaggtgtcgtcgttctccacagagagcggcgacgtcacattgctcttgccgaacccgtcccggcactccttcaccgcgctcgccgatttctccagcgatgaaatcgcctcctggaacctgccgcccttcacggcggcgccgacggcggcctgaacttgcagtatcccgccgtacaccgcctggcatgacttgaggcaccgcgtcgtggcgtcgccgccgccgccgctgctccggagcatggcgtctatctcggacttggtgctcgtcgcgttggccgtgaggaggtcgacggcgatcaccgcgaactccttgtagctgccgacgttgctgctccggttgtcggagctgagcgcgtcgatgcagaacgtgacgccgatgagcccgctgccgccggcgatggtcttgcacgcaccgtacacggccgagttgatgccggcggcgagttgagacgcagcaattaggagaacagccaagaggaagagagcgctgacgccattgttggaggaggccattgtggaaacctctgcaagtctgtaagataatgttgaaacagatggttttcttgacgccattgcgtgtcaattatataagcacaaaattttgcatggcatttaatgacctgatcgatcgtctcgaatcaatgattatatcgtggatttgtagaatcgattattgattttccgttaatttctctccccattaaatgatgcatcgtcctttattgccatgagggaatttatggtttttttaattagatgaaaaaaaagagattccttttcagagtttatggtctatgaaaaagatgctgttacaaagttttgccccgtatatatgccatcatatggatgttttcatgatgttcctcgttttataaaaaataaatacacgaatagtcatgaacatttttagaacaattatttgatggtgggcccaaccaagtttagtacacaagtatagagtatcccatatttaggacaataacagtagcccctgacctctattcaaatgtataaatcgatcacattagaatccaccgaggagccgagctgtcggaatagatttactttcagtagcacagaaggaatttatccgtacaaatatcatgatggagaaaagcagtacaaaaaacacattgccatcagctgctataagaacttgaatatatagatgaaagtatggttatactatttctgcagccaaaataaaaccttaatgacatcaacacaaaatacaatggaattgtggaacaaaaatatgcggtaactttaaaacagccatctactcctggtgacaaacagccatctacatctggagtatgtagcaacagacgagtatgaccacgagtttactttgtctgcaaagcacagataagtgacacctggtgagcaatgccatcaggtgaacacagcagtcagcagctgacttcatttagatgttaacagtttagtggtaataaaataagagctcatttgattcctgcatcctgattgaagattcaagtttttgtccatgttctatcgtcactgtcccttggtgagacaatggaaggttaataatctggaatagatgcaaaggtg

SEQ ID NO: 25804 - DNA, 6319 bp, Oryza sativa
taaaccagtgtacattaacataccaggaaggaaggcaaggatgcccaggaacaagagaccatatgcctgagagttatccccctccatgtgacctgtgaatataaaatatgacaggaagagaagagaacatcctaggaggaggagaatagtgccagggcaattgatttccacgggatttttctgagggattttggggtgtaagtgaaccgaaggtctacatcatcagtaaggttgctgtcatccctgtcctctgtaggaagaggagcataccccccaacattgcgtctagacgccatagtgcagtgcctgcatttgaaacacatactgtaaaatacaggtagaaaatggcatggtaatacacagtaagatctaagagttcaactgacaaagaaaaattaaaatacactgttgctgttaatgataatccaaaattacaaggtttgaaaaaaaaggtgcaccaaacagtaacagagatgatatgacaaacaaaactaaggttgtggttgtcgtcgcatgtgccatgccaagggccttaatggactgcatgtgacatggacatcacaaatttcatgtgaatcattctcagagaagaactattagtttttatagaatgattagaaaaatataagataaaattttctgtaatgcgatacataatttgaaatgaactcaaagaacagaatcaaagacaagaacaagatggcataccagacagatttgagtttctctaggttgttgcacatataaaataaaaccttatgcatcaagatgcatattaaagctttgatcatctacaatcatctgcacgaactaaggctaaaatgagcactctattctacaggataacaacctgaaaatatggactaaacaagacacatctaataattttaacatggtgattattaatcgttccttttccttaataatttcaacatggtaagtatgtaaggttctaaaagtaattcaaaattggtactccaaaagattgatactttcaagttgctgcaagatagccaaaaatctcacagacaactctagtgttgtagtcattccaatcagcagaatctatgggcattttaacacccttcaaagacacattttgagccatgcctgtcatccactcactcacaccaatcctttttcaataccaacatacatcataggttgaaaattgagatgattgattctgaacagagtctacaagttgacatttatatgtacagaaaagaacaacatccacacagccatagtgaaccatacagaaaagaacaacataactaatagcagtgatacaaagggactagtttctcgagagcaaatgtgaaacatacaggcagttggaacggaaggtgtcatgaaaacatttctgatgtgatgtgcatctcatgtaaactataactacagatcgataatacaagtatccaatctaagttagtactaaattttgctgaccaaatctttcaagaaatctaagggtgtgtttggttgctcgtatccctctagcctggctcatctccctcatccaggctaagctgagcctggtttaggggatacacatgcaggcatttggttgcttggatgagatgaacctggatatgatgagatgttgtttggttggttgcagcaaggggcggatggaatggtagcatgcaggagatgttgtttggttggatagatacatattgtgtgtaaaatacctattcttgtgggtggtgaggttacccccataaagtttgtgaaacaagattttttccaagtccctaatctatttatgtgtgataagtttaatccgtcgtagaggttatagattaaattatgttactctgggtgtgtgcacacctactaatattcctaagctcatttttgtcttagagaatcgatgtactgtgcatgtatgttttactgatgtcattttttaaaaccaatgagcagcactgatgataattttttttttaacaaatgtaacgaaatggcctggatgaacacgcaagagtgattattctagcaaaaatcaactacataattttattgacgacactggtacatttgacaattcaaaacaaacatacaaatatacgtgctcatggcaagttttttacaagtaaccaatttgataaacaaatctgtaaccgcatacaaaactaaaccatctgtttcagctatgttctgcctgcaagcttttgtacagattgcttcaaactcatcaaccttagtatatctacacttgatctcacaagtttttccattatcacattttcctgaaacatagtaaaagtaaacaggataacctgtacctttgaaacagtacaggatcagagttgcagagatcaggtcgcaagaacatcaacacttaatagtagtattatctttaccaaaagagcaagtgcagagtgtatcggtttcatataaaaacttgatcatgtcaaaatcaagtgtggttaccaaaaaaaaatgagtacatctgttgatatcaaaacatgaacaaggaacttgatagtatttgcctgacatcaataactcgaaaatgtagcaaatgtgcagaaatttgacatcattgagcctcatttccagcaggtaaataaatgcagaacaatggcctcagatatatgaagaatgtgaattagctactatcattggtatctgttcttaccagtatctatcaaatgtagcaaaagaaaaggtataaggaaaaggaaaataagaccaaatgtaggaaaaaaaaccacaagaaaatgagaacaagtgtagagcaaaaatttattcacatgcatcacaaacagcagcatatatcatcattggccatctttcccagcctaacagcaagaaaaaagaacaagtgtagaaaaatctgttcatgtactcttataaattctgctcaattcaagtgtagaggtggcctcagttctgctaagatcatctgaagtataaaatactgagaaagatcacagaaagacagaaacttagaaagggcatgtttggtggcctgaccttatcgaataaggtcaagtgcaggcatatctgttcttatgcatcacaaataagcactattaatcaagtgtgtatctgtcagtatcaatttaaaagaacgcactatttcttgccttatcagtaacttctatttgtaggcaaagatacaatggcataacacaaatcaacaggaaataggaataagtgtaggaaaaatctattcataagcatcacaaatcagcaacattagtcatcattggccatcttagaacaaaaaagcaagccactagacatttcattccatcgaaatcaactaagaaagatatcagcttttagtagatctagcatatttatgaaggggacacggtctaatccaaacaaatcggctgaaatcaaaggaagagaggagaagaaaactggaggaggtgagaaaaggaaggagatgcccaacctagcccttaccagagagctcaacggagagagtcgacgaaagagaggggcgtagcagagagccggcgaaaccaaacggcttgacggagagagcgaaccagtggaagagagcgatggcggctagcgaaagagagggaggatgatcaacggaagagaggatgctgacggacgaccggccctcccgccggcgaggacggcgcgacgagcagcgccctccactcgcgagtcggcgaaaccctagctttccactggtttggaacaaatgaggagggatggtggtgaccctatccatgggttctgcacgcgcgggtgcaagcggtgcacgcgtggatgcagcctcgcggcatgaggcgagccaggccgcaactcagcctggctccgcgggcctttttgcatccatcgaacctggctctgagccaagtgcaggcatctaaacgaacacaaccctgctgactaggtgtgagctaggtgcggtccggaaaaccaaacacatcctaagttggcaagtatattgagaatatggttgaagtatactgactaataatcaagtaataatagacatacagacggtgaaaatttaactggcaaccaagcaatgaatcccccaagaaataaaccagatttgagggagaaagtccaggattttagcctttgagtttatggataccttgcaccagatctcctatgccgccgccgttgtgcgcctccgtcaccgccgtgcgcagcccaaacctccgcgcggcgccctagccgagagaggactgagtcaggcgcctcctttctgtcgtcgcgagagaagccgaggggatgcgcgactcggcctgagcccggtgcggatggggaacgctggcatcctgcttgtaatttcgtccaacactagtgtttattacttccattttggactttttcttttagcgaaacttaaataagtttgatcaactttataaaaataactagcaatattcgtaatatttaattagtttcattaaactgataatacatctattttatgtactaaatattattatattttttataaacttgatcatttgacttagaaaaaaaattaaaacgaacaaaaatagtactccctccgttctaaaatataaacatttttagttgtgtgtccagatttatagacaaaagttgttatattttggaacggaggtagtagcttatttgtttactcttacttcaattctgacttattttaaagtagttgagatctggttattggattggacacaattcatgtgtgcttccccttaacttccacttcatatgacagtatgagactaacgtttatatccttcatatgcatcatatgcataagcatgtcattggcatatatttcacttctatttactcattgacatgtatggatataaatcaattgtcaagcttcaatataatgttggtttatatccttcatatccaaatgtggttattgttaatggatttgtcatcaatcaccaaaaagggggagattgtaagttcaagtgccttaatttggtttcggtgattaatgacaaatctaattatatgagacttatgtttttatgagcctttctttgactagtctcatttggatatggaagtaaaaatgatgagaggtatgtattaaacttcacatattctaacttggtctctcttgtggatccaaaatattgtgttagcttcctatttgatctttattgattatgtgcatatgcgttccttcatatccatatgtatgcacatcttgagggagagcttatcctatattttgtttattataagatttctatcttgatttgaaatcattttttatctcatcaccaaagagagaaaagattgaaagatcttggattaaacaatttgtgtaattgttactttagtgatagatgataaaccgatgtttatgggattaacctctcttttgcataagttgtctactaggttatttcccgataatgagatgtggaagacatgcattcttttttgatggaccttaatcatgactaggatgaaatgcatggagataaaacgatatgtaccacttcttatctcctactttttgataggttcatatatatgatttccatgttattgatatataagtgtgagactaatatttactcgaatgttatcttatttagtctcatttacattgagaacatggagatcatgaaggtatatgttttatgttggtctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatattggatctttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagtcaaggacatcgtcatgttggcaagaatgaagtcaagcttttgatgagaataaagtcttgacaaaggatggacaagacctcggcataaacatggttcaaccgaatggtcacaagtgttgatctcggctcaagcttgaccccaagatggatggcgcaaggcaaaggtataatgtagctaagaatgttttcttagtcttttcccggtcttggtgtttggtgtagactagatttgctagataggcgccgtactatcaagaggggtctatgaagcgagcttgtggatgatcttgtgctatattagttcatatg

SEQ ID NO: 25805 - DNA, 4444 bp, Oryza sativa
  unsure (1)..(4444): unsure at all n locations
cactccatacttccaaacgcctccggaaaccttttgtgttgcgctcgggtagcaaacaccacgagactcatgacgcttactatgtatctcgagataaaatttgatacttttagatactaaggctgtgttcgctcattagggttaggaacccatctcctttacacggaaaacggaacggtccattaggacatgattaattaagtatttagtaattttttttcaaaaatggattaatttgatctttttaagcaactttcgtatataaactttttgcaaaaatcacactgtttagcagtttgaaaagcgtgcgcgtggaaaacgagagagaggggttgggaactagaagttccgaacacagcctaagtatctcgagatacctctagttattagtgtaaacttttctagttaaaatctaattcctctatatactaagtatctcgagataagaaaaaggtgtaaaatttaggtaccgagatatcttctcaaggatcgtaaaatttcacttgtttcagagatgtcggtccatgatgattacaagcatgcgtgatgtatatcatattttactataaagttaatgcttaataactactaaatctcaatatccaagtgtgtcacctcatcatccactttaaattttattatttattgcttttgtcaggtgtgatgtaatatgcattagtacatttgtttgtacatttttctttatcgcattatattgtttgttacaacaatgtgtgcatttctgtcattttgtaaaattcagcagattatgtatggaagggaacaaataatataatgtacttacaggtacacatatgtgattacttgcaaacggaaatcctctagctggtacatcaagagaacaaacaaaatgaagagagaaaaagtgagacatggtttaagccatcgttgtatgcgcttaatataggcaaatagagtatgcatacattaagaatgtcttgccattttttatgtataatagatgtttatgtggtcaagaacaagcatctttttcttcccctcttgtccttttgcagtgttcaataattgcatgccaccgaaattcatccatgtaaaaaaaaaattaaataactaggcacaattaataattcaagctagacatggtaaacagacaagaacttgattcgatttgtgcaagtacatatacggaaatactactactgtccaatttccgacttcatgagatttatgtctttgtggtcagtatcttcccctcttccctctcttgcttcttgccgtgtgtttgcgtgcttgccagtgaaattcattcgatgaagatattttatttacataaataggaccaataattcaatgcacgcatagtaaaaaaaaaaaaacttgcatgatttgctttgtgttaatttgtacatggaaattggaaatgctgtcctcttttgtcgatcctgttcagttgcttgtcgcaacaggacatgtctagcccgagaagcaactgaattgccgatcaagcggttgcccgttctgcctttccaaccgctcgatcaagatccaacggtgcacatactcagtagaggcgcttgcattattgcgtccgtggctcaggctacagatgtcacgttatgatgtagctcagctcacacttgtcttgttcatagcatgagcatcgcacgcctatttaaagatgctatagcttcgattccctcctgagctctaacactatcgnnnnnnnnnnnnnnnnnnnnnnnnnnnnnnnnnnnnnnnagtgagtgacatcttgtggggatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggttggttgagctgaaaagtgacctgcggtctgaccgtgggccttaggccggtctgaccgggtctgttagccggtctgaccggcgtggtaaggccggtctaaccggctccactggtctgttgcactggtctggtttttggtggcgatacagagccgccagagccgcaaccggtcagaccgagccgacggcggtctgaccgagccgtggacggtctgaccggccactacactgcagttagaccggccaggttgagtgggctcaatgattgccctgtaacggctagttttctagccgttacaaagtagtccggtctgaccggcctcacaacggcggtctgaccggcagagcacaaagttggggatttcggttccaacggctagttttggtggttgggggtatatatacccactcctcagcagcaagggtaaggttttggcactccattgcattatcttgaacccttgcaagagctctcacacccttgtgcacttagtttatctagtgaggtgttagagagtgagttaagccaatccaagtgcgttgcttcattgttatagctagtgtggcacttgatcatactcggcaagcatcctagacttgttactcttggaggttgccgcctcctagacgtcttgtggaggtgttgcccggtgacctctccgaggagattgtggaggaggcccggcaccgtttgtgagtggtttggagttcaccaccttcggagtgaaggaagaactaccccgagtgatcgaggcttgggtagtcctctctgtgggccggctcccgccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttatttgctgcatttatatttgagctatttacattcatagagacatatttgagcccatatcagttaggtttgcaaaacttaacttagttgcttagttaaccttgcacctcaccttgtctagcaacttaggttagttttgtttaagtgccattaagttttaaaaccgtctattcacccccctctagtcggcctgcttgatcctacacacgcctgcgtatgccgcctggcacatctggaggctcactgttgtggcatcgtcgggtttcatgccgccgccatcatccttgaggatgctgtctatcttggcattggcgctcgtcgcgttggatgtcaggaggtcgatggcgacgatggcgaggtcactgtagtggttggcgttgaggctccggctgtcggaaccgagcgcgtccatgcagaacgtgacactgatgacgccaccgttgctgccagcaacggtcttgcatgcgccggacatgaaagggtcagtgttgatggcgagttgaacttgagacgccgcgacgaggacaatggcgaagaggaagagggattgatgacgccatgggaggagaccattgtgaaacctcgatcgatctgcaagatgatgtcgaatagtttttttggatgaatacctttgtggccttgcgtgtgaactatatatggacatgttttgcatggtgttaaaaacgaatagatcgtgtctctagttaatgattagatagagtagatccgtagagtcaattattgattccccgtaaatctctgaccaaatatggctaaggcatgtataataacaattaatagcatgttctctaagttattaataatatgattttacttacataaaaaagagaagacagagaaatatatttgttacgtgtgacaacgacagatttttagtgttgtgttacgtgtgaaaaaaaaacattcgtgacgcctccgacccttctttccctcacatcgtcgcacattctcaatccaatggtttgattgtgtgaacccaacttggggagggggtttggagaattattctccgacctggtgtgacctcccactaagccgtcgcggcgcttgccgcgcctctgacactccatactaccaaacgcctccggcaagccgttgtgttgcgctcgggtagcaaacaccacgagactcatgacgcttactatgtatctcgagataaaatttgatacctttagatactaaggctgtgttcgctcattagggttaggaacccatctcctttacacggaaaacggaacggtccattaggacatgattaattaagtatttagtaattttttttcaaaaatggattaatttgatctttttaagcaactttcgtatataaactttttgcaaaaatcacactgtttagcagtttgaaaagcgtgcgcgtggaaaacgagagagaggggttgggaactagaagttccgaacacagcctaagtatctcgagatacctctagttattagtgtaaacttttctagttaaaatctaattcctctatatactaagtatctcgagatnnnnnnnnnnnnnnnnnnnnnnnnnnnnnnnnnnnnnnnnnnnnnnnnnnnnnnnnnnnnnnnnnnn

SEQ ID NO: 25806 - DNA, 1241 bp, Oryza sativa
ccatcatgatgccaagccttgaatcccttgtgttttgtgtctacgtacggttcctaaaagatatggtggaaatgcagcctggctttgacaatctgcatatgcagcttggctttgaaaaagttgctagcagttcgctccagagggtcactgcaacgatccaatgtgaggatgctactgctgctgcggaggtggaggaagcgaagacagcattggcgcatgcagctgacctccatcccaaccgtcccacccttacaactcaaatggtgaacaagcataagatgctctcatccgaccgagagctacgagtgtgaagcagaggagatgatggagaactggcggagagaatctaggagcaggagagcaaggataccagctctgctttcccctgatggttaccctgcaaaagcaagcatacatgttgcattgcttctgtatcaattctgtgagacaatttagttgattctctgaacagagtcagctaagtgccaaatgcccggttccagcctgtgtttgatcgattgacgattggttcggatatctccttcacttttcctgaactccatccacgattcaagatgtcaaatgcatataatcattaattagcagctagcattacgtggacaatgtgcttcaagatgcatttcgttttcgcgtttcttgtatatttttgtcagcgggctatctttgtcaaaacgttatgcagttactccaccggtctgtgttatgaacagcggtgtgactgtacttgttcatcccttcctgtttgtgtttctgtcaggatatcgaacaagttctgaatcacattggtactgaaagagactagacttaggcccccagctgaatagtagacaagaccatatatggttcgcatgtattaacttttaattacttcttctaatagaatgacgtacaatcgaattgccagtttgatgaaaaaaatatggtttagaagtgaggttgattgtccttgttaattaggtttactgatccactgtctatcggtagtccacttccaagtaactgaatcatattgtgtactcaggctaatggtcccaatctcgtccggagtctgaatatttcatgaaaatctcctgcaacattgacagtgaaacctgaaatcagttatgtatactgaacgtatgcctatgggcatgtctgtaaaccgtaaccgccacctgaagaaatcaaattcagaagacatacattattagtcattcgaattcagaaggcagattgatagt

SEQ ID NO: 25807 - DNA, 6349 bp, Oryza sativa
  unsure (1)..(6349): unsure at all n locations
cagatgtacggcaaattgtttacttacaacttttgtggtccataaacgtgctttctttattgtacagctgatcactaaaatgagctgagttgtgtagtccctttttctttctttatcactattcacttgtgctttttttaatatatatatagcagtcactcgcatgcattgatccatacaggctctctccccacagaaaaaaagttgagcacattatgtgctatcattgtacttgtgccgtgcttatgagaacatgttcaaaggaagagctcagcttgtgcctgtaaattcagtctggaagctgaaaacaagatggatgagcttctacgggtacagagggagcttctacgatttcagttactgctatccaagcatttccaccgatggagaaatattgacatctaacttgtttcaggcacagtaatagctttgacaggtcaggtaaaatagccagattctagagggagtgaagactgtgcaacgaatgaggtgaaacttaaaagtgagagtgacagctaaagataccaagattgctctccactttccctacaaaacttctctcatggtggtactccaaagcaaagaatcctagaaaaaaagggcgcaagcacagcactgcagcttcctatctcctttatttggtcttccattgcttcttgttgctgaggttgccttcctattgcccccttcccttttccactcttctactaacacttgcttcaggctactgagggctttggcttctcggtgttgtcgctacaggtgagcttggcattctgtgcatttttgcgttctactgctaatctggtcttgtgctaagctccactattagcctcttgtgtggtcataggtggctcctaatttagcttcttgtgtgaatctgatgtccaatctttttctaaatgatctgtaaattcgctttgattttggtctgattagattattttgtttatttctttgttactttcctctcttttatgggttgatagtatacaattatagcccaaaaatactgttgaattcagagatcttcattgtgataactgactgatcatttaaagagatggtgcttttccacctacctgttgaatgttaaaccattacagatgattttttttttgaacatgcaatttctatagatctctaactaaggaagctggaatgtcaccttatttgagcagtttgattgtattgcacattattaaacttgtgtttcaagtataaatcttttttttttcgccgggccggcgtaagatacgcggccgaagtttattaagattgggaagaggttcaaactagtacaacaattacagctgccatggaggctagagctgtacggccgctattgttcaagtataaatctttacttgtttgaatattcaccataatgttatagtgatgaattgcttctctctttcctatttccaggccaacgttttatctgagggtaaaattcaagaagatatatatggcttttggtgcaaatgacattgtgttgcatatcaagagactaatgtattcatctgtcagaattggatatcaatttgcttgtgattaccctatagtactagctgctggcgttttgttgctgtttctacacaggctttgcccttctctattcaacttcttgctgtcttcatctccagtcttcctgttaactgcacttctgcttggagcacttttgagttatggtgaacctgctgttcttgttcttggagagaatcaacaaactttgtcctttaaatccaagatttccattactgactgttcgattgacaaggttgagactgttgctgtcgaggagcacttggataaaacaactaccagtaatgaagtatatgtcagggaaagaaattttgagggtaatatacatgacactcactgggaagagaaaaatggcacctacatgacagttgataccgctctaaatgacgaaatacatacgaaggatggaacttctgattatgatttgcaggatacccaccgtgaaggaaaaggtatcacatcagtggaaactgatactgttccttgtgtggcgccttcaagttttgcctacagtggtgtaactgtggaaactgaagacgttggggagaacagcaagaagaatgatgagctgcaagaacttggaagcatcaatcctgaaagtgataacaataaagtacaatatcaatatcagttaggtgagtttatgagttcatgttgggaacctgttatgagacaggagccacaggatgcttgttctgattctgaatctgatcttactgagagttctcctgatgcatcaatgactgacattattccaatgcttgaagagttgcacccattaatagacttgcaaactggccacccttcattggtctccagagacaacttgaatacttcttcggatgatgatgaagatgatcttgaggaggaggatgctagcacagatgaaaatcaattggaagggaaaatagatgattttgctaactggaaggatgttattgatctaaattacttggatatggacaataatagcaagctggagggtatgatggatctgcaaagagcaaagaacattctgaaatttgaacttgacaggaagttaatggacttgcaagcagctgatgcagtacagaaaatggaggaggcatcacgcttccgtgtgcaggttccctccatttccactggaaggcagaacccatttgattcttcaaatggctcagatgaaataatagagttaccacatgttcctgattcagcaccgtcttgtctccttccacggaaaaatctatttgatctttgcagtcaaccaaaatatggcccacgatagtccattgcaagaaacttggactcctctttcgtacttttcagcaagacggcatagaaagcatggaaacttatatgttaggcactctactagcctgcatcacaatagcttcaaactggagaaagatgaaataagtgaaaatgatgcccataatagtcagtcagactgtgatgccaagcaagaagggaacaacagcaagttatttggttcactggaagcacatataggtgaagaaatcaaaatattaggcgcagcaatttcagatgtgggtgtattagaagtaaattctggaatggatagtggtaaccaaaatgctgatttcagtgatgatatcagtttatctcctatccagaagtctagacaaagcactttcgaagctaaggaagcagtacatgcaggtaaaactgttttttaaccctaagtaatgtattgcaatttgcctactggaaatgataactcaactgaagttgatgtcatgcaggtattgagcaattaacatcgtgctccccttacaaggtaaataattttgaggcacatattgttgaagcagactccattgatgaatttaactcattgtttaagtgccgtatggaggaagtactagtgcaatccatctcagagtccagtatcagtcaacccttgacagttaaacttgaagatgaattgagtgaaccattatcttcagactctgggaccgggacacatttcattgacgggagttcagttgaagattcggatccacaatttgcacagctcaaggatgaagcactggtatctgctacttctaacgcaacatgtcgtaatgagtcaattgaagagaaatcaagtgaagcattactggcaggaaacgaagattattcagaactgccaaatgaactgttaaaatcaggagatccacagtttgcagatagttctgagattcaaatgcaggttattgaggctacaggtcactgaatcatcacaagggcctaaaacaaggccaaacagccaatttctcagagagatctgtaaagcatagatgtcctgtcttagctctctgaacaggtttctgcccccctttgttccaacttactctatggcgtctggatttaactattcctcttcttaatacaaaatgtgcagcaatcatgctgtttttcctccaaaaacttttctcaggaagtccgcaatgtcagaaatatccaaggaacagtggatgtacatatggtttctgcttatttcttctcttttgtttctgcttatttgctttcggttttgggctaataggttagtagataggagagtagatgacattgatatgaaacaccagttgcagttgggtgtgatatccattcagtcaagccggtctttctttcgctgcctatggagtattaatttttcttgtctgccagacaggcattggcaacccctgatcatcactttgtttcagtaaataagatgattggatgtctgtttgcctgttggtaaaccgctggactggagttgcagcttctgcagtttgcttcttcaacagttatcctgtcagtaatcattgagtaatcaagtaatgctttcacagatttttttttaacacctcctcatgctcattatctgcttgctgttggtggtttcattaagaaaatcacagttccttgattaaaaaattcatagtcctttacattacatacatgatgcattgatgcttatgttgggtatactgatctgaatctgaggcgtgctttgttgggataattgaagatacgctactcccctagaaccattttcaggaaatcactcctttagcttgaccttgctaaaatgaattgtttgcatgatactaacaaatagatgaatctttggtgtagaatcgcagtgatgaataaatctattttttttcatctgtttgtagagccatcttacagatgagagcgtggtattcttcgactgttattctgttaaacaaataaaaaaacttaagagtgaagtacatgggcacacctaaacttaagagtgaaataaaaaaacttacagaagacacacctacatctaggttcctgaactcgcaaaatacatttttaggtccctaaacttgtcatgtgtgtcacataagtcctaacggattcaaacccgctccatgcgctgacgtggcattgccacggtggcacctacatgtcgagcatatataaaaaataaaattaaaaaccatattttctcctcgtaggtaaacagaaaaaagaaaaaaaattctaatgtagagaggagaaaatatgtatttttaaaatttttttctatgtgactaacacgtgagtccgactaacacaaagatgctatcgtgacatgccacatcggcacgtggaacgggttagagctcgtttggaccttgatgatatctcaagacaagttcggggactcgaaaatgtattttagtttaggttagggaccgctcatgcatttcactcaaaagttaaatatgtaccgaacatagggtcaaacatttgacaactacccaacacacagaaatatcgttattttcaaaatcacttcaaagttgaccaagacaccttcagcagtacacgggcgccaccaagtttaagctctttcatgtcatatccatgtcttctagctttgaatgggcaatattcagagacacgatacgagccatccccctgatcaaccttgaagaccaatggacagtatttagggatatcataatccgagccatccctatgaacagccttgaagattaaaaacaaaggtgtattctccaccacagcaactacaaacctatccaggtcacatggcttggaaatgacaccatcaaagagccgaatcttttcaggaatttgaccgatataggaatataaagataagcttaagccattgtcatgcacttgtgatatgctaacttgtattgtggcctccactgcttcgtggaaaagggctcgactaatgtcgaccgcatcacaatcaccttcaatccgttgcgtaaacactctatcgggaagcacgaattcgctgcagatgatggcaccatcgatgagctgaaaatcatcgtcttgtgtctctccgttcttgatcttcatgtcaaactcgatgagcacacgaacttggtttccaatgcctctcttggggcctgacattggtatcaatgaattatccgaatcaacgccattgtcttatcccatgatgaaagggtcatccctggtgcggttgaagatgtagttgcgtagcgggtccaaatgatcccggacagcaaagtatccatacaagtgaactgggccatcaacagcagcagtgatattggatagcttgagcgagaatatctgcatcatgaattgcacactgtgcgccttgcaagcccacatgtgtggccggcaattggttgggtttgacagcatcattgcctccatacgagctgaacagccagccatacacgtcagtggatgacagtaagttagattgttaaccccaatattgaaatgagcaggaaagaaannnnnnnnnnnnnnnnnnnnnnnnnnnnnnnnnnnnnnnnnnnnnnnnnnnnnnnnnnnnnnnnnn

SEQ ID NO: 25808 - DNA, 7100 bp, Oryza sativa
  unsure (1)..(7100): unsure at all n locations
nnnnnnnnnnnnnnnnnnnnnnnnnnnnnnnnnnnnnnnnnnnnnnnntgctaacaagtgaagctaaattgaaagggaactaattaagggcagatgagaggattgtagatgatgcaaagttaaattgaaaaggaagtaattaaggagatgaggattgtaggtgatgcatggtggagaggggaaaaagctagggtttgcaagaagttaaaacttactctctcgggtatcgtcgaccttgtaaaacatgtgccaaaaatcgtcgccgctgtagatcgatccatcgctatgtttgctgcactcgaggatgaacgcgcgattcaccccgtcctggctacctgctgctcgcctcccattcttctccgcttccgcctccgcctccaccagctcaagctcggactctgccgccgcttcgccatgaaatcccctcgcgattcaacccggcctcagcctctctcccttcgatctctctcgttagcttcatcttctccgtcctccacccttgggttttattttgatttttgcggcaacaaatccgaaaccgattcatattagtagtagctttgaaaaaactattatcctctcaaatagcagtagaaaatagagagaataggatatgggctgctttctgggcctggatatgggccgtacttccattttccgttgaggcccatctagacccataaaagatgaagtttcttccctaacctccggcccccgctcccttttcttgtcttctctctttctgtagtctgtatatgtatttttgtgttgatgcaaggtaatagtttattgttttaagttaaacacacaaatacgattttcttattgtttcccacgaagaattgcatatttgtgtagcaccatatctaatttgtatgaacatacaagaatagaaacttgctttcttacaaataacacagtgacgttctttgactgctaaacttacacaacaaataaataagcttaaatatgtgctgaacataggaccaaacatttgccaacaagacaatacacagaagcatcgttattttctgcttagcatagactatgtatcccttgggctgttcaaaatcactccaaagttgaccaagacagcttcaccagtatattggtgcaaccaagtttgagctcttgcatgtcatactcatatccatgtgttctagctttgaacgcacaacatccaggaacatgatctgagccatctctcttgtcaatcttgaagattaaaatcaagggagtattcaccaccacagcaactacaaacctattcagatcacatggcttggaaatgaatccatcgaagagctgaattttttcagggattctactggtataagaatataaagataagctgaagccattgccatgcacttgtgatatgctaacttgtactgtggcctccaccgtactgtggagaagtgcaagacttatgtccaccgcaccacaatcaccctcaatccgttgcgtaaacactctattgggaagcacgaattcgctgcagatgatagcaccatctatgagctgaaaatcatcatctcgtgtctctccattcttgatcttcatgtcaaactcaatgagcacacgagcttggtttccaatgcctctcttggggccaggcattggtatcaaggaattatctgaatcaacaccattgtcttgccccatgatgaaaggatcatctctggtgcggttgaagatgtagttgcgtagcgggtccaaatgatcccgtactgcaaagtatccatacaagtgaactgggccatcaacagtagcagtgatattggataacttgagcgagaatatctgcatcatgaattgttcttcgtgaatattgcaagcccacatgtgtggtcggcaattggttggatttgacagcatcattgcctccttgagagctgaaacgcagtatgtaggagcattttacatcagcggataaagttaaattttaaacccaaattgaaataaaggagaaaacaaacaaatcaagaggacggacagaatattgatacaattaaggttttaaatagcaaacttggcgctgccatggatccaaactcccaaagcgagctatacaatatcgtataaggtggttttaattctattctaattaagaaaggcctaaatttgacatcaaagtagatagatgtgttatgaaaaaaaaagcttaatttgacatcagttccatggtattgagcatacacaggaacaaattaggtgacacatgaatatatagaattgaagttaaaacttaaaaagagcatgaacgagttcacagcatgaggtgctaccgagtgaagttaaattgaaagggaactaactaattaaggagatgagaggatggtagatgatgcatggtggaaaggggaaaaaggtagggtttgcaagaagttaaaacttactctctcgggtatcggcgaccttgtaaaacctgtgccaaaaaatcgtcgccgctgtagatcgatccatcgctatgtttgctgcagtcgaggatcaacgcgcgattcaccccgtcctgactaccagctgctcgcctcccattcttctccgcctccgcctccgcctccgcctcggcctccacctgctcaagctcggactctgcccgccgcttcgccatgaaatcccctcgcgattccacctggcctcaagctcgatctctctcgtttgcttcatcttctccctccttctcccttcggttttatcttgcggcaacaaatccgaaaccgattcgtattgctaccattaaaaagacgaggaaaagaaagaaaaaacgattcttatatcctctcaaataaatactagcagtaaaaatcgatatgggctgatttttgggcaaatatatgggccgtacggccatctaccggtgaggcccatctaggcccataaaagatgagtcttcatccctaacctccggacgactccttgatgctgcgcctcgcgatcgagcggctccagcgctaagtagcctctcccttgtctcacaatcattccatcccccttcctggctaccttgctcgccgggatcaggagtctgctgattgggttgggctgcggacctgcggtggagggattcagggtttctcttgtccctgatccactgcctccacgaccaacaatggaggacaacgttcttgtctcctcgaaaatccatggaaggtgactcccaactcatgcaccttttcctttatttgcttgtgattttaatacgatatggaatctaaacaaaggcccccgcaaaaaataaataaatagagaatctaaagaaaggcatccttacatggcagaattccatcacattatatgcttatattcatttatttgtgtactgttactactaataataatgcaaaataccctctgacatatgtgttattttgctaaaaaaaatagtttcaagaagtcaattctgtgtgctacttaaaacttctgaaagaagtatcattgcatactggcagagcatgcatgatatctttcaccaacattagccagagttactgcccttctttctttttcggcatgcatacctgtagggttgtactgtaatcaaacttgttgaaaaagagagagcatcttacagatgttatgctgaggcagaattcatggttattttcatcaccttgttaatcatgctgattgttggtttcaggagtaaaagcacaacagccaaaaggaattgtataatttgcggacaacgtattagtaagaggagaagaacacaacataattttcagaagataagtcgggggcagcttaatttacagaggacaagaccatgtctgcttaattttcagtctcttcccaaggtatgtcatatcatgacatgaagtcatgaaactctcaactccttttgtgctaggactaggaggctgtattctgatgcttgttcaaaatgcattgtcaggatattgtactaagggtaatgtcaaaattaacattaaaggaagtcgctcagttgagtgttgtgtcaacaaactggagacaggcttggacattccatcctaatctgtactttggtattaaaacagcccttggaaataatgccaagagaaaaggaacaagctctgatctgaactgtagaatatcaagtggtaacaagttcattaaaagggttgatgctattctggaaaaacattgtggaacaatggtaaataagtttgctgttaagtttggtttgtcaaatgagcatgctaaccatgtcaatggctgggttgcgtttgctattgcatcaaaggcaagggttatcattcttgacttctccccagattggaaatcacatgaaaacaaatatgactttccttgtcatattttcgacaaacataatggatcttaccttgaggctcttcggcttgacagtgttactttgaatccacctctagatttctgcggatttgcaaccttaaactgcttgctcttgacaatgttaggttgcaacatttagagcagttaatatcgaaatgccatgttctagagtggttaagcatccaatcatgtaaccagctgcataatttacatgtgtcagaaccattatgccgtctgcaatatttgtcaattcagggttgtcatttacaaagaatggagttacatgctccgaatctcacaacatttgagtacgacggttccctggcattggtaacgctcaatgaatgctccaatatcaaagcatcaaccatcagactttttgatgagaaaaccctccaaaatatattaactggaattccaagtgtattacctcatgttgaaacgttatatgttgaagttcatgtcaaaactcaggtctgattattcttgtactctctatatacatttaattctattttattttctgtttcacatcttgttgtttgaacctatgtgtggcctggtcaccctccagatgtctggatttacacaatcacctctcaagttcactcaattgaagtgtctaactttggaaataacttttgagagaggttcattcgatagaaattcagtcttccagttgactaatcttttcgtagcagctccatttttggaggatctttatttggatgtaagtagctatatcatttgtacttcactacttttattgccttcttccctagccagttacagttcgccttttgtattctcattgaccgattacctcttttttcctatttaatgttatttcgttggtttggaaacccaatcagaataacctgctaagccagtactgtcaatctaattaggaattacctgcttgtccaatgtgccctatgcatgattcatgaactcataagtcccagaaactggaacattcgctgcagactattgatcctttttaacgatcatcagaccatcgaacatagctttggcaaagtaatattgttcggcccggcgaaagtagtattgttcagcattagttggcaactgcatttttttccatttgacagtggactttgtaaattttaatcataattatttgggacatctgtagaagcttttgctatatcgatgtcactgtttaccctgagcatcacatcaccatatttatgcactgtacaagataccaaatagtatgaatcaaggtgataatatgtttggaaaccgattagccatgtgtttccttgattgaatatatttgtatccaaacagagcaaaagcttctttttttctaacaaaatctcagaattccatcccctgcatttgttttgacaagatatatgttcaggctatccttctcttcctcgatcatgaatctttgatcttcttttccctaattattacgtgttagcttgctccttgttagtgatgccataatttcttgcagatgtattgtagcttgaacaggtgccctttggatttggatgacatcgtggatcagcctcactatcatctcaagatggtgtgcatatttggattttgtggcaacacaggccaggttgagctagcaaaatgcattctcagaaatgcgttaatattggagcaaatgatcatcgacccaaaagggagatatcggttggatggatattttgggcgccaggaggcagatgagaagcttgttccagaagatatagatggtgtactcacaattctgtaacttatactccgtacagtagcaaactacagtcacaagttgaagtgttgttccttcaaggcactagtaactaggagtaagttttttttaacagagtttacagagattattcggtactgcaagagttgtggttcactgttcaatacgattatattagtatgtatcccttccgattaaaaatgtttgacatttaggaccatatttagttgcatttttaaaaatctagacatcaataatttgtcaaatgcttagttttcaaaatgatatacgtagatttgtctcataatattataaacttattggattatataaacttattctggtgtaaaatagattgccaaaatttttaaagtgtggccgaagtttgtgctaaacattaaactacttgagaaagtatgcactattcatatgttacaatgagttttaatctccaacccatggaccttttttttttaagcttcaattcaaaggatgccaaaggggtgggagttttaatctccgtcccccaagggactattttttctttccccaagatcgagcttttttttaatgtagttttgtgcaaacacatttggatagttttgaactactagtatatcacatagtaggaaataattgattactatggaagtattcttcacagacaaaaagcttcagttttcacacacatgtacacacacatggattgtttagactagcaatgcatataagaaaaataattacttcctcgaatatgcggatatcttaagttggatatagtagaatactagaatagataaacatctcatcttacgcagataagtgcttctggcagagaagtgcaagataacaaccacattcagacaggatcatataaaaattagagtaaagtccatcaccggtccctaaatttataccgttttgtcatcccggtccctaaactcgtaaatcgaccattcaggtcctcaaacttgttcgactgtgtcatcctagtccctaaacttgcagattactcgtttaggtcctccaacttgttcagttgtgtcaccccggtctctaaacaggacgg

SEQ ID NO: 25809 - DNA, 802 bp, Oryza sativa
cgggatgacacaatcgaataagtttgaggacctgaacggtcgatttgcgagtttagggaccgggatgacacaacggtaaagtttagagaccggtgatggactttactcaataattaggtacagtatgaggcaccttgagaaaaatcagtgctagaatggaacgttctctttcagatgattacaacctacggagtagcttgtacctaattccgtagtaaacccccataatatttgactctttcattcacattcatcatcgaacccacgctagccatttccttgatcaaattatcacacctactcctgcaggacatagtaaataaagtagcacgttgtcttaaaataatactactccaccttttaatctcataaatgaataaacggagaaatagaaaaaaaatcaggattctgatagaaatgcaagtgcaaagcaggtgattgaaaacacagaaaaagcatataaataaccgtttattggaccgctggaaaaatacagaaattgaataagagagatagacttaaaggaaaattttcaagagattattcatttcataggaatttcaaaggatatataggatatgatttaatcttttgtttcaaaagcattcataggaaaattttctatatggttgaaatcctccaaagttcttatgtttttcatccaaatcaaaaggaccctaagcatttttagtatttaaaatttgtaacacaatatactttctttattttagaatataagtatttctactatttaaatttcatatacaatataagcatttccaggtactacttcagaattcag

SEQ ID NO: 25810 - DNA, 755 bp, Oryza sativa
  unsure (1)..(755): unsure at all n locations
nnnnnnnnnnnnnnnnnnnnnnnnnnnnnnnnnnnnnnnnnnnnnnnnnnnaggcaaaggtataatgtagctaagaatgttttcttagtcttttcccggtcttggtgtttggtgtagactagatttgctagataggcgccgtactatcaagaggggtctatgaagcgagcttgtggatgatcttgtgctatattagttcatatgcatgtaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggttggttgagctgaaaagtgacctgcggtctgaccgtgggccttaggccggtctgaccgggtctgttagccggtctgaccggcgtggtaaggccggtctaaccggctccactggtctgttgcactggtctggtttttggtggcgatacagagccgccagagccgcaaccggtcagaccgagccgacgcggtctgaccgagccgtggacggtctgaccggccactacactgcagttagaccggccaggttgagtgggctcaatgattgccctg

SEQ ID NO: 25811 - DNA, 625 bp, Oryza sativa
  unsure (1)..(625): unsure at all n locations
nnnnnnnnnnnnnnnnnnnnnnnnnnnnnnnnnnnnnnnnnnnnnnnnnnnnnnnnnnnnnnnnnnncctgatcgttgctttgtgactttgtgaagtgtctgggttcacaatggtgagtgggggaactgaattagaagggctctagcccttttccctctgaaatcttaccattctgtgaaccctcctactgggcttggggatcttcatttttgcagaagtcgtgactgtaacgctgggtgtggtggctcacacctgtaatcccagcactttgggaggcggaggtgggcagatcacctgaggtcaggagttcgagatcagcctggccaacatggtgaaaccccatctctcctaaaaatacaaaaattagccaggcatgatggcaggcacctgtaaccccagctactcaggaggctgaggaagaagaatcacttgaacctgtaatttctataaaatgacaattttgcccttttgatgaacatagaaatttatgaattacattattgaaaatgtaaaagtttgtcatatgagactattatagttatgagtttgttgtgcgatacattatttatgacaaaaattatttttagataatgaaacaaaaaatatgtatttaatttatttttt

SEQ ID NO: 25812 - DNA, 706 bp, Oryza sativa
  unsure (1)..(706): unsure at all n locations
nnnnnnnnnnnnnnnnnnnnnnnnnnnnnnnnnnnnnnnnnnnnnnnnnnnnnnnnnnnnnntacctgcatgtactgcttccttagcttcgaaagtgctttgtctagacttctggataggagataaactgatatcatcactgaaatcagcattttggttaccactatccattccagaatttacttctaatacacccacatctgaaattgctgcgcctaatattttgatttcttcacctatatgtgcttccagtgaaccaaataacttgctgttgttcccttcttgcttggcatcacagtctgactgactattatgggcatcattttcacttatttcatctttctccagtttgaagctattgtgatgcaggctagtagagtgcctaacatataagtttccatgctttctatgccgtcttgctgaaaagtacgaaagaggagtccaagtttcttgcaatggactatcgtgggccatattttggttgactgcaaagatcaaatagatttttccgtggaaggagacaagacggtgctgaatcaggaacatgtggtaactctattatttcatctgagccatttgaagaatcaaatgggttctgccttccagtggaaatggagggaacctgcacacggaagcgtgatgcctcctccattttctgtactgcatcagctgcttgcaagtccattaacctcctgtcaagttcaaa

SEQ ID NO: 25813 - DNA, 996 bp, Oryza sativa
  unsure (1)..(996): unsure at all n locations
tgaaggaaaatataatgggaagggcatggaagaaatcaaattaaaatttcaggggtatagaagggatcagataaatttcaaggatgtgaaagggattgagtgagtttttaagggtatacagggaatttactctaatctctatggagtgcgacatgccatcttctttcgtcaagcaaccaatcgtcctaccgaattggctcgtcatctatcacgccttccattcctcgtcaaatcctattacattaatgcttagattttttttaagaaaatcctattaaatcatcaattaattaattaatcaatgtgccattaactaagaacgtttaattgttaatatgtctatcgggatgggagatgatctcactcgattttttacattttaactctttttaaaaacttattttataagtagacccttaaacaaaagacaacttcgacgttgggcaaccgcgggcgcaactatgacctccaaatttgtattagtccactctatactctgagtaggcccacattcacatagcactctatttataccttcattctcatttctaaaagcattaacctggaggtactatgtatgcttgaaatgaactcggtatataagttgacccaaatctatctagactctccatgtggagctcttcccaccaaacgaacacttgggtctaaaccggaacaagaagagtcgcgcaacgaaacagactaaatgggctggattttacactctcactccttcatgggttgatgccctagctgcctagcagctcaccgctactcaacagccaaatgcccagggtatcccctcggtgctacggcgttgtgcctgtgcgtcgtgtccccctccatgggccaacacgcacgcacacttgtgtaacacgggttgaagttctaatatcacatgtaacacccgagacacaaaatcaacaatagtccactctannnnnnnnnnnnnnnnnnnnnnnnnnnnnnnnnnnnnnnnnnnnnnnnnnnnnnnnn

SEQ ID NO: 25814 - DNA, 628 bp, Oryza sativa
  unsure (1)..(628): unsure at all n locations
nnnnnnnnnnnnnnnnnnnnnnnnnnnnnnnnnnnnnnnncataaataggttggaagaatgcatttcccatgaagaagcagattttgttttaaaaattataaattggaacgattgttaaacaagttttacctgctttagtacaccagcctccatatcttttatcagaacaaacctcgacaatgcttagagccacagaggcatgatttgagtttgcaagctttgaagggttttccctcaaagccagggggagcacctcttgtaccataatcataagtcagttcagtcatgggagggatatgttccattgcaaaaaacatgatatgtgggtagctgtcatcgccatggtcatactgtacagcttgccaaaggagatttggagaacagctatggttcagaaaacgagccacattcccttcattgtttgctcttatgatgattggtagtttcttaaagttcttggttatcacagccgtacttttttcttcaagtaattcttctcccaaattccagcttaaagccttattgccgggacatgaagcgcgaaaggtatatttgtcttcctcaacatctatgtccatcttagtttcatcaatgacttcaccggcgtactcacaaatgaatgtgcca

SEQ ID NO: 25815 - DNA, 768 bp, Oryza sativa
gccagtttctctctgttttttttttgtgaaatttgactgtttctcatatttgatagttcaatcaataaatttagtcacgatagataataaagcttagtgaatacaatcgacttacatggaagcgctttctaattaatacaaaaaatcatgtaaaactcacattgtgcaagggcttggtgaaataataggataaggggtatatatacaatagagtaaagtccatcaccggtccctaaacttgtactgctgtgtcatcctggtccctaaactcgtaaatcgaccgttcaggttctcaaacttgttcgactgtgtcatcccggttcctaaacttgcagatcactcgtttaggtcctccaacttgttcagttgtgtcaccccggtccctaaacttggatttgaatatcatctgggtcaaataggacagtctaaagactttatatttaaaaataattcataacttgttcatatgaactctaatgaagacaaactttatatcaaacttgtagccctcgacgcgatctacaactttgtagttgaattttttttattttaagtcatttttttgtcccaaaatataattttaaaattaaaatttaaaaatctataaacatgcaacaatattttgggaccctaaacagttttaattcaaaaacttttcaactacaaagttgtaggtcacatcgagggctccaattttgatataaagtttgtcttcattagagttcacatgaaaaagttatgaattattttttatataaagtttttaga

SEQ ID NO: 25816 - DNA, 650 bp, Oryza sativa
  unsure (1)..(650): unsure at all n locations
caggattgcacctgtggttgctgcatgaaaccgtgggttggtaacttggtatgccggagggcagaatcgggaattaacaggacttaattaatcgatgattattaattaatagtgactctagtctagttgatcagatcaatgtatatatccatatacatgttgagaattaattagcaatagtaggtggagtaagaaggaagggtgagattcgatctggggttttgtgtacattgtactatgtggcaatgagggcaagaacgtgtactgtatatagctttgcagcctgtagttgtagactgtaaagacgcgaggtatacatacgcgtacgcggtacggcggcttatgttgcgaatgcggggcgtcgggagatgccacgtagagatgccaggtacccgttcctccagggcaccaccaggcaccagcaggctgcatcgtgattcgtgaagcacaggaggccacgcacggcggaggtaggcggccggagtagtagctggccagccgccgtcagatcagcttcgtcaacaaaatataatggatgcttgtccggcctgcaatcggccactgcatgcctgatgcatgcatcgtgcagnnnnnnnnnnnnnnnnnnnnnnnnnnnnnnnnnnnnnnnnnnnnnnnnnnnnnnnnnnnnn

SEQ ID NO: 25817 - DNA, 761 bp, Oryza sativa
  unsure (1)..(761): unsure at all n locations
nnnnnnnnnnnnnnnnnnnnnnnnnnnnnnnnnnnnnnnnnnnnnnnnnnnnnnnnnnnnnttttttctttcttttcctcgtctttttaatggtagcaatacgaatcggtttcggatttgttgccgcaagataaaaccgaagggagaaggagggagaagatgaagcaaacgagagagatcgagcttgaggccaggtggaatcgcgaggggatttcatggcgaagcggcgggcagagtccgagcttgagcaggtggaggccgaggcggaggcggaggcggaggcggagaagaatgggaggcgagcagctggtagtcaggacggggtgaatcgcgcgttgatcctcgactgcagcaaacatagcgatggatcgatctacagcggcgacgattttttggcacaggttttacaaggtcgccgatacccgagagagtaagttttaacttcttgcaaaccctacctttttcccctttccaccatgcatcatctaccatcctctcatctccttaattagttagttccctttcaatttaacttcactcggtagcacctcatgctgtgaactcgttcatgctctttttaagttttaacttcaattctatatattcatgtgtcacctaatttgttcctgtgtatgctcaataccatggaactgatgtcaaattaagctttttttttcataacacatctatctactttgatgtcaaatttaagcctttcttaattagaatagaattaaaaccaccttatacgatattgtata

SEQ ID NO: 25818 - DNA, 611 bp, Oryza sativa
  unsure (1)..(611): unsure at all n locations
nnnnnnnnnnnnnnnnnnnnnnnnnnnnnnnnnnnnnnnnnnnnnnnnnnnnnnnnnnnnnnnnttgaacggaatatacaaataaaacataaccagaccatactacaagtcactcctatgaaaacttctttttactaaatattaatttgcactataagtcatctattgatatgcatataaaatatgcatataaaaacagtatatactacaaattaactgtatatgcacattgttgtaaattgcagcttggcatggcgagcgcattagaaacgttgtgtggacaatcatatggcgccaagcaatatcacatgttgggcatctatctacaacgctcatggctagttctcttctgttaggcagtcatccttctcccggtctatatcttcacaactccactcctgattgctctcggtcaagatcctgagatctctgccgtcgctggcaccatctctctatggtacatccccataatgttctcttacatatgggcattcacgctccaaatgtacctacaagcgcagagcaagaacatgattgtcacttaccttgccttcctcaatcttgggattcacctcttcttgtcatggctcctaacagtcaagttccaactt

SEQ ID NO: 25819 - DNA, 1313 bp, Oryza sativa
tgtcctgcaaaagggggccggatgcaaaattgttgcctacgtggagcgccacatcggcggtcagcctcagtcaatcgaggtttggacctactgtggttcattatcatggacataaatgtgcaattttcaagtttacggaactatgtgacaccaccgctctagtttaaggactggccatgtattttactctttcatatcatcagagctaggaacatttttaataggtaactttgccctacagtattttcttttcctctatgactcattaaaacatttagtcaaatttgaaattagcaattgtcaataattatggcctacaggcatagtgggcactataaaggactcaaggaacgcaatgtaaaataattaagctgctggatgtggtccactgaaaaaggatatgtatgctagaccaccacttgtgaaaacaaatgtcagaaaaatgttttttcccctttatatgccaacgcgtgctacaatcacatcattatagtttttttcacatgattataaaattatgtacagcaattttctttgtcaacatgctagatcatttttatgtatttgagatgtttgtttagtctagaatttacatggcagatcaatggaaaatcggaaatactatgtaaattccttttttcccaagtcaagtacatgatggaactagaagtaaaataacgctggaacaatcatgatgcaatacaggccaaggtatcagaatgcattaagtgccaatttttcaacggtacatatctacaacataacagacctattgaagagagaaaatcctttaccttgggtacaagcatcatctacatctttatccatcctttccaaaacactaacagcattattgcatttgtttaaagctgtgtcttcgtcaaaatgttgatcaagcacagactgatatgctgttacaatcttttctggcatcccgccaatagtaagtttctacatcaaaagaaaaaacaacaaaaatagctcacattcatgacaatatactgcatccatcctcagcacaagaaaatatttctttagcaggtcaagatctggcaacttacttttgttactgtaccagaatcttttcgcacagctttggaaactgaagaggggtgagagcttggatttgagctattgccattgttacccattgtatgagtgctaccaccaagaatgtcatctttcagactttcaatacgggttccaaagaccttccgttcatcccaaatatctatctgtaattttaaaaataaatatatttttttacttttcgggttttggccttgtgatagaaaaaaatgaagtaaatagac

SEQ ID NO: 25820 - DNA, 847 bp, Oryza sativa
  unsure (1)..(847): unsure at all n locations
gtagtggccgcatgctgaacattactccacatattctccaagaaagtctcgttccacacgaagtgtgccaaattctaaataatgaaagtagacatgaaccacatttcttcagggggctgtagagcatactttctttaccgtgaggctacttcacacttttgggtgtctattcattggatactgcaattttagcgatggaacttaattttgtagtgaatggtcaatgatctgatgttgcaaagggcagcattcactctgatcagtatttctgtacctccacatgttcatcttcaacattgagggtatcatttctgtactgtacatggaaaattaaatgcctgagactgttttttcctggtttgtggaagtctgagactgaacagttgattatgctcgttgtttatttcaacattgcgagatggttactttttattggcttcttgcagcttaattttgccacttgggttgcgtatataacgctgtggtattgaaaggtcattatctacttgtgttggtgatgcgtatgtctgatgagatccttagtgccatttattttgagtttgttgtgtcttgctggaattgttgggttacattccctgtttgaacaatgaccagtcatgaactgttgtcctagtagtcggtaaggaggtcttacagtgactcaacttgaattatgactgcactttcactgggctgctggaatttcctcaacctttgtgcttgttgcaggaaccgagttaccagcttgatgttatctacggaggcacggagtgatggaatnnnnnnnnnnnnnnnnnnnnnnnnnnnnnnnnnnnnnnnnnnnnnnnnnnnnnnnnnnnnnnnnnnn

SEQ ID NO: 25821 - DNA, 846 bp, Oryza sativa
  unsure (1)..(846): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttaatctctctcgagtaatctctacctgaaaaaattaaacatgaagcacatcattaaatgagaaaaatatgctcttctaatgacccatgaattttctagagagacccttaaattatttgaaaaaagatatttaatcagaaaaaaaggataagaaaaaaatatgagcagaggtaaaaaaaggcaacctgttttttccaatcggtcctaagtgtgatgaatagaagcacaagagtctggactagtgttccaagaagcatgccgatccaaataccctgcaaaaagaatgaacataagtgagggacacaacttaaatccagattaactagtgaaattctatcatacaaaaattccttacctttgcttgaaatcctagcacatagcctagtattgcaccaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25822 - DNA, 1240 bp, Oryza sativa
gaacaaggtttggacatgctgtgtttcatggacctaaacgcgcaattttcaagtttacagacctaagtgacaccactgctcaagtttaaggaccgaccatgcatttcactctaatcggaaacctgtaccctgactttttatatttacaaagttggatatgaagagatgatcatcctttgacactataatgctttcatcctttcacttcgattcttggatcaaaataatctatgcacaccttactccttttctatttcataggtattcagcaaggatcatcgttgatttctgaccttcaagggcaggaaacagtccttaagcagtgcattgagcaacttgaaagtgtcaacatggctagaataaccctaatcaataaactaagagaagccctcagcgaacaggtcttgagcactttttatatttttttccccaaatgttctaccttgaaggcatactattacattcataaagctttatgttttttctttttatataacaggaagcaaagtcagagcttcttcgcaatcagttgcatgtaaggattattcttttatgcattctcacttgttagtatccttgttattacttcatctttcactgcagaatcacatgttagatctttctatttcttatgccatgtctgtaactcaattgcaatggaacgttaaggtcaaaattatgctgatcattttcatggatccataagcttttgtttgcctagcggcctagcctaagatgccccatgagtccatggcatgtgagcacaaccagagttttgctttgtcaaggacattcattcatgaatttatatcacacatgttcaggatgagtagagctaggaaagacaaaagcaaacatgagaacacataagatgcacattgtatgctctgacacgaagagaagcctctaaactggatagttgctgaatctgctgtacgattcagctctatgatggaagtagtagactagccatggtctgcttgggcagcacagatgatctgtctcatctagtatcctgcttgaagcacaaacctgcctcttagttaccatggcaaccctgaggccttctctggataacaaggcgacatgttatttcctacttattagactgcttctcaattccaacttatgtttgcaactttgcatatatgacattcctctctttatctgtttcaagagaaataggtccagcacattgggaggtctgactatctctatagcataagctatacagttaagg

SEQ ID NO: 25823 - DNA, 651 bp, Oryza sativa
  unsure (1)..(651): unsure at all n locations
ggcgaattcgagctcggtacccatccaacggctgataccactccactgctcttctttataatttaatggtcaacttcagctcggaagccaaataaaataggagtagtataatgtggtgtacgtgtacctctgttactgacgagttcagcccaaaggccaccacttccagcgtggttaatctcctgcacaaataataataatacagatttcgataaggaaaaaagcaaagcatccgcaggagaataaatggaaaaagaagaaagaaatgaaaagaaacgagacgtagctagctagctagtcacctcgaagaacagaccgaacagagtgtccggcattcttcgagcgacagagtaatcgacatggagagacgccgtctccaacgtctcggcttcgcatctgctgccgccgccgacgaagaaaagaacgaggaagacgacgacgacgacaatggcttgccgggacagcatgctcctcgtcgccggcggccacactctcatcattctctctgcgaccacaatgatcaatggattgggtacgttgttacttgcgagagggaggcttgattattcgaggttgnnnnnnnnnnnnnnnnnnnnnnnnnnnnnnnnnnnnnnnnnnnnnnnnnnnnnnnnnnnnnnnnnnnnnnnnnnn

SEQ ID NO: 25824 - DNA, 525 bp, Oryza sativa
  unsure (1)..(525): unsure at all n locations
gcgaattcgagctcggtaccccctttgcaaaatgttagaaatttgtcatgtcatcttaggtgggctctccttcaattattgtttctagcgatctgtttcgtttttgtcacgttgcaaacgacctgcgagtgctagggcttgggcgatcgcgcatcactgggccgtcagcaaggtggacgcgagtgcacgccagccgtcggggcaagaaagggcattgtgagggttccattagctgttgtcacgttgcaaacgacctgcaagcactagggcttgggcgatcgcgcatcactgggccagcgcgtcagcaaggtggacacgagtgcacgccagccgtcgggacgagaaagggcatcgtgaggttccattagctgccaggtcaatcagccacgccagggcaatgataggattgggcatgtcggaatattggggccatgattggatatatattggaggctgtgnnnnnnnnnnnnnnnnnnnnnnnnnnnnnnnnnnnnnnnnnnnnnnnnnnnnnnnnnnnnnnnnnnn

SEQ ID NO: 25825 - DNA, 1700 bp, Oryza sativa
  unsure (1)..(1700): unsure at all n locations
nnnnnnnnnnnnnnnnnnnnnnnnnnnnnnnnnnnntaatacttataagtcagaatttaaaatttaaaattaattttaaaattgattttgtgatttttttattatagtttattttatagcatttgcttttgaatcgctaagaatatgtgtataaaagttttacttataaattaaattttagttgctaataagccatacagataagcataaccataagcaaaaggatgacactgctcattggttccaacttccaaatttgttcaaaaaccttctgcgtacagtacaaaaatggatatgtctgctcaagatttatttaggtaatactgtgaccaaaagaaccccacaagtcacgactcacaatcaactctgcggttcgacctacaagacatagatttcaagccgttttgtggaagagatcctggagatcaagtatgtcagcaagaactccagctgcagtggtatcattgccagctccagcgccctgaatcaccagaggggcgctctcgtagcatctgctgtatatctccacctgcccaagaacaaagcagcgtcacttttacgtttcacatcactctctaccaacagtaaaaaatcacatatcaaacattctttaatcctctcaaaacagaaaaatggatttcatcaatctacttctaacgtgttagaggccaatacaaacaatgtttttggtagttttagtgttccaacttccaagctcgtgtgaacaacgcaaagaagaaatggggaatggtgccaatacagaccctgctcacactcgtaggctcttttgttttcacctgaaaataaccagcccttgaggctaccaactgcacagtgccgcttgatgttgaataaaagagaaaaagagagaggaaaataaaaaggattagcataccacattgtcacttcctctcaaccttcccagtgcagagtttttcgggagttcttcaaggcccacttggcacctacaaaatggggatgttactctacactaccattgaaagaacctttacaaaatgcacagaaatgggcctacgtgtctctgacaatagtatgctagtattgaaacactaattagtgattcagagggcatagcacaataaaaggatacataccctgtgctttcaatcttacagacatagcgaagaacatttcctttcaaagatgctgcctttactctttcttcaatgcttttatcaagctgtactaaaccactttcaaggaagtcctttgtggacattgcatcaggtcctaattcactggggtataaactctcaacctgaagataattgcaaaaaattagcacacctgatcttttttctacgaacagggtgcctgctcaattacaagcggtcttctaactggaatgtacgacataacacatgcataaatatagtgtctatgcataattagaaaatttcggaataagtgatttaggggttaaaatctttcaaaatcaaagttctggtatcatagaaaacaactgaactagcagccactcaacaaagctaatggctacataaactaaataacaacttccaagatttggagggtattcatttcattttcagactataagatacataaggtgtataattcatcggaatccccaataatcctgaacacaagtctatggtgatatccagtgacctatattgtagaagagtgtcggtccttatccatagaatccatgtagccaa

SEQ ID NO: 25826 - DNA, 7773 bp, Oryza sativa
  unsure (1)..(7773): unsure at all n locations
ctgtaattacagataaggaattgaatactgagtacacattgatgttataatgtccaatgaatgaataaatttttagacctggttctgtatagccaagagacttggcagttttcacaacttcactaaatttctttccatcctccagctcactcatcacataaccaagtgtacctgcagaatcataggaatggaagtgtacattgctctgctatttggaaaacagacaccttttacaaacaaataaaataataactgtgtaccactcagactgccaacaatacgagaaactggatctccagaggcaataatacgagtcacagaagctattacaggcagactggctccaacctaagagtaggaatagtaaatatcagcagagaccctcaactcatttgtaataataaaagaaattgccaaaaaaaaaggctgtgcttaatcatatggccacagtcatatcatacaaccccagatcaaataaatgaatggatttccatgaaaaataaatataataacattttttgctgggtcggcgaaagaaacgccgaccaaatttcattaagattgggggaaaagtataataacatttaatagtgaaatgaaggaattactagtggcgtatgcatacagtagattcaaatcttatgcgacggaagttggagaccaacttttcgaaatcctcctgcatgaaaaaggaacacatttggtaagcatgaacttatgtgtcaaaatgacaaaaaatactggatggaagacttaaggaggacattacataagcacaagtaagcggtttcttgtttgccaatacaacacaacatccacaatccacggcatcctttagcatgccaacagtatcataagttgcagaacaatcaactagtacaagacctgcaaaaaggatcataagataagaaccaaagaagatattacactccttttttttaaaaaaaggaactaatcaacaatcatacagcatatcaaagattccttttttttccccactggtttctattccagagaattcaaaaacttagcgcgcaatgtattctgcatagggagaaggatcacagaccagttgttttccctagaacgctggcagtgtcaatgactttcctcctagcctcagtgttgttgaatagctgacattgccctgaaaattgcacaatccaaccatccattactttaaatatcacgtgtacaaatgcaaattcatgacaaagtattcattacccaaggaagctatggaatattctaaaaaaagaaaaaaggaataacgaaatagaatggggatacctcgagcgagcagggaagataggggcgagccggcggacttggcggcgcagagatcagcgaggagcgcgtcgtcgaagccgttggagtggaggtcgtcggcgacgagcagagaggagctgtcggcgacgccgagcacccggatggcgacgccctatacaagtatgggcgatgagagcaccgaatcggagaggaaggggacgggtcagacgagacgaggtacctggttggcgtggagcgggcggcaggagacgatgtggcggagaaggtggcggccgacgccgccgcagccgaggaggacgacggggaggaccgacctcaccggcgccgccatttgggtgcttgacagcttcaccttcaggctacaccatttttggtttcttcggcctgttgttcaatcgtctattcggcccagcccacgcagcattttttttcttcattttttttaagatgatgtcagagtaggccaatgtccctatgcttagatttgatttagagaatatctccatatttaacattgtaataaagaggcaaattgtgtagcacataaattatctagatcatgctttcattttgaagaattcttgtaattgggttgaacccattagcttcttgctaaacgttgtagtgaacgttataactgtgttttgatatcgataaagcgcgtcaaatggctaaaaaaaatcttggttgcaggagaggagaataattgtggaatatagttcaaatgcatcaaatcatattttctgctatttaaaactggaatcattttacaaagcaatttattccagaaagggacaaacgacccacaacttttagtgtggatattttctctcatttgatagtgaatccataaatttactcaaaggtagaaaacaaaatccaatgggtacaatcaattcacatgcaagcacatagccatacatgctcttgtcaacaaatacaaaaaaatatgtaaaacacataaaggtcaagcatatgctgcgtcgtgctaaaaataaaaggataaggggcttatattcaaggttactacactaacatcgtggttcttccttgatctgacacttcaggaaaaaaaaaacatcatccatgccttgtgattaacgtttggttcatggatgatggatgatgtgacctcgaaggatctcgaactctttcaattccattatgaatgtgcgaaagtttcagatcatggatttcctctcgaattttgtgatcttccattatcatccgtgtaccatctatttagtctctcgagagcaatctctacctaaaaaacaatggagcataccattcaaatataaaaaaaatgtgctctttcaatgtcccacatgtttttctagatagacccttatattatgtgaaaaagatataattaaatacaagataacaaaaaatatgagcaaaaaagataacaaagccaacctgtttttcccaattagtcctaagtgtgatgaataaaagcacaagagtctgcactagtgttccaacaagcattccaatccaaatgccctatagaaccaattaataaaagtgagaaacgcaacttagacccaagatttcctaatgaaatttacaatagcaaccaggaccttacctttacttcaaatcctagagcatagcctagtattgccccaatagggataccgatcaagtagtacgatgcaacattaacataggcaactacactttgccaaccagagccaatagcgacacctatagatagttagaaaacgttgtaatttcaaagtgaaagtttaaattattttgatataatcgtccgtcaaataaaataatcatacctgagagcaccggttgaacactattcaataaaatggagaaagctagaaggggagcaagatcagcgactgcatctactacctcctgactttcagtaaatatgtatgcaaggcttccacgaaagaaaaggaagagcacaaaaaacacaaatcctatcaagaaagaagtggtgaccacattgaaaatggcaaacttagcccttcttgcactcctagctccaagttcatttgccacccgcactctaaaaatgtatatgtattaagtataagtcaaatttataggacataatggaatagtcagatgaaccacttaatgagtaacaagtaagatcatgaagttacccagttgcagccaaaaatccaatagcaatcatcatctcccaaccattgatattaaggctacaaattttgtaagtgaaaacaacagtgctcaacaagcaatttctccaagtactaaaggatcaacacaaaacaataaatttatgtacatgatacaacatgatttggctattattttctaaactagtatgcaacaatagtatatatatatattaacatattaccatatagaaagagcatcaagagcaacctctgcattcttcatataaccagtgaggagcaccaatatggtgttgtaccataattctacactgaaaggcaaaggaacaacaagaatgaatcaatgagctaccaaattagctgtaggaaagaacttggttaacactaggttagatataacatattgccttttgtttggtatcatcaaaattatacaaaatttcatatgtgtacataaacagaactgttacttaccaaagcatcactccggatgatatcgaaagcttgataatagcaccaagatcagtaaaggcagaggacgagaaccctgtccatgtttgaggacaaccgccaaagaagacatatgcgagctgaccaaatatagggatccaacaggcaatgaccatggagcccatcaccccagcaaggccaaggtgaaacttgaccaccatgagccatgataggaagagattgagtccaaagttgagcaaggagaggtaggtaacgatcatgttcttgctctgtgattgtagatacatttggattgttaatccccagacataggagaacatgatgggaatgtaccatagtgagatggtgccagccacaacagagatatcgggatcctgaccaagggcaattaggagcggagtggtgaagaggtagattgggagaaggattactgcacaacagaagagaactatccatgagcgttgtagatagatgcctaacatgtggtattgcttggcaccatatgattgcccacacaatgtttccaatgcgcttgccatgcctatctgcagttacaacaatgtatatgtatggttaactatcaattaattgtaaatagttaattgtttatgtatgcattttgtacaagatgatttgtaatataacttaaagtaaggtatgtttacattttatttgtatattttgtaccattaagagtttgttattgttgcagtgctagctaacagaggtagcacgaagaagatagcatacggaagatccaagaagaataaagaaagagcacactatataattattgcatgaagaaaatgccatgattaaggggtggatgattagatgaagagcctgcttcaaatattaattagtgtattgaaagttgaataatttgatgatccccttctcaagaaggaaaaaatgtgaggaggcaaagatctcgtataattttcttccttcgatacgttttattcgatacgttttatgtcttttttatatcgagcctaactcttataaaggcaaatcaaacatacatgatttgtacgaattaatcgatgtgcaaattaaattaaagaaaaaaaagttagtgacgctattagtctcgatggatagaattaagtcatgactccaacattattaaagttagtttttaaaattggcaaaatttactataagagtgattttgttagggatactcctaaaacgtggcttgacctaaggacacctaaaagaacgtgttaatttgctagaaaatatcatattattattttatcatttttagcatatttgaaaaagaccaaaattaatcatccatcgatgatgctcaggtctccccatctaccgtttaatggctgggccagagacgatcgagcgaggaagtacatgattggccctgtggttgctgcagatggtgggtaggtagggagggcagtgtgggaagaaattaataaacaattacacaagccctgttcttttctttaaaaaaaattggataaaattttggatactagtgacacgcttttcgtacgaaaactttctatacaaaagttactctaaaatatcaaattaattattttttttaataattaaaacttaattaatcatacattaataccatcttatttacctaaaatacttaattatcttctttatccttatcttgtgtgtgggaatactatcatcgattcaggcaggggttgtgtgtaaacataatgcatgtcagcatgtggcgaggagggcaatcacgtgtactttctcttttaaaagtcatacgtattctgtttccgacggatactgtaggtaatctccaccacgtacctccaccaccatcatgaagcacggccgggcgtacggcagaggagcgatcacgtcgctggccactctactcgcgctcatgggaccagtttatactagacgcttccgcgacaaaaaatttcatacataagttactttaaaatattaatatatttattttgttaagtctataataattaaaattaaaacttaattagctatatactaataactttctcgttttatatacatcaacgtaacttttatcttcatcagttttaagtacaattagaatttaacttttttttcttggatgaatggagtaatataagtagtagcagcgatgtggcctaccggtatcaacgtcatcgataaatggtatgtttgtccggcctcgctgctgtgctgcatcagtgcatcctcatgtatctgcgtcacggtcactggctcactgccaaattaattaaagtggttgctacaaaaaatgattcctcatccaacgatgccaaccaatgcgtcccggaaaaaggagatcacgggaaggaaaacgttacatcattgcatgggagacaccatcgacatcgagtcgccgtctcgtgtcggccatcgatgaacttttttttcgaacctttttattttttaaaattaaaaatgaactcttacaaaatttaattttaaaactagaccttttaatggtactggctggtctgatgtggcgaaataatattgtcaagtcaaatgaggatgaacatgatagtttatgatagtttagtttcgttatgccagccggggtggcgtggttaaaagttttaaattttaaaaataagttttgggatgtttatttaaaatttaaacacaaaaaaggttaataataaaaaaaatggccatcctattcatcaattcatgccctgtgaccttgttctcgtcaacccatcggcagcacaccaccaccagctaactcacgatttaattcaacatcgtggaatatagttcaattgcatcaaatcatatcttctgctatctagtagctgtgtgaattgaagaagggaaggctgcaaggaaaggaaagcatgatgctcgcgttttatatccgcacgttttctaaactgctagtatgtattcttaaaaaaaagttattttaaaaattatattaatttattttttaaatttaaaataattaataattaattaattatgtgtttgtgacttgttttgttttgcgcatattttcagtcctctctaatactcttctctctaacacaacctgctgtgagattgcccctaaattatatatggttctgcagatggcgggtaggtagggatgacagagggggaaattagttgtactaccttgtaagtaacagtgacccctgattaggattctcggacaacgagtgatcaaattaacaggaattaacagttggatcgtgtggcaaggagggcaagcacgtgttctttgctccaacaaaagttagataaagattaagatttttatggcacgcttttcaaactgctaaacggtgcgtttcgtatgaaaactttctatatgaaagttgctctaaaatatcatattaatctatttttcaagtttttaataattaaaactcaatcaattatgcgttaatatcacctcattttatgtaaaaaaacataacctttatcttcatcttcacaagaaaagaacaccacctaatgtgctgccaatgttttcttatcctactaaagctttctatacgtagtccattaatgggatgtttgcccggccttgctgcatgctgtgctgcatcccctcccccacccccaccccggccacccgactccggagcagttttggtccaacgtggcacacacgtggtaatctagtcagcataaaaaaataaaaaatggtagggcacttgtcagttctgcatcttttctaggtcgccacatgtgggccctaccttatatatatatatatatatatatatatatattaatgctgactagactgctacatgtataccacgtaggaccaaaactgctagcattctgnnnnnnnnnnnnnnnnnnnnnnnnnnnnnnnnnnnnnnnnnnnnnnnnnnnnnnnnnnnnn

SEQ ID NO: 25827 - DNA, 14073 bp, Oryza sativa
  unsure (1)..(14073): unsure at all n locations
nnnnnnnnnnnnnnnnnnnnnnnnnnnnnnnnnnnnnnnnnnnnnnnnnnnnnnnnncaacaatattttgggaccctaaacagttttaattcaaaaacttttcaactacaaagttgtaggtcacatcgagggctacaattttgatataaagtttgtcttcattagagttcacatgaaaaagttatgaattattttttatataaagtttttagaccgtcatgtttagggaccggggtgacataattgaataagttggaggatctaaacgagtgatctgcaagtttagagaccgggatgacacaatcgaataagtttgaggacctgaacggtcgatttgcgagtttagggaccgggatgacacaacggtacaagtttagagaccggtgatggactttactctatacaataacttttcctggcggaaaagccatcaccccaagccatatgattaaaattgttctttggtggatacgtgaccttgatgatttttttttgaaagttcaaaccttgaaaatcttaaatccgagcacaatcccattttgacaggttgattcataaatcatcaaaattctttacaagtgtgcagaagttttatatcatgcatttcctattgaattctgtgatcgtccgttctcatccatataccatctgtttaatctctctcgagtaatctctacctgaaaaaattaaacatgaagcacatcattaaatgagaaaaatatgctcttctaatgacccatgaattttctagagagacccttaaattatttgaaaaaagatatttaatcagaaaaaaaggataagaaaaaaatatgagcagaggtaaaaaaaggcaacctgttttttccaatcggtcctaagtgtgatgaatagaagcacaagagtctggactagtgttccaagaagcatgccgatccaaataccctgcaaaaagaatgaacataagtgagggacacaacttaaatccagattaactagtgaaattctatcatacaaaaattccttacctttgcttgaaatcctagcacatagcctagtattgcaccaagagggataccaataaagtagtacgatgtaacattaacataggcaactacactctgccaacccgatccgatagcgacacctatagataaattagaaaattagtaatttcattgttaaattttgaattactttgatatacttgtccttcaaatggaataacatacctgagagcactggttgaacactattcaacaaaatagagaaagctagaaggggagcaagatcagcgacttcatctgctactgccttactttcagtaaatatgtatgcaaggcttccacggaagaaaaggaagagcacaaacaacacaaatcctatcaagaaagaagtggtgaccacattgaaaatggcaaacttagctcttcttgcactcccggctccaagttcatttgccacccgcactctaaaaatatacatgcattaagtatatgtcaaatttatggttcatgttgcatcagttagatgaaccacatagtgagtgacagctgagatcgtgaagttaccctattgcagacaaaaatccgatagaaatcatcatctcccaaccattgatattaaggctacaaagtttgcaagtgaaaacaacaatgttcaataagcaaccttttcaattactagaggagaaacacaaaacaatacaatgatatacatgatacaacatgatctggttgttgttttctaaactaatacacaacagattagagtggaatatattaccatatagaaagagcatcaagagcaacctctgcattcttcatataaccagtgaggagcaccaatatggtgttgtaccacaattctaaactgaaaaggtaaaagaaaaatgagaataaattaatgagcttctaattatttgtataaaagaacttgattaacagttagcatctaaaatattaactttctatttgccatcatcaatttttttgtcgaaaatttcatatatacacataaacgtaaccatgttacttaccaaagcatcactccagacgataatgaaagcttcataatagcaccaagatcagtaaaagcagaggatgagaaccctgtccatgttagagggcaaccaccaaagaagacaaaagcgagttggccaaacacagggatccaaaaggagatgaccatggatcccatgaccccagcaagaccaagttggaacttgactgttaggagccatgacaagaagaggtgaatcccaagattgaggaaggcaaggtaagtgacaatcatgttcttgctctgcgcttgtaggtacatttggagcgtgaatgcccatatgtaagagaacattacggggatgtaccatagagagatggtgccagcgacggcagagatctcaggatcttgaccgagagcaatcaggagtggagttgtgaagatatagaccgggagaaggatgactgcacaacagaagagaactagccatgagcgttgtagatagatgcccaacatgtgatattgcttggcgccatatgattgtccacacaacgtttctaatgcgctcgccatgccaagctgcaatttacaacaatgtgcatatacagttaatttgtagtatatactgtttttatatgcatattttatatgcatatcaatagatgacttatagtgcaaattaatatttagtaaaaagaagttttcataggagtgacttgtagtatggtctggttatgttttatttgtatattccgttcaaaaaatctaggtaaagacttttgctattgttgcacagctagtagacagaggtagtacaaactactttaattacagaagaaaaaaatatatatatcagaagatccaacaagaatacacatgaaaaaagacccggcaaaaagaatacatgaggtagatgctatatactccttccgtccctaaatatttaatgccgttgacttttttaaacatgtttgaccattcgtcttgtttaaaaacatttgtgaatattattaaaaaatttgagtagtagtagtatatttaacaatgaatcaaatgagaggaaaataattaataattacttattttttaaaataacataaacggtcaaacatatttaaaaaagtcaacggcgtcaagtatttagagacggagggagtactaattaatgtctggagagaaagccgtgcaagggaaggatggctaggtcaagagtctacttcaaagttttactagtaatttaaaaatccaaggaggcaaggtctcacatgattaattttcttcctgcagtatgtactatatccatttttttttaaaaaaaaatcgagcctatagcttcttagctatagtacaacaatgctggacaagatcgaacactctgttttgaacctataaagacagcaactgaacatccattgtttgtctcaattaatcgatgggcaaattaaagcacaacaaaaaacttccagcgcgcgcggcgctgttagtctctgaatcggcacaattaagtcaaaacttaacgtcatcaaagtcagcttttagaaataaaaaacagctagttgccgaaaacacgaaacaggtaaaaagaaagatcaatttgaattgttacaacgtagtaataataatttaaacccaaaactgtgtaatgataactctgtaataataagtaaaaagggaatcagcggcatgacttaccaggatgccattgctgaagcgcatgaggacggtggagacgagggcgtaggcggcgagctcggtggcgccgatgtgtccgatgaacgcctggctgatgacggtgacgccgaaggaggagaagcgggcgcagatggaaggacccgccaccacccacagcttcttgttctcctccaccactcgccgcctcaccgatccaacctcatcctcctctgcatcatcatcttcctgatgcttgtaggtagccggcttaggctccaacagaggaaccgtcagcttctcatcatcacccggcttctccattttgctaattaattagtggcggcttgtagtttgcagcaatggagatggagtggtggtgtttcagattcagtagcaatggcgctgctggaggaaagggaagcatcaaggatgctcaagtatggagctactgatgatatatataaagggagtcgaatggaagtacaggattgcacctgtggttgctgcatgaagccgtgggttggtaacttggtatggcggagggcagaatcgggaattaacaggacttaattaatcgatgattattaattaatagtgactctagtctagttgatcagatcaatgtatatatccatatacatgttgagaattaattagcaatagtaggtggagtaagaaggaagggtgagattcgatctggggttttgtgtacattgtactatgtggcaatgagggcaagaacgtgtactgtatatagctttgcagcctgtagttgtagactgtaaagacgcgaggtatacatacgcgtacgcggtacggcggcttatgttgcgaatgcggggcgtcgggagatgccacgtagagatgccaggtacccgttcctccagggcaccaccaggcaccagcaggctgcatcgtgattcgtgaagcacaggaggccacgcacggcggaggtaggcggccggagtagtagctggccagccgccgtcagatcagcttcgtcaacaaaatataatggatgcttgtccggcctgcaatcggccactgcatgcctgatgcatgcatcgtgcaggtcagccactggccgccgcaccagtcgaccacgtgccgcagagccgaccacactgagcaggtgtgcgcttgaccagccacgccacccaacggtcgtacccagcaggatgccatgctagagcaggcccaacgaccacgcctactcgacagccgcgcgccctcgacggtgcatcgttgtgtgcaaaccctaactgcgcgttgattgtgccatggccgccttacggtgtaagtggctaccacttattttgacatgtaagtggattcgtgggttaaccacttatatccttagagtcgcccatgtcacgatcaagcagcgccgccgtgctacagagtacagagtgatggaccatgccagcatgtcgggtcaccgaactgccttatagataagtggtcgcatcgccatgtactggccatgccgttgtgagcgtcggccatggaacgaggaaagaaggaaaggaagaagaaagatacaaaagtaatgaaaatggaaaaagggaaaggaatcatgtgatttttgcataatgggcctgagctttctggaacatatgagcacagctccctgtattgagatttttggtgcgcacgtaaaaccttaaatttaggataacaccatttctaaccctctaccgcatagaatcttctaaagtggcccttgtatttttcaaaattcattgcaaatttgtattttagcgtcaaaattaatgattatgtattttgaatttgaatttcgttttgcaattgaggtattttactactgttatttaagattttgaacttctcttatgcccataatatgataaacataagattgtaaactccaaaattttgccaaaaacttaaaatctaatatttcacaaattttgtccaaattttggaagtttttgtcccaggtattttggtcatttggataaattgtacagtactaacggaggttaactgaacgacaatgataaatcgtagaacttgagcaaaagtcgatggcatattgtaaaacgtgataaattcagtggtaaatagggtttacgattccgagatagccttccgtttcgggctctgatggaatgacggttttcgcgaaatccggtggaaagccgatagattccgaacaaatttcataaaccaaaatttgaatgcaaattctctgaatttgccgataaactcgcaaaaaccggtcggctttggcaaaatttcgagcgaaatcatcgaaatttcaatcggtagctagaaaaagaagtaaattgaaagtgttttcctttttttattcgttattttattatttcctactgtatatttcagtaaatacacggaatacatcaattttttcgtaaatttatatcccaataggttctataaatatcatactatttataagattttacttgattttttttccttttttttcaattcaaatttgaatttgaatgaaactcactaaaatctcagacggcttctactttcgagcctcgtcgaaaatcgaccgattttcatcgaaattgtgaaccttggtggtaaatcgtagacccatggtaaacttattggtatataatggattcccgcacaagtcaatgacgatgtgtgtgtcagcaagtctggtactgtacactagctctagttggtggtgctcgcggctcaggaagcggccacgaacaacgtccatccaccgtccaaccatgcacgcacgctactcatggacgttgccaggttcagtagcgctttcatatcagactagatttactatttttgatttgactccaaattattctatcaagctagcaactgcttttgactagcccgcaagaaattacacgggaaaattccctagctaggtactgtttagattccaactttttctttaaacttttaacttttccgtcacattaaacttttctacacacaaactttcaacttttccgtcgcatcgtttcaatttcttcaaactttcaatcttagcgtggaactaaacatagcccaggaaatcgtctccattttctgtcggaattaattcacgcccaggaaacgcattcaagtggatgctttcacctgccattgctttgcttattcacttccctccagcttaattacgagtagcttacagtacagtcatcgctgttactctgaattataaaatatgtaaaactcataatggtcaagcatttgctacaatagtttcgatgacccggtaaaaatggataatttatgaccatatatatataaggttccttcaataacatcacgggtttttccatggtgtgacacttggggaaaaacatcattccaagccatttataggttcattgaaggatgatgtcaccttgaaggatcttaaactctgagggcaatcccattagaacaagctgattcatagatcaccataattcattacaagtgtgcagaagttttagatcatggattttcacccggattctgttgtctcccattctcatccatagaccagcggtttaatctctgtcgagcaatctctacctagaaaaaggaacatgaaacacatcattaaatgagaaaaaaaaatctagagagacccacatgctatgtgggttaagagatttaataaaaaaagataagtaaaattgtgagcaattaacatacctgtttttcccaatcagttctaagagtgataaatagaagcacaatagtctggactagtgtaccaagaagcataccaatccaaatgccctatagaaacaacaaatggaattgagaaacaaaatttaagtcccaaattgactaatgaaattttatcaatcggttcctcacctttacttgaaatcctagcacatagcctagtattacaccaatagggataccgaacaagtaatatgatgtaacattaacataggcaactacactttgccaacccgatccaacagcgacacctatagatgattataaaatattataattccaatgtgcaatttcaaattatattgatatatttgctattcttttaaatggaataccatacctgagagcactggttgaatactattcaacaaattggagaaggctagcaagggagaaagctctgcaactgcatctgctactaccgtactttcagtaaatatgtatacaagccttccacgaaagataaggaagagcacaaacaacataaatcctatcgagaaagaagtggtgaccacattgaaaatggcaaacttagcccttcttgcacttccagctccaagttcatttgccacccgcactctaaaaatgtacatgtataggtatgtcaaatgaaatttatgtgacatgaatgattgatcaaatgaaccacttagcatgtaacaagtaagatcactaagttacccttttgcagacaaaaaccctatagaaatcatcatctcccaaccattgatattaaggctacacatggaaaaacaataacgctaaataagcaagtttttcaactgctaaaggaacaacaaagaacaatacagcaatgtacccacaaacatgatcccataaaaggggcaattgcaaatttaccactactttgaatcgttattgcaaaactgccactagaaaattgcaaaaatgccattagaactgtcattcgagtggcatccttgcaatattgaaaaaaccggtggcaaatttgcaaatgccccatcttttattgtctaaaccattatgcaacaattgaaagtggaatatattaccatattgaaagagcatcaagagcaatctctgcattcttcatataaccagtgaggagaaccaaaattgtgttgtaccacaattccacactgaaaggcaaatgagaaagaaaaaagaataaaccacatgagcaattaattagctctaaacaatatgttggtcaacatttagcatctaacatattgcatatctgaaatttcatatgtatgcataaacacaattgttacttaccaaagcatcactccagaagacagtgaaagcttgacaatagcaccgagttcagtaaaagcagcaaatgagaatcctgtccatgttagagggcaaccaccaaagaagacaaaagcaagctgaccaaatactagaatctagtaggcaatgaccatggagcccatgaccccagcaaggccaaggtagaactggaccgttaaaagccatgatagaaaaaggtgaagcccaagattgagcatggcaagataagtgacaatcatgttcttgctctgtgcttgtaggtacatttggagcgtgaagttcccaacattggatatcataacagggatgtaccacaatgaaatagtgccagccatagcagcgatcttaggatcctggccaagaaaaattaggagtggagtggtgaagaggtatatcgggaggaggaggactgcacaacacaagagaactatccatgaacgttgtagatagatgcccaacatgtggtattgcttggcgccatatgattgcccacacaatgtttccaatgcacttgccatgcctagctgcagtttacaacaatgtgcatttaaggtgagcaatttataatgtgtttttatgcatatatagaagataagattacatctagaaattaattgttagtaaaagtctaaaatataaagaggtcgtcattacttgtagtaaggtatcttttgataccaaagtatgtgattgagagcattgatagggagagaaagcactgcttatggagatagtcagatatgatcaactccaaaaacaattcctggctgcttggcataaggtgcagactaagttaaaggagaagaggaggccattaacttgacaatccaaaattaggcaccactcatgaaacacttgaacaaattttataacaataaggacttgccttaggtaaaactgatttagaacaagtattatgtctacctagtgcctaatttaactatcccaaaagagtcctggtggaaggatgtttgtaaaacaagcatccactttagaggaattcctagatgtatcttacatatgggaattcctgctccttctaggaagatatgtggtctcactagccacctccatgcaatgtatatctaaggctatattcctttgcttctaataaggaggcctctgtcaaagtgtttgtatctactgatatggatgataattttaatctgccatcatctcggaaaacatatgatgagctttctcgatagtcaaacaaactcctaaacttggaattggatcacactgctgataagtggaagtatatatggggaaacatgaactatgcctctcagaaattctactctctgatctttaattacatccgtgtagcctccacattttatttggttatggaagagtaagtgcacttcaaaagttaaagtttttggattgctacttcttatgaatagattgaacacacgatatatgcgagatcataaaaaattgctccaccaaagtatgacctagtatgtgtgttatgcaatcaaggggtcattgaaacaatgcaacatttgtttcacacgtccattttcatcttcatgttgagcttcaattggatttagttggaataccgtgatgggaacttaaattatgatggttaaggctaaaaaccaatatgtgggttacagcttcatcgataaattcttaacttctgtctagtgtatttggaagataagaaataacttcatcttgagcagaaacctcccaccttttcttccgggagacatctgtttaagactgagctcctccttttaatatttggactaaatgaggagataaagatcaataaaaatatattactgtagggcctccctccctgctgtgcttccttaaaaaatatctagatatataaaaacttggcagtctgctattgttccagagctagctaacacagatatcttacgagcttatttgtacttgaagtcatgaagagcacacaagtatataattaatgcataaagacaatgccctgattaagaggggggtggctgaactaagaaagtgatgctttgaattagtcggatggcccctttctaaacaaaaaatacacaggtctcacataatttagtttttacagtacgaattgtgtcttttttaaaaaagaaaatttttttatgtgcctctgaatattttggatcccttccgtgaccttaaatgttgcctcatctctctgacatgtctgatatttttttccccattaatacactttccattactttgaccgttagatttttttttctaacatgactatatgtccacactatccatttctcatagactcgcacttatgtacactttaaaatataaatctcaacgtgaaaaaaaatgcagtaaaaatcaaattgggcagagtttgagagttatttgatggaaaatttggaaaacaaagtttagattagtttaaacacaaaatgtaattaaatagtattaagtgtagtgggtagagaggatagttacaaggatgccgccgctgaagcgcatgaggacggtggagacgagagcgtatccggcgagctcggtggcgccgacgtggccgatgaaggcttggctgatgacggtgacgccgaaggtggagaagcgcgcgcagatggaaggacccgccaccacccacagcttcttgctctccaccaacacccgccgccccaacgacccaacctcctcttcatcttcttcttgcttgttgttgctgccttcgccatgagcatgcttaggctccagcagaggaaccgtcctgcagtcatcatgttcatcacccggcctctccatttctcctagcagcttctgctaactttaattgtgcagcaatggagcgaattaatgggaataattgtacttgagtggcagaggagctatcagaattgatgaagggaagcaggttaggaaggctctcagctaccgttttaaaggagatcgatcaagtagctgagcttgatggctggaacagagagttgagtgaggagttgggtgggtaggtagtgagggcagggtgggaaagtagtagtaacagtgactcgttaatcatcgattcaggaatcagcattccagacaaaaggaaagaagaatatatacgcgagtgtgaaatggaatctggggctgtgtgtgtagtgtaaatggctcaatgcgtgtggcaaggagggaaaagcacgtctagtactgctgcagcctgcaatttgatgaaaaagatcagtagcatatatacacgtacagaacagagataggattgtgctacgtacgtcagggcggggcttgcatgcggcataggcagcggcagcggctacacatatacacatcatgtcaccggccggtctgttcacggcagctatagttgccggacgtacgtgtggctgaccggcatccccgcttggcgctcctcaactcgtcgtggtcaccaaaaccaaaagtagacttcctcgtaagtccaacgatccagggccggtcctaacatttgaaaagtcataggcgaacttaacattatgggcgccctaaggagttaagatttttttttacttctaatatatatactctataaagcacatatatcagcacaaatatcatagagtaacacaaataaatatttttaacatggtaaataataaatcaagcagtttgcaagttgtaatagagcaatttattctcaataaataatattgatagtataatttacaactaaaagaaacaccgtacaaacaaattagtatgaatttcttaacacccgaaatagtgaaattgcaaagtaaattgatagaggcatagcagaatagagcgagtcgttgattgacttataggtttgtgatcatgatataccttcagcatgaagaaaagaggagcgaatgggcgatggccgatgacgatcacagcctcacaggatgagacggccgggcagggcagggagcagccaccaggcagcgtcgcaacgatgccgccttggtggcttggctgatgggcgacgggccgacgtacggtgagtcggcgcctagaggcactcgcagcggcgtctcgcggactagggcatgggcaagacggcgacgaagcgaagcgacccggtcacgtggctcggcctaggcgtctggcctgcggctgggcctgttgaggggagggggggtggtaagtgatgggcccccctccggcctgggaacgatgccagccaatatgcaactgggaattcatgttgagaaaaaggagatctcgctgcaaggacggcgcggcgttccatcattacatgctatgcatggcgtcctcttgttctgatcaggatcagttaggttgttaatgccctacagttcaggtaatacccacacaagaattgggtttgaaagtaacactagaaaagaaaagaaaagaaaagaacaaaataaggggaaggccggccgggggattaaataagaattgattttttttctttttcccttttacatgcgcaatgctgcgtgcgtgtcacaccgccctttgtacgtattttggttatcaaatctgcattctttttgttgtaggacttggtgatttaattaaattttgaatatgcatgcatggagctctaatgtataggtctcacaataatctctatagaaaatcccttgtatacccctgcaattttagctaatcctttttatgcctctgaatttttgcttactttcttgtatgcacccaaaatttgatttcgatccttgaccgtataatttctataaaatgacaattttgcccttttgatgaacatagaaatttatgaattacattattgaaaatgtaaaagtttgtcatatgagactattatagttatgagtttgttgtgcgatacattatttatgacaaaaattatttttagataatgaaacaaaaaatatgtatttattttattttttaaaaagtcataaaaaaataggagcatccatataaagataggactacaaattctcacgatagatttttatgaatgctcccgatgaaaaaaaatccattgtcctattgaaatttcaaataaaaaatttaatttattaaatttgttttattttcaaattttatgtcaaaatttcttgcactaattatttttgtttcattagtttcataaaatgcacatattgtgcactcgaacaaagcttatattcaaacctaaatcttcaagggcataaaagacatttgcaatcaaacttaatagtgaaatgaaggaaaatataatgggaagggcatggaagaaatcaaattaaaatttcaggggtatagaagggatcagataaatttcaaggatgtgaaagggattgagtgagtttttaagggtatacagggaatttactctaatctctatggagtgtcacatgccatcttctttcgtcaaccaaccaatcgtcctaccgaattggctcatcatgtgtcacccctcccgttccttgtcaaattnnnnnnnnnnnnnnnnnnnnnnnnnnnnnnnnnnnn

SEQ ID NO: 25828 - DNA, 2430 bp, Oryza sativa
  unsure (1)..(2430): unsure at all n locations
aagccatagcaataccaaagatataatattcctctatttctgaaaatgttatatacactaatgtatttattttggcatagcttctcacatttgtttcattcatatagcatgtttaattgcattcttcatttgttccatgcatcaccataagttaggaggccatatgcaatgtcaaagcaagaaaagtacttcctttagtttttaatgtttgacgtggacttttggatatatgtttgaccattcatgttattaaaaaacaatgcatagttatcatttattttatgtgattttcttttatcattataagtacttcaagcatgacttacatttttgcatgtatacaaattgttttaaataaaacgaatggtcaatcatatgtccaaaagtcagtagcgtcaaacattaaaaaccgaatggagtaattgcaaagagacctatatctagtctcttggcttgaggttaagttggtttatttatttcccttatgactgattacgaaattcatttttgtgcgtagttcatacatgttaagagtcctaaggattcacatgatcctccatcaagcttacttttgcacattatagattcctcaagctacatgtcagatgaagatatttcttttagcaagttgacaaagacaccagtactgatgtgctttatgtctactaaggtgactccacgtggtaaattttaagttatcccctaaacgtagggttaataaatcacttttgtcgataatttaatgtggttacacttttcagacatttctaaggttctaagaaatctatgagtaataccacaaaggcatgtaactgaagtagaaaagaaccatgctcttcaaaggacagaagaatttaaaacctaataatcctttttgcagtgtaaataacgatggaaccacatatatatctatgttggatttttcatggtaatggtactttcatgtgttcatcctcatcccgtattgaactttttttttctacgtgcatcccgtattgaacttttttttttctacgtgcatgaggcattatctaaaaaaatgtggatgacaggattgatcttaacttgcataacggtactgcatctatagtttgagagttttggatgaggtctgatttgaatatcccatctgatgtttgatttttgtgtatgtttattttgaatgtgactgtacccattgaaaaatcctacaactatataaatcaccaatttgtgatagcacattatttttaatttgtggcccaattaccctgcatctttcaggtgatactaccaacaaattatgcaactaattactccattgataaccagatgttcattataaatttttaagcatacatatgtccatttattaactggaagtatctgaatattaggcattctattgatgcatactcatcagcgacagaacatattggactcagctttgatgcaattcatggccaaggccattggtgttgagccgaagtcgttgtcaagtgtatttgaagggcaagctaggggtttgaggatgaactactatccaccgtgcttgaaagccgacaaggtgttgggtttgtcaccgcacactgatctggatggcttgacactgcttctccaggtgaatgatgtgcagggcctgcagatcaacaaggatggcaaatggttctccgacaattttgtgtgatagcaaataacttgcaagattttcttggtgatgctagaagaattaacttctaacttctgcattacgagacacatgtagtcttacataaccaagtttggaatatcctgagtggccgttagggctcgtcgaccaatgattcattgaaattatatattagcgaaaatttaaacatattttttttaataataccatggccctaattttaaacttctaaaactctttttaatctgctacagattggtagctaaagttagaacatactaggagaaattagggatatatggccggtcaacatctccaaggtgatgggacgacagatggtggtgttggaatgagatggcgctgaccacgaccagtttgtgaggagggaggtgactacctcagtggggctatacaggttcgtcatagggatggctcggattatgatatccctaaatactgtccattggtcttcaaggttgatcagggggatggctcgtatcancacgccttcctcgtctcatcaaatcctatcatcattatcattaatcacccatcattatcattaattagtactccttaattaattaacgaatcattactgcttaattaattaccgtatctggcgggatgggtgatgatgtccatgatccccttgtagatgtcgcagaagacgacgtcggcgccggccagccgcggccgcagcgccgccagccgcgccgccaccctggcgttgtacccctggacgagctcgttcgcctcctccacgcagctccggccgtcca

SEQ ID NO: 25829 - DNA, 2538 bp, Oryza sativa
ttcatatactaacattcatgatagtaaaatatttcattttttttatgacaggatgctctgaaagaactttggagattagcttatcccagccgacaacttcctcctctgaaatcagatctatggaaggagatgggctggcagaattctgatccagcaactgattttaggttcgtttcgctaatccctagtaatgattttaggatatatatataagctgtcatgcatttatcaacaccgcttgaacctcgacaactaatcttttgaagtatctaatgcttgcagagcaggggggttcatgtccttggaaaatttaatatattttgctagaaattacccagtatgtttctattaatcatgaacatttactccgcattagtctgctgttattgggtgatttgattaggtacaatgctcaatgtctgctttaacatgcaggattcctttcacagtttattacacaaggcggatggtaagagatctgaatgggaatatccctttgcagtagctggcgtgaacatatcttatatgttagtgcaaatgttggacctgcaatcaggtgaaatttgcagtaacaccttatctttgggccaatttacctcctttgctcttgacttcgaactctctttttttttcagctctatgcagagctacagcttatctctttcacttcttttgtaggaaaaatgggcacaaaagtcagttctcaatttgttcaactacttagagaagacgagatggcttttgataaccttttctgtatggcctttcagatgcttgacgctcagtggctcacaagacaagctagttatatggaattcaatgtgtgttctctgtagaacatctggtctcttctattggcttctcattctaccaccttattcagttgtcttcatttccatttttcaggaggttctaaagtccatgcgtattcagttagaacaagaacttactatcggaagcatttcttgtgttcaggagatgccatcatttaggttgctaaaaaggtagccatgtttgttgtttacagaaaggagtgtatcttacttgtcagtaggatcttgtgcatactaccgattctttcattggttgtacaacatgacacactgtaagattatttatcatagaataataaacccagtatatatctggtactttggtaagtgttcaatgttttctggggtaacaatttaagtatttctctaatgaaaattacctgcaacaggtttgcttcttaaaacatgtgacaaatgtaagtaaagtaaatatcttttattaacattgctgatgtttggaatatcaataaaagatgcagcatttatgcattcatgcctcaaccaagatgtatagtatagtttattctgaaagttagatagatttacatattgtgatttctgtataacatatgctccattaccttataaaactgtgaactacccagagttttcttgtgggaatacctatagtactactcaagcattcaagattctgagtaatcagaattaactagctcaatctagggtaagggagaaaattgtctccctagttaatcaatcagccttgggggtattacaagaaaaggaacacagacacttgtctcatgccaagttgaatgcctttgggtttctaggagactaggaccatagggagaagcatatgaatcttccccacctgaacagaacgcctacagaagctttgcttctttgtggcagtgccattggacagagaaatataccccaagataaaaacctgaaaacttccctgtatatctcaagattttcaacacccagaaacacacacacagagagaatcagttgcacacactgatcattttttgagggcaggagatattgtttgcttgaggagatattcgctccctatctgaaattgaaatgtccttatctaaaaaatctgaaatgtccttgtctaaaaaatctgaaatgtccttctccaacatattgcattcctcaaacaaattgtattctgtcacacctgagttatccatgctgttgccgccttcagttatactggagcacccttcaaataggtactccatgccgccttcgaaagcctcatcattgaaccattcactgaaattcatcgagttgctgaagtaagccccaggcattgtatccaattcataatccaagcaagggctccagaggctttcttcaatgccatcaacaattggaaggggttcattcatgcattcagcgctgtcatcggctgcaagtggctcattgttgtcacttgatgtatttgcttcactggaactgagctcttggactgcattctcacttcggtcatcatcttgaggctcttcatgtaatgctggcaccacctgtagctcttgttgcagttgtgccagtaactgtggttcctgttgcagctgtgccagtaactgtggctggtccaggtagcagctgatgtcgaagttggttaccgcattggcacctcggtattcaattgcagcaagatcataggccttggctgcctcctcttgagtatctgtaaaaagaggtacgtttgttgaaatgagaa

SEQ ID NO: 25830 - DNA, 3958 bp, Oryza sativa
  unsure (1)..(3958): unsure at all n locations
nnnnnnnnnnnnnnnnnnnnnnnnnnnnnnnnnnnnnnnnnnnnnnnnnnnnnnnnnnnnnnnnnnnctctgaacaaaatggaaacagcaagttggtagcactggcaccacaatacagtaactgatattggaagcagatttcatcaagaaagagagaagcttaaaacttttgcagttctgacttttcctagatgcatgcatgacattgcacgaaactgacacaagaaagaagaggccatggaccatggagcatgcatgcagagcatacacggctggcaaatgacgttgccagctgatgaatgccaccctagctagcaatgctatgctgactcatcattcaggtcaagagagagagagagagagattaattagagttaattaatcagtagtcctacctggcaacgcctctgtacttggagacacccctggagaaaccgctgctccggcggcggagggaggccaggtactcctccctcgacacaccctccatctccgacctctccttctcatattcctccagctgcaataattcgcattatcttcagtaataattcagattacacaagtcgcaattgtctagtggtaagttggcaaacttactgggaaattgagcactgtctcaggaccccagtacttaagagctgcaaggtcatatgcacgagcagctgcctcttcactatcataagcccctaaacatcattaaacattgcactaatgttcagaaacagaccaaacaccaaaacattaagtagttatgtaacaactagttgctatatgcctatattcttagggataaactgttttcatattgagacaaaccaaggatgtgacagatcaaacaaaggaaatctaagattatacaagaacaggaagcaacatgcagcatgaatctgacaaaacaggtgtgtatagacaactagcttgtgggacttacccaaatagactaatgagaggagcatcaagcagcagcagatcaaggtcacatgcgcatcacaagggcaaggtcccccaaagataacagcaaaaaagaaaggagataaaaaaagcttaatcagaatgtcagccttaaaaaattcgctccactttatagtaataagctttgtactaatggccgatgtatcaagatccttggcagtatacagaagtacaccaaggaccttgtatgtttccctttttctttcattatagtacattatactgtaaaaatactcgtatttaactttctttagtattttcagagaaaattcaggttaaaaatccttaaaaaaaatcaggcaactaatgcatgttgcgatcaatgtaccttgcctccctttcttcttgttctgaagtgaagtggagcaattcttgtcccacagatgggcctcaaatctgccagtccaccgatgcctgtttatacatacagatacatgcatgcaacaaatgattccaccgtatattgaatttattgatgattgataaataagcagcattaagcattagtgtttgctttacaggaggaagaaaaactgaaggagttgaccaccccagcagtaaatgtagaccaaccaactccctacttcccagctaataataattgactcactccaaggggaggagcagcaagaaaaaaagattaaaaatgggaattatgagatcaagaaatggatccgatcgatcatgctcgccaacctccaaaagatgaggcatgaaaaggggagcagactcaccacccagaaaacgataaaaataattcatgatctctgacatgcaagtgaaatgttcagaaacagattggaaagaagcggctgataatttcgggagcctgaaatgatggaaacgatgcggaattttgggctgaaaatcagccattgattagctagcggcaatgcaggatgaattcgcgactgaaatcaagaggggatcagaaagaacagcagaactgggatcagagggatggaagcaactgaccatgcagagacgcatacctggtgactcccctgtagatagaactcctcttgccgccgccgccgccgccaccgccattggaagaaggatcaaccacctccttgctctccttcttgggcctcttggccttgccggtgctcttgtccgtcctcggcctcgccctcctcttgcagggcatcgacatgggcgaagaggaatcctcggaggaagaggaggaaggagacgacggcgaggatgatgcagatggagaagatgatgcgggatcaggagacgatctcttcgccatgatctctcgcgttggtgcaggtgcaggtgaggtgacgaggaggaggagaggcaacgaagtggagccccggaggttttgtaatttatagcggaggggggaacgaaagtaagtgcagtgcagagatgggttttttgggttgctaatcaccatcatcagcattaactgaagatgacacctctgttttttttgtatttttgtgcgtcagggcctcaagctggccaccatacgactctacgagaataggagtcaattttgatacacttattcattattcttttattttatttcagagatttcctctgtttttaatatattattattattgatataagtgtgcattgcattgtgcacaagtagtggtcgtattcagatttctttttctttctttatttttgcagatttcggtacacgtgcagacgctcatatacacacgtgtatactcaccttctataaatacatacgctatctctatgaacacctttaaagattaggcaaggagattgtcgtttctgaattgacataatttacatgggaagtacaccgataataatatcttgagatttgcgaagatacagaccaaatttacatagcatggcagatgacgcactggcaaattaactcaagatgacaccttgttttttgtatttttgcgcgtcagggctctgctggacaccgaagattagcaatcaattttgctgcacttattttaatttgtttctttttgagagatttcctctgttttaattatattattaatgagtatgaaaggtacaaacctgagatagtttctggaaggacacaatttccacggagactacaccgagtcactggcaatatttgcgatgttgaactgccatttgcccaagctacacttcatttttacatagcagggtacactaggaagtaaacaagctcataaatgactgcaaattaaacgttactggagatgatttttttttgtctatattgaaccgtaagtcttactgcaagagctttcacctctgattcagatcagtgacagacttgcagtgagttaattctacagaaagaggacaaagcaacttaaactaaaaatggacggacggacggacgccgctgggtcagggtccttagactgaagaaacaaacgaaggtgcatagcatagcagctacacaaggagacgaatagcatcgggacgtgaaaaagaaacaacacatgtaacatgtaacactgaaaaatcaaagacattagtgccatgtgtccaaatggcagagctctgcagccatgcaaaatatgcaattcctcattcagaggaaagcatcctactagccatgcaaccacaacacctgtccccaacattcagagcaacctactgtgtctgtgtgcagtcagtcaattactgtacacaacaagcatctactgtagctccgatgcaacgaccccctttcgatgaagaatcatcaaacaaacagtgcatccttcaattagaaaattcagcaattactcatgctgtattactggagtactacagatcatgtgaaacatgtgtgttgtgttgtaccgtggatgacggtttgatggctgaccgtgatgacctcaatatttgagtaaattagtcatcccaattaagctcccatgcctgactgccaaattatttgttttgtagtagatcatactcaccaaaatggtttatcacgagtctgttttnnnnnnnnnnnnnnnnnnnnnnnnnnnnnnnnnnnnnn

SEQ ID NO: 25831 - DNA, 12852 bp, Oryza sativa
  unsure (1)..(12852): unsure at all n locations
nnnnnnnnnnnnnnnnnnnnnnnnnnnnnnnnnnnnnnnnnnnnnnnnnnnnnnnnnnnnnnnnnnnnnnnnnnatgcaaaatatgcaattcctcattcagaggaaagcatcctactagccatgcaaccacaacacctgtccccaacattcagagcaacctactgtgtctgtgtgcagtcagtcaattactgtacacaacaagcatctactgtagctccgatgcaacgaccccctttcgatgaagaatcatcaaacaaacagtgcatccttcaattagaaaattcagcaattactcatgctgtattactggagtactacagatcatgtgaaacatgtgtgttgtgttgtaccgtggatgacggtttgatggctgaccgtgatgacctcaatatttgagtaaattagtcatcccaattaagctcccatgcctgactgccaaattatttgttttgtagtagatcatactcaccaaaatggtttatcacgagtctgttttctgaccacatttttgtctagacagtctgctgcagttgcccagatgattagtaacctgactcctgactgactgtcgatattagaccgactgacgtcttgtgtcaccaccatgatgtccgtccagcttgttcacattcatcagcagggtaagacatgcaatcacaacaactaacactaggtttatgtagtatagggtggtccatgatgcagaaatatgaatattctcaactctaaattctaaaaaaaaaaaaagagagacatgtttcttgtagtacaggcagtacggtacggtgaatgtttggtttggttgttaaacacgtttctcatctactttgcctgcatttgaggtgctagagtgaagataaatcttaggttgccagattattcaaatattcaatcaagataaaagaaattccaagcttttccatctaacatctccctcattagaccagaaacatgcttgcttgcaagctacctgacaatgcaaccgtccacggactgattgcatatcgtacaaaaatttctgtaacacaaaacagcactagtcaaacctgaagctttcatggaaccaaaccatctctagaatgagcttgcactccaatttgttataatatccaataaagcacacactctctcctggtattactgtagtaatgatcaaatttcaatgttcagaagaaacaccattaaatcatgaattggatttaaaacatgtgtccttccatgtaacatagtcctacagagacagctgccaacagcagtcgatgcaaacttctggttttcatttggtataacttaaaaaggatgaaatgtgcaaagatattgcaaatagaaatggatgttgtagaatcaaatgcgaactgtttcagagctatccacaagaatagatataatatttctttatagtactaacagattattcccaagtaacaaaacagcatgcagatcacatgagagcaatgcaatgacgaaaaaatcattagtagagataatcctatggatatatatacaatagagcactactaattgcacgttccatttccaccactgcgcactacttgatttttttttctttcaggatcttctaatgttacaaataattattcccaggttaaaaagaaaatagcatgcagatcacatgatatcagtcgatgaccaaaaaaatcacaattagtagatagaatcatatgaacatgtatacatctctagtagtactaattgcacgttgctaatatgaatatcagtcctcccaccatagcgcactagttgatgttttctcactatcttctaatattacaaataaggagacccccaaaatttaccctgttcttaaatgtcacaatatccataagtaagtctgcattcattttctgaaatacatagtcatcatcacaataacttgaccttatctctcttagatctttactgattccccttccaaaacttcttaaatattgttgaacgtcgtcgccctcaacagtttttgttggttcatgggtgaaggagaaacaagaacttctgctttttggtgtgtcaaagccatcgagatcatcacttgagttatttgtagttcttgaaacgggggtcatcatattatgactaaaagtacggcctccagacacatcagatccagttaagctaactgagcactgggtttggttgtcagattcctgggagggcaagaagtacttgttatagtgtgagaatgatcgttactatccacaaaatagacctacttttcattctactaaaatgctgctgggaaatcaacaagaatatgtaatatgactcgaaacaacacattaagtacaacgtagacaattcaggaatatttgagtggataacaataggaatatgaaaatagctgcaatatgccaattaacagagagtaaagactgtactatttctgaaccacataataaaaaaataaatgtttaaaagaatgatggaggctgttgggtacttgggttgatattcctaaaaagtactacaaatctcaaagcctcagtgaagtgaaacagcattgatttgctaacctcattatgccaatgacgatctgttggatagtggatttctgcaatgcttgatccacctttgttaaaagatgtatttctgctcttttgtgggatgttcacaactgaatttatttgagggtcctccagtgatgagaaatcagtgctatccaatgtcgagatcgagacacattcctcaaaataattcattgcctcttcagccaaatgcttcgatactttcagtcgttctacactactctggtaccacaacatggagacaaaggtcagttcaaataccaagacaaaatgaatagaaagtttaccaacaaacagaatcaaatatacttaaaatttgatgcagttacctttcgtcttggccttcttttatgtgcctcagtaaaatttggtgtagttacaatacccttcagcactctactcaactcttgttcacgttgctcttcgacagctaaatctgcccgtagctttcgagcacgttcatgtgactgtaatcaaagcagtaaaaggttatgactgttgactgcacagaattggaggcgcagcacacttggcataataatagtcagacctgtttgagctttgttgtatactctgttatatcaggagacagctcggcactgtccggatcaaagtcaagaggaatttccatttgttcccgttgcagttctattgaatggtgctctatgtcaggagccagatcagctctatctagatcaaactcaaaaggaatgtgcaaaatttcctcctttttgaattctgttgtgtaatcacttatgtcggagacaaactcagaagaatctggatcaaactcgggaggaatttcaataacctgttgcactgggacatttgaatgattgctttgccaaatgacctgtcgatgaaagaataatagtagcatcacgataagttgagaacatgagtgtaaaacaatattggtgttctaaaacagaacggggtatggtgcggagacaataaaatggataaattataagcatgcacagaacataaatggtcaaagacattcttagcttaacataggtaatccttacatgctcaagataatcataaatctcacaagggtactgctagattttttttttttaagaaggcacttctagattctgaatggatatttccagccatgtgttggcatgtctggtggtaataaaaaagcatagtagcttacaaacttgtttgctagtaaagttaatatcttgcatcaattaatacaactcaacaacctattcatgtaccactttggtcactgaaccaaaaaagccagcctatggtccactagtacaagtgaatgatcacttctgacctctactgagctcgaaactgaatgcatactctcccaaaactgaaattctattgacatatctctgatttctgcatcactctgttcgaatttagcaagaacagaacttgcgagcaaaggattggtggagatggaatgcaaagaccgagtctcaatttctctgcgcttctacagtgacaactccaagtgaactagattactatgaatctttctacttactataacgaaaaaaaaaacagtagattttgttcattatcatatagtagaatctagagagattgttttcattccacatgtatatggtatgatatcagaattacaaagactccaatatatttctttccagttcctattgcaaaaaaaaaaatagagttttgcaaaagtagtggtaagaaaaaagtttgagttttctttttcttgagacttcccagtcccccagtccgctgagaaatcagaaaccaacctcgtcaccccgataaggttgcaggtccaccgccaccgacggcgccctggaggccctcctcccaccgcctccatcaccattcccccacgacggcgacgagtcggcgccccggccccgcggcgcgagggacacagagcgcgccctcccggagccgccggcgcacgaaccattccgcgccacctccctccccctctcccgtctcgcctccccgccgcgacacccagcagcctccgtatccacctgcggctgcggcggcggcggagaggcggagtcgtcgaagagagggttggtgcgggtgttgccggcggcgtactccccgatgccgcgggcgcggggctcgacgctggcgctgcgggagcggcgtgggcacggcggtggggccttgcggggacgagccggcgggcggtcgtcggcggcggggtggagggtccggcgggtggtggatttgaaggccgaggaggccatgaattcggcgaggtttggattgcggagaggaggaatcgaaaatggaggagggaaactgatgaagtgaaatgggaaagtcaaagctccctccaaaacaagttttcttttcgcctgtcctcgtcaggtcagccgtcacagcgtgtcacacacatcacactgcgcgagtcacacagtggaagaagaggaggagatgcttcggtctgggctggttgatgctaatcgcatgtgctaaacacagatttagtgaggcttcggatgcttcgcccatgggataaacgaacgcaacattaattaggccttgtttccttcgcggaaagaaaaatttataggtgtcacatcagacgtttgattagatgttgaaaagggtttttagataatgaaaaaactaatttcagaactcgtctagaaaccacgagacgaatttattaagcccctaattaattcgtcattagcccatataagttactatagcacttatagctaatcatggtctaattatgctcaaaagatttctctcacgatttccatataaactgtgcaattagttttttattttatctatatttagtgatccatgtatatgtacaaagattcgatttgacgtttttgaaaaaaaatggaaactaaacaaggcattagactcttcactggaatgaataaattaacctgtttttatacttatattcaaaaagtttgccttttttactttttgggcctgttcagattatagctaaaataaatcttatcaagttttgttaatgctaaaattttagcaagatggtaatattatcaaaattttggcatgatttcttatgtattgactaaatttgacaacaaactaaacgtagatatttttttgataactttgtaaaaaaaagatatgattgaaaatgacatcaaagggaacaggctctttattgacatattttttgtaaaatgcaaaatggagattgcaaagtgccaacgttttttcagcgtgaagttatgagcaactgcacttatcgtgttcttaaaaaaaatgcactcatcgaatctttctttaaaacaagcattgaaaacggaattcacgttggatgagttcttaatataaactagatgaaaaccccgccgtgttgctgtggaaaatgaactaagttacataatatgcaaagatataatatgattattaaaataaaaataaattaatacttataaattttaagcctaaagataattgagattgcagagaagaaagaagagaaaatttaaaccatatctctcttctcttattaatatgacttaataagagaagagagaaataacattaactatatttagtggggatgaactatatacgatacggcaggcaggatatccatagcaccatactgcacttgtagccctgtacttctactataaaaaaaacctataatataatatgacctaccctaaaaacaacgaatatgaactattcttttttacggaaggaataggctatagcagctgtcgttgaaatgtgggatggaaccaagctgtcagccgctgttactaaaggaaagtactaaagagaatcccataaaaaattgttataaaaatttagaagctcaaaaaactaaattaaaccaaaaaaggcaaaagaattcatcgtgtcacatactcacattcacatacaaaataaggtgagcataaaattaaaattagaccaaaaattagaggcaaaatatggcactagaaaattagaagagcacatagttaaattagacaagaatttagaagcgcacaaaattaaattagaaaaaaaatcataaaattaaattagacaaaagaaaaggaattaaaaagtacatagttaaattagacaagaatttagaagcgcatagaattaaattagagaaaaacataaaattaaattagacaaaagaaaaggaatttaaaaaaaataaaaactggagatgcgggggatcgaaccccgtgcctctcgcatgcaaagcgagcgctctaccatttgagctacatccccttcgatgtttgaaataaaactaagagtctaattatttagtaaatgtttacttgggcaacagcaaacagttcagtcgtattcgaatattcatcaaatattgctgttctcgttcagaataaagggaaaattcaacattcaacaaaaaatgttgctgctttaacgcaacacaatattcttgcatgtgtcgatccaactcatagtccaagtgaaagtgcatctcatgttctaacttctaggcttagtcatcgatcgtgtgtttctaggctcgtggatcgtcaatatttctctaggctggccggagtattctagattcaaatttaaacatcaaattttaattgtacagttgttttgatctattgtagatgcatttttcattttttgtgattgtagccggtggtttcggaaaaagtaaccggttattggcaggtaaccatcattgatctgaactcaaatatttagtttgaaagtttgcccgagaaaggtttggacaaatgatgttcccaaacgccaaatacttattaccagagggaaagtatacagatgtggcatgccatcacaggaagtagcggctcatccatgtaaccaaaatttaagaaactcgggactgttttataaccaacaaagtcaaatcttgatcacacctaaatgcaatgaagtgtgaggttgggcctacacatgtgtccgtgctggacctcaagcccagcaagcaacaccacggcccaaacaagtcgctgacacctcacgccgtggagtggatctactcaatctggaccacacaagcctgatccgacggtgccccagagacccaagggggctcggagtcgaaaactccgaacccccttggtgagcttccggttttgaggcgcagcgaattagcttatctctggctgaatatcatcaaaatttgtatatttcgcaagactaaagcatctttgtttctagacatgaaaacgcaaacaccaatgtatgcattagttacaggaatcatgtaaaagaagcatatttgtttgatatttattccctgaaccttcctaaatgataggtgtttcatcatattccacttgtacaagattggcctgtttctaaccacatgcatgatctgtgagactgtatgaacttactgtcggttgcttttctgcatataaattcagtacgtctcctgccgaatgtctagcgtttttgcttctagcttgtcaagactctgatgacatatattgttcttgtcagtcttcagcttgtctcaaaaacgattcttgccacaaaatgtgtatccatggtgcaaattgtgtaggtaattttaaagctccttgcagacctttagaacattccaattttaagttcagagaccgcagatggtcctattcattttagaaggcccttttgcagtcatacaatgagcatgtgacacaattagaaatgtagacaagttgatttccactcttctaatgtcccatgttccatatgccatctactatggaagtccaagaatgttagaatgattgacaggagctagaaccaacttggaagttaagcctgacgaatggctgatcaaatctgtggacttatgtggattgaagagaggagttggtggtggctgaactttgctagtcaaaaaacgaaaaaacaaaaaagatagtatcgctcattacatttgaatttggtatatttaatcatatttaaaacattgacaatagttgctacctcattgtcaaagttcgcggtacacagttgcctgtgggaaaatgtgaaactatgaaaactgcaatgacataataataatagtcatgtactcaagctgtcttcagattcaggtatttggtatgcattgatgttcctgtaatatgaagaaatgcgttatccatgtgattccatatttccatctacaattacggtcaagtagaagtggccatgaacttcgcaatgattgaagggctcagcatttcacttggcaattagtttatggtcaaacatgtttacttaggagacagatggtccatggccagcctcttccatgtggacaggcatttttatgtagtactggatgcatcatggtatttccacttggtatgattaaccagggcatcccattagtaagaattattcttaacatagtattcaacattgtttcagttttgcaaatatagacctacaattcaatgtttcagacaaaaatgtaggctcattactgaattggataattttcttctgaaataagcattgaactgaatatatatactgtccaaaatcaaaattaagagaggaaggaaggaatgaattctgaatttctgatgttattgttaggcttgcccgggtctaaaaacttgattctgaaaccgtggacagtgctatctgtgtacgatatgtttgcggccgatcagccgtactctgcacgatgagctgctacccgatctgaatctgaagcatacaacattattgagattcttttatatcctgagtgtactcttgaaagaaaaacgaatgtctgatctgatcacatgaccgaacgtgttgtatttagttgttcgtatactgccggcctgacggaagagatgctattagtcaaatagaagcatctttcacatggtcggcactcacgcatatatccctagaaagaattatggatcatatgcttaatgtgaagcacttttatggactagattatctgagaatctcaaggaaaaggagttttttcagtcaaagagaaacagcactactatttgaggtctgcaaaacaaaagtgaggtctcagggtggcatgttccagacccacttgatgcatgactcctttcttcttaacaaaatattccacagaagctaaaatttacagggaaatgtgtggcatgttctctgcatgttcccaagtagtggaagcagcgcgcctgcacattgcatctgcatgttactgctactgcaatcaagctagtctgtatctgtaacacaagttaaaagaacaatatatataagccagcattgctcccccttgatgctcaactgccatacacgcacacagtactgcaactaccaccacatcacggctgatcaagaaagcatcatcaccatgaagaagaaggctttgcaccgcgtgttcgctgccatcttcttgctccatcttctcctctctgtaactgctgctgcatcaccaacgatcggcaccgacttgttgcgtgacggcaacaacaatgcagtagctgctgctgctgctaggagtagcaggaggttgctgctgcagcagcagcagcccacggcagcggcgccggcggcaatggctaccaacaccttccgagtcaatggcgttcatcaggcgaacggcgagcccaaggtggagttcgacgccagcatgaagcacaaccccgggaccaacttcaatcccaggcacaattagaagcatccggcccggcaaccttcagcttcttcctggattctgctctccgttttagttagcaaaagttttgcagatgagttttatgatttatcccatcttgtagatagttttaacccagctttctttactacagttaagatcgtctcgctagtttcatcattagttccactaaactgctagcttagtagcttgtagcttaatcagctggatgactcacattccggccgttaggtaagctagcttaatctgctgtatccttcaattcaccgagaataagcaattggggaactaacagcaatttcttgtccgttgttcagatcagtatgtgaatgatacttgtgggctccttttggcttcctttttctccctatctgtcacttcttccaaatcatttctatttcacaggctaatgggctatttcctgggaccatgctgcctagactggaacaagaatcagcagaaataacagtctgtattcctgatccacaattgctcagggtggccatatcaaagttgtgtgttcatatacctgaagcacccagcaaatatatgttcctaccggcgtacttttactgtgacaagctaggaggtttttgttcaggattactgaacaataataaccttgccaaagaggacatgttgtacttgtatttacaatgcagggtacagacttcacctcccctgaattatcctcccttactctgagctaacaacccagccacatcctcagaatgaatgaaagaatggaaaacagcaaacttgcatagcaatcattttgaataaaaaataaataaacaaataaacttgaacatgacaaatatttgcagttcacaacttcaagtaaggatctatggatatatggcttctctagcaaactaacagagccaaaggtaagttctaccatagaggagcccaaaaaggttttcacttgggcacctctttaagtaaaaaatgtaatgccaacatttgtttgcctcaggactaaaaataagatctggctatgcaaacaaaagtaaagtctaactaacttcacataaccaagaagagttgaacaactcctcagaccaaaaggaatagttgtacatcacataagccgcaagcctatcctacaaatcttcccaattcataagcattaatcctgcttcacgacgcaggactcgccaactatcagatcaatcctcagggtattgtttaatatacaaagttagcacaaggtgcttcctttatagcccaacaattgttgtagaatcatcattgccgttgggcagatggagattgctgaacctgcactggtgggaagaagccagcacctggtggttgaaaaaatcctgtcgaggtcggcgattgctgtggtgcctgcggagactgctgctgctggggctgactctggttctgaggttgtgtaggcagaggcagaggtggaggcgcgcttagtcttggaaaacctgctgacataatgttgggcaataggggtggaggcggcgcagagccactcaccatcccaaaaggtcccattccaaacattcctccagtattttgaacaaattgtggcataagtggtaatggaggtggaggtggtggaaatgaaccggttgcttggtttgcttgtgttggtggctgtgtgcctccaagagcagctgttgctccaatctgtggttgcacctgtggtacttgcccaaagaatgggggagcacccatgtcactcacatgaatagggttgtcaagcctaggcttcttattgctctcaaagcctggaggtcctgcagagagatctccagaagtcgaaccactattccttgcttgttcagcagcaagggacgagaaaatggaggagagcaccttctcaggagctgacaaagatgcaagcttatctgccatagctgctgcagtttttttgggctcatcaccaacagcactagatgtggcaggaagtgaggttgctggatgcagtggttgatagtggggaaatattggcattgcagctgaattctgcatcatggcagctgtttgtcctggtggaagtgtaaccatcagtggactagaactagatcctgcaccattgttcaaggcactaccaagtcgttgttttagttgcatggcatgttcagcctttgctcgagctacctgtcaattaaatcagggttagccaaaaatcaatctaaataatttcttgagtagctgctaaaacaccccttcagtggcaggaaagatgctgcggttttaactgagatggtatatagcaatgttaacaaaagccagcggagacggatgctacatacgggagcagaaatatgtgattggaaatttccaactaagatgcaatgacacatgtttgtaccgtggagttagcaggttagctacatagaacctaggttacaactaataacaacgcatatgcatgggtacatcactgcaggcacatctttctattagctcatgcaagggccaccttaactgtatagcttatgctatagagatagtcagacctcccaatgtgctggacctatttctcttgaaacagataaagagaggaatgtcatatatgcaaagttgcaaacataagttggaattgagaagcagtctaataagtaggaaataacatgtcgccttgttatccaaagaaggcctcagggttgccatggtaactaaaaggcaggtttgtgcttcaagcaggatactagatgagacagatcatctgt

SEQ ID NO: 25832 - DNA, 9846 bp, Oryza sativa
  unsure (1)..(9846): unsure at all n locations
ttccaaaacactaacagcattattgcatttgtttaaagctgtgtcttcgtcanaatgttgatcaagcacagactgatatgctgtacattcttttctggcatcccgccaatagtaagtttctacatcaaaagaaaaaccaacaaaaatagctcacattcatgacaatatactgcatccatcctcagcacaagaaaatatttctttagcaggtcaagatctggcaacttacttttgttactgtaccagaatcttttcgcacagctttggaaactgaagaggggtgagagcttggatttgagctattgccattgttacccattgtatgagtgctaccaccaagaatgtcatctttcagactttcaatacgggttccaaagaccttccgttcatcccaaatatctatctgtaattttaaaaataaatatatttttttacttttcgggttttggccttgtgatagaaaaaaatgaagtaaatagacttttcctgccattaaacatgtaacggaattaagaataacttactaatcttccgactactttctttccatcttctcccccattgacataaaagtctttcaataatccaggaagaaccctccagaattcattcacaaactcccctcccttgcgtttactattttgcaggatatcatttgacaggtacaggaatgatactttcttatccttatttgcactgttatactgcttctcccatgtatcaacaacctttctggctctctttcggtgaaaaatgcaccaatttgaaagtgctgcttaagaattaaggaataaaaaaggcaagctactgtattctagatgctattgttaaaaatatgctgtgggaatttggtatcatgactgtgtaaatgatttttatggcattggcattaaacacaggaaagcaagtggtaaaacttgttcagaagattttacatagggcttcgagttgctaatatgtaagcaaaaggacatgacataaccatcacataatccccccacccccttagtagcatgaatatatggatgcaggtggataaatgctatatttatccttgttcaaaggccaaaaaattgcaatttgttttttttttacaaccgtagggaatttgttatttgttaaattgatgaaagtatattagttctgacctaactgattaactgacttagaaatgaagataaatggccataaaataatagaaaaggttgtttattcatttgccaatactacgggcctgtttggtagaaatataagaaattttagggttatacacggttattaagaaaataggtagaattaaatggaggaaggttgtgattggatgagaaatggaggattgtgattggttggaaagagaatgttagtgaagaagttattatatttgcaacaaattctgaaggctagatattgttatattttgggacgaagggcgtacaacattagtgcaaccaaatattgtcacactgtatttcgaacatcgtaaaaagcaattccacaaagattgtgctcagccatcaagagataaaaaaaaaaagttgaactagcatatcagtaccctgatagcagcaaccaaaaggaaacaaactatgtgatatatgactgattctacccattaatttgtatattgaacaggaaaacagttatattcgaatgtacaagaaaacactactacaatgtgatacaaacctaacgctccttattattattattagtcaatttcaaaatataatcatcctcaacagacatagaaaaacttaatttttcacaacaaacaaaaaattattacacgtcaaacagaagaatagaagatactactagatgtaacacaacagcttaacaaatcatgccattatttgtcatttttcaaaagataatcatcctcaaaagacagtgaaaacttattttcccaagaaacaaaaacaaaaggaaagcatgtattgacagtaagaacacatcaaaccaaaattgtaatataaatttgattgccaatagcacaatacaccataacgctgataagaaactacaaatattttagctaggctaatttatatacagctataattgaaaataatatatgaaaatatgcccaaaagaatgatccagaagctagagaaaaaatggccacaccaagttatatgtgtatcatcgtacacatcaataagtattgataagtaaaacatgagatgcaatctaactctaacagcaataagcacagttaggaacagaagaaggtgaacagtaaccaaacaaacagtgcaaaaggcaatatatggaatgccaaggagatatgctgggtcagttgtactaattcacattgcaatttagggttctattcaacttgaatagtaaatcaatcaaaactaccagacagataatataagcaaccaaagtagtactaccctaatagcactagcataccactaccctaatagcaccaaccaaaaggaaccaaagtatgtggaatatgatcagttctggttattaatttgcaaattgaacaggtaaaatattccattctaatgtacaggaaacatatataagtactaagtagacaacctagaaaatactagtaaaatgtaacacaaagcccgaacgctccttatcatcatttttcggtttctagatacagtcatcctcaaaaggcattgaaaaacatagtatttctcaacaaacaaaaaatcgttgcatatcaaacagaaggatactattaaaataatacctaacagttcatgccattatttttcatttttgtaaagataatcatcctcaaaagacaagaaaaaaagatttccccaagaaacaaaaataatggaaagcatgtatacagtaagaatgcatcaaacagaaattattataccaactttgattgctgatacaccataatgctgataagaaatctaaattttgtagccatgctcatctatatacacttatacagctataattcaaaacagtatatcaaaatatgcccaaaaaaatgatccagaagctacagaaacaattgccacactaagttatatccgtatgcatcagtaaataacgcacgagatgctgtctaacagcaataagcactgttaggaacataagaaggtgaatattaaccaaacaaatagcgcaagaaccaacgtatggaacgccaaggagatatcctatgtcagttgtactgatccacattgcaatttagggttctattcatctggaacagtaaatcaattaaaaccactagacagataaagtacgagcgctaccaaatttgcaagcgcaaaagaaataaacaaccggaagaaaggatactctggatcctagtcgccgtgttgttgagcttgttaagcttctcaacaaacgcttgctcgctgaacgagccagagccgccgccgccgatagtttccgcctttgcctccgccttggcgtccgccttggtgtccgccatcacgaaggcgaaggctccaccaccgaactcctccccctcgcgaacaagctaatcccccgaagaaacttgtgcttcttggccggccaagatcgaaccaatcctggcgcagaaaaaatcccccaaaaaaagcgagaaaatcaggaatttggaagtgagagattgaagcttgcggaggttttgggagggagagtggcgtgtaccccggtggcgagctcgtcagcttgaattcgccgccggtgagcgagggaagggggcggcgaggccggggcgggcgggggaggacgagacgagagggtttggttttctttttttttcccctttccgtgctgcgtgtgttcgctgcaagcctcttgggttcaagagggcagagggtttttcacatcagaacatgagagggtgaaaaaagaaactgaggataatgttattggattataattttatcaaagatagctataaaaatgaattaaatagataatactattggttttattcttgtgagatttgaaaactcgtatacaaatatgctatacattttttctattaatatacatacgttaaagcgtgttatttgtttagcgtacaatgcgggctatattgaatatagccatagcatttatcacttgaattatacatatcgcttttggtgatacccttacatatttaatgttatgataaggctcgttcatttatttttttccaaataatactcactacatccctctgttccaaaatgtaaggtatttgggttggatcctaatactacgaatcagaactaagattcgtagttctagaatgtgtcacgtccaattaaaatctcttatatgctaggacggggagaatatattttagcaacatattaggctacactttagccctaatgcttatgtataatcacatccaatctctccctcggtaacgatgtaacttgaatgtaaataggagagatcgtcctcatgagggtgccaatgttcttgagattgttgatgtgccgcaaagagagtttggatggtccaaaatgtaagaaaacaaaaatagatgatccaaagtgaaaaaaaaatcagataaaaatgctccaaagtgaaacttcgatagcagggggaccaaagtgaaattcactcaataaaaccatgatgatggctcgttgaaaagcacataattaacatgtgcatatagaaaaaatatctcatacattttttacaactattataatcaaatggacgaaatacttgtagctagaatcgtatggaacattttaccctaaaacatggtgggcatgaacataaattgtaaattttaggattttgtgttagatagcctaagacctcaggttttatgaaatctactcattttatcatttgaggtactttaaatataacatagttctactatttttttaagatgcatggtcacccgttatgctaaaattagcatcatcgtataataagagtatgtgcagagaaaaattgaagggaaagaaaaggaaaccaatggtactataatccatttgactccattcctcgtttcccaagtacagaaaactacaatttggttcaaacggatcggaagagctaaacattttatcagggaaaaaaaaagaaactaaatatactcgcttgtacattgaagcgctgctagatgatgctccgtggcgctcaatgtggggagcttcaccctgacgagtcgtgaagaagcagagaagattatagttggaacgccatctccatctgcactggttgttgtttcaagccggtagagcttctggccagcggcgaagttgccaagcagctggtaggaggtcgcggagccatccatggtgaggcagagatcgtcggtgcacgccgcgagctccttctgtgtgcggtagatgaagttgagcgccgcggcgacctcctcctggaaccgagagaatgggctcgtggtgtcgtcgtcgagacgcagcttgcggagcttgcagaggccttccccgagctccatcatggcgccacggtggttctgtgtttgtgcacgatcatgtctaatcacaaattttactggagtaattactaatttactatgcatagtcaaatgtggaaatgagacgatgaaaatatatacttggttgaagaggtggtggaaggcgacggcgcactggaggatggcgtggagcagcgtccgggtgggctcctcggcggtgtaccagagctcctccaccacgtcgtggcacgcgtggaactcgccgccgttgaacagcgccaccgccgcgtcgaagctcccacctatgacttccgactcctcctcctcatctccttcttcatcggcatagttctcgtagaagtcgtagtcaccccgcgcggtgaggaggcggcggcggcagcggaggtcaggacgagaggaggagcggctgcggcgctgctggtggagcggtgggtgggggcggcggagcaagaggccaccgcccgccggcaacagtgtccgtggcgcggtgggcgtgcgctgctgcggtagtagccgggcggcgtgcagcgaagccgcagagtgggagtgcgccatgggaatcgaattaggaacaagaaagctgcagagatcgctagctctgctttgtctctgtcctgccacgaaatgggagtcgaatcgcgagcgtgtgacgtggaggacgtgtggactcaagcagaggttgagacactcactcgtgcatgcagaaccaaccaatggacaatgcagtgggtcaaagtgtcaaacacgcaccaactggctgcaaaaatatctaaccagtaaccacaggcccaagaggccaagaagcaacagccgtcagccggtctgcctggcctagactgacctggttttctcatcgtttcctgttagaaaaattttccctcgtcgaatcaaccgtaaaatcagatacaacacatctcttaacttttaaacccaatacaaacgaggtcacttgacaataatgttactgcttttggtttatgtgacgtttgcgtggcttctttgattaggtatttattcgacgtgtgatattgacatgacgcttacatgataatttgatccaggaaaaaaaataaaaatcaaggggccacatatcagaaaataaaaataataataggacccacatatcaacaaccaacccttattacttccctctttcttccatctatgatctacagaccgatgttggccgaacacgggcagtggagagaagggcggctaacggggagagagatggggctggcggcctccacgtcagataaaatcagggacaatacataaaggaaggaatcttgtttgtactggttttgaaagttagaaatgcgttgtatccccttttacggttcaaaaatcgattttgaaactcaacaacaacatgaggcgcctcgaataaacttttgtcctttcccgttcggcttaaaccatgcatcggctacacttgaaatacttgggcgggtaggattgggtcgggctcaattctcaccaacggcaatgggtgggctcgatcacatgggccttgtattcggcccgcacacgccaacctgtcctgttctgccgtcctgctccgctggcccgctgcgctgccaatctcttcttctcttcccgcgtctcctcgcgcctcttcccgccaatcgccaacacattttcccccacctcacctcgctcaatgccctcgtcaattccatttcatccccaaacttccttctgctcttgctagggttccttccttcattccttcatctccctcccattccgtccctctcttccagattactagcgagctcgatcctgcggcaggggcaagtcgagcgatggcgccgctctcgtggcgccaccacacgctgctgcaggcgctgctctcccgcgggcccctctcggagcgcgacttccacgccctcttctccgccatctccggcggcaagaaccccggtatatgcttctgcctgctccgcttgctactcttatctttctcctgatgtagctcccagtcattgatttcattactcgtagcacaggtgttcgacgtaatgcccctctaggaattactatcatctcaatggaaacaatcttagttggtcccaaccttctctcagtttcagataatttctgcttcagttcaccattgacgcctggttttattacctaagattgctgacaaatcataaaaatactatgcgtgatgttatataatttccggcctaaggggtgtgaatattcccataattgagtctaacaaaatggtttgcgatcactcatgttccgtatcactgcttgcagccactcatcggcagctgttcgatgatacactcctcaagatcaacaaggagctcacgtacttgcagtttgagttaagagcaggcataaaccagtatgatggtactgtgtattatggagtggtcaataacattgctgatgaagagtcaaagcttggatcaaagttttctgtgccacagattgcattctacaagggattggtatgcaatcaatttgcacttttttttaaaaaatccagctcaatctagtattcgctatattcatgtaattgtatgggcagttggaagcaatagttcatgaagctggaaatgatgggagcataacaaatatcgatgctcttaacacacggattgagaaccaggtatctcgtattaatacccaatcactatgagagcttttgtttctgtttaagcaaatgttttatatttttattgttgcaaacttttatggtagtgtgacaaatgaaagaattatttggtgttctgctcccaggttgtaattgcagacgcttcacagggcagtcaatcccgtctgcctacttccattaccaacttctcattgtcccaaaaggagaaaactcttaatgaactcatacaggatcgttggctgtcatacactcccacaggaaagattggtcttggcataagatcatttcttgatctccgaagttggttacgtagtaatgatatcccatcatgtgaggtctgcaatgaagcttgtataaaggtgcagatatgtcattatgaattacgattctacatttgcatttatcttgtacccatggtcatatacttcactaatgtcattccatgtatttttattacttatatttaaaacaggcatcatgttgtcctaatgaggaatgcaatgtaaggattcatgggtactgtttgaagaagaaattttcgcagagaaaggtagtcacctatttttaattccactttacacatatgaacaggagtggctttctaaatttgtttgtgtctgtaggcctcgagagcttgtggttgtggtactgaatggcctcggttggagggtgaagatgacggtgctgaggatgaggatgttaacgaacctgaggaagatcaggtcccatcagccaaccagcattcgaggactagacgcagaggtgtcaaatctgaactggtggaagaaaatgaaagagcaggcccatcagcgaggatgacaaggagggctttgagaagctctaaagctgaagcagttgaggctgctcaagaggtgccatctgcagcaggaccttcgcagtcaaccagggcatctaagagaagaaagaactgatgagattgatctgtgcttgctagtgagatctccaggttccttttgtcatgtacatacagtagcagtagccagtaggtaatccttttgaagtggcaggcaaagttgcaacttctagttggagaggaatatatatagctttcggatgctcttgttactaactcttagaacgtattagaagcctaatgctttcatttggcaaagcaagcctgcttgtggcagcacagttaattgtttgaatggctctcttgcttgttgatgctagtttcatgcatgctgtttttttcccctctatgttgcttatttctttgtgtctcttcctaaaagggacaatttaaagctcccaggtcccagcctagccagcattgtgtggttgctgacttgtataaacagtgaatggaaggttgcctaggagtcaggaggaaaaacccaaaaatagagaaaaaacagagtgaggttggtttcagggttgagaatatcctgaacaagggcagccaagtcagaagtatttttgtttatgtgaatgtgaagatgaagatgatcctcacccagctgacttagctatggagaacagcttgttgagtcctggactacttgcttgacgtattctacttgttcttttcatttttctctttttgagggcgtattctacttgctgatgcagctatcgtactctatactaaaacatactcctttcgtcccaaaaaaactcaacctcgtactataatatgtgatatatcctagtacaacgaatctggatattcttagcactagattgcctttttttgtttggacggagggagtaggcagcttgcatgaggtacggtccaactcggagannnnnnnnnnnnnnnnnnnnnnnnnnnnnnnnnnnn

SEQ ID NO: 25833 - DNA, 719 bp, Oryza sativa
  unsure (1)..(719): unsure at all n locations
nnnnnnnnnnnnnnnnnnnnnnnnnnnnnnnnnnnnnnnnnnnnnnnnnnnnnnnnnnnnnaatctcctttggcaagctgtacagtatgaccatggcgatgacagctacccacatatcatgttttttgcaatggaacatatccctcccatgactgaactgacttatgattatggtacagaggtgctccccctggctttgagggaaaacccttcaaagcttgcaaactcaaatcatgcctctgtggctctaagcattgtcgaggtttgttctgataaaagatatggaggctggtgtactaaagcaggtaaaacttgtttaacaatcgttccaatttataatttttaaaacaaaatctgcttcttcatgggaaatgcattcttccaacctatttatgcaactgaataatctcttttaaaagtagctgattcatcactccattcatgtaagtcaagaactctcaaaacaactctgtggttacagtcgcctgcagcacctatgtggcgattttcatgctttggtacataaacatctattttcaacttaagcttagcatgccatatatttattcaagaatgtatataatattgacgaactgaacaattagatctgaaactatggcaactctatttctcttgtgactgcctaatgcttccatcctacatttgcaggatattaaactactctatgaatggtagcataaagtgataaaggggctctc

SEQ ID NO: 25834 - DNA, 821 bp, Oryza sativa
acgctttttacgcttttttggttccggatcgcatgtaactttttttttatttttttgtcgctccaaacgtgtcgatgtacgtttttaagttggattgtatatctgctttgattgtatattttctaagtagtagagattccccaaaaatctttaatctcttcactttgcttaggttggctccggttgacagtgacacggggaaaggcaatcggacgcggttgagggccgctttcgcaaacggtattgggccagaatgtaaaaaaagcccatagcccatttttgtcgatctgatttctaaacgaagcccatagcccattaacgaaaagagcccacggcctcttctcttctttcttcctcctctgcaagccgccgacgaggcaaatgagagaggagggaagaaaatcgtaaaggagagagagaagaagaagaagaagaagagcggaagaggaggggaggagccatggatgcttcagcgctcagcaacccgcggctgcaggccatgctagaggtaataataaacccataatgtattagggagatttagagatgagcggcacactcgagtacccgacctatggaaccctaacatggagattaattagcagcccccttcttttgatcccttcctgctcttcagcccatctttttgttggtacgctcgctattaattatgtgtcctttctagatctactcggagattcgtgaaaaaggctgagctttgggcgaaagtttgctgatttgggccaagtttttgcccttactgttccttccaacctttagcttattatgtatacattttatttattttgttcagttgtttt

SEQ ID NO: 25835 - DNA, 2378 bp, Oryza sativa
  unsure (1)..(2378): unsure at all n locations
tccttgtcattcgctgatgtgttctatttgttatgctaatgatgttttggtatggaatacccaattatatttccatgacgctactgtgggttgatctattgaaaaacaggactgacaaaatccacattgttttgagcagattggtttgatggactgcacacattcatgaggtatatctgtcataaaagttggctgggtgggtggttcctacctcagaagaggagttattttgccttaaagcttcctaatgggtggtgggtttttggccttgaccaagctcttcatggtgacattgatgtctatcagttcaagttttttgcagagctatgtcaacaaaaggtaagtacattgcgtcatctttaggctattagcaaattatttttgtggtgaatgctatggtctacatttgtgaatttgttgtttcggttcttctagtgaaaacacaatttgattgtagtacaccagtgacattattctacaggttagtaatatgtactagacgttgttatcatgaccagaaaattatgcataatttcacgtgaagtttaccgcgtgtgggttttcttattgactaatactacttgtaactatgcaggttggagaaagtgattctgtaattcttataactcatgagccaaattggcttcttgattggtactggggtgataaaactggaacaaacgttgagtatttaatacgtgaatacctcaagggaagatgcaaactgcggatggctggggatctgcaccattatatgcgccattctttcattgaatctaaagaaccagttcatgtgcaacacttacttgtaaatggttgtggtggggcctttctgcatccaacacatgtctttgagaatttcagagaattttatgggaacaaatatgaaacaaagattgcatatccttcttatgacgattctagcaaggtaaggttgattcctgcttgtgtgccttcagcccttcatttggttcattacatagcagagcttgccctttcatgttcatgagccgattctatttattgccaatttgacttctctccattggttgcccttccagattgcacttggtaatattttgaagttccgaaggaagaattggcagtttgatgtgattggtggttttgtgtactttgttttggttttctcgatgtttccgcaggtgagagactaaattatttatgaattatttaattcatagtaaatcattttgcttatgcactatgtggttaatgtgaatacttatagcctagaaagaccatccaattttcatatgcacgaatgctatattgtaaagtccatgaaggattgttctccaacagcatattatatgcttgtctgattaaagtagtatcgtatatgtttggcacggaaaaataaccttggtggtatgagttcattgatgattatgccctgctacttacaattgatattggacatgacctatactctccagagtattttaggacttaagaataatgcctgatatcctctatatagttttgttttttgttgcgttgaattggatttaggaaaattattagggctttgctcatagaatcatttcaggcctattcccaagggcgcattaacatatctgagacttcatgaacatttctcataggttcatagttgtactttgtaggtttagttgcctgtagtctgctccatgaactctatggaccaacagttggtgataaataatgttcatctagacaattaatgtgcatgcaccatataatagaagctaaagcaacaagaaccacatttcaactttgggcactagagtatcaaatttatattagagcagtgctagaagtttctcaattactgttcttttgtggcctgacataagtatatattattttcagtgtgattcctttcgtatcttacgtgaagactcttgggctgaccgtgtcaatagtttcttcactgcaatgtggaatgttgtttttgagattctggagcattcctatgtatccctggctggtgttgttactctattgatggtatcttttttctttgtacccacaaaactatcgcgtagaagacgtgccttgcttggttttcttcatgctgtggcccatctaacttcagcagtgatactgatgctgcttatggaattggctattgagatatgcatccgcaacaatctattggcaacatcaggtcggtgtgttatctttctttttttttcatgcatcgttgcttgatatatcatgtaatgtttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25836 - DNA, 717 bp, Oryza sativa
  unsure (1)..(717): unsure at all n locations
ccatggcatggccttcttcgtctccccgaccaagaacctctccgcagcagcgccgaggagctacctgggcctcttcagcaacaagactgatggcgatgtggccaaccacatcttcgtcgtcgagctcgacaccatccagaacaccgacttcatggacatcaacaacaaccatgtcggcgtcgacatcaacagcatccgctccgtgagatcctaccccactggctactacgacgatggcgacaacggtaacctcaagaacttgacattgaacagccatgagccgatgagaatctggatcgattacgaccaagaaaccacacggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25837 - DNA, 362 bp, Oryza sativa
acggttcatgcaaagcaaccgagtgcaagtccggcccggcccggcccatattctctctaggttgccttggttaccctagccgtgccgctcattccccctccgccgccgccaccgccgccgccgccggaattgctaggatccaccaccgccgaattgctaggatccaccaccgccggcgatctccagcattatattcgccggtgttctcaacgacgtggagcagagcaggtgaggaacacgttaatgttccgagacataattacatttctttttagcttcgtgttagttttcttcttgatctaagatagatatggttgcgatccagtcctttcctctccttacttgcgatttctctgggctgc

SEQ ID NO: 25838 - DNA, 742 bp, Oryza sativa
ttagatgaaatgatgaatggtagtagtttccgggccaacgtgttgctcacaactccctcccttccattaatacacacatcagcacacacaacacgtccaaagtcgagaagtacctaaaagctattaatccgccagcatcacaaccaagctgaagtagtagtagctcgatcaaaaccagctaaatccgatatcgtccttaatttggttagttataccaatcgaggtaatcattatgaggatccaattgaagatccacaattaattgctgcaatggagtaattgcagtgtacttgttcaggttaattgagctggtagctagtaatagtagcagtgttctttatttattaattaaggcgagtatatgttgttggtatagtacttccatttactgtactagcaacttaattatcgataaaccttggccttatatatatgtaccttagctcaccgaaccatgcatgtaccagagctgtttcgattaaataatttatgcacctcatgtatgcatgagacaggcagcagtgtatatataccttttttttacataatggataggcagcagtatatgcctgatatatgcattgaacgtacagatcgatcgatgttcatatttagtttgtactactactccagctagtacgtactatatggcggggtttcccaaacagccgggcccggggttaccgcgcctcggcggtaagcacggtaaccgtgaaaaaccgtacgaaaccgtgtaaaattt

SEQ ID NO: 25839 - DNA, 785 bp, Oryza sativa
  unsure (1)..(785): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgacctgggcgtcgtgctgcacgccatgcttgccaagaaggaggagctgaccgcggtcggcaacaacgggtccgatccctgcaagaggctgcggatcggggccgacacgggggcggtggcgtggggacccggcggcgacgcggccgagatggcgcagagcagaggcatcgtgccgttcccgtgctctgctggcggcgctgccatcggagtcgtgctgggtgccgcccatggacgaggacgactactcgtcgctgtccccgtggatgatcctgtcgaccaccaagtccgtcaagtacatcgacacggcgcactacgcggtgccgggcggcgcccgcgtggttgagttggtgaccggcatggagacggcgatggtgcaggaggtgagcaccgtgcccgggctgtcgtacaggctggagttctccgttggggacgccggcgacgggcgctccgggtccctgaccgtgcaggcgtacgcgtgcggagatgagagaggcgtccggcgaggaggcgggaggaggagggcggcgctgctggcctgctgctatgccgtgcgacgaggagggcggctgtctgccgaggagaa

SEQ ID NO: 25840 - DNA, 13551 bp, Oryza sativa
cgtcatcccgatggctggcgagggagggagaagcggggcacaccgtcgatgtggtggcggcggaggaggaggacgccgggcaccgctccggggctggatccggccgcggaggaggaggagacgaggaggacaccgacaaccactatggcaacgccgacgaccaccatgctcaccagccggcgggcgctcgcacgccgcttcggccgccgccgttcagccctgctcgccgccgcccgttcttgctactcccctgccgcaaagagaagtaaaaaagaagagaaaaaaagaaaggggaaagagagagatgacgtggcacgctgacacgtgggtcccacgctgactcagccgccacgtaaaccaaaaccgtggtcaaaaccaccgaaggatctcggggtgatcggttttgtatagttaagataccccgtgtatctggttttgcggttcgaggacgtattttatcccgatgataagttgagggaccttcggtacactttttccttcaccggccggccacgccggacaagctacaggtgcggcatgggctgtaaagcgcatggagaggcccaactctctaacagttacgaataaattactttgagtttggtcgaagtcggttatagacaaatataataatatttatattactaaattaattttattaaattaataattaaatatgtttttataataaattaatcttaggtcgaaagtattactatttattttataaactttattatacttgaagcagtttgattttaaccaaagttaaaacattttataacttgaaacggagggtgtaatgtatttgttgattatcactggattttcaaagaaaaaggaaatcaattcattattctattatccatcaagaaattaaaacgaaagcagtcagcagcttagtcaaagggaaacgtacaaactaatgtccaatttttgaatcaatccaactcagaaataaccacacacttggcattaatcaaagggaaacaatcagaagcagcagacacagaaaggtagcgaacacaaagagccagccaacaaagccatgcaaagaaattaaacacgcattaaccagcacttaaataaacttaaacagcagatgaagaagccgcagtctcgttgtcggcggcggcggcggcgggcctggagacgatgccggcgtggttgagcagcgcccagagcagcgtgatgagctcgccgccgcgtgggcgtccaggttgtcggacggcgccaggtacaggatgatctccgaccaaaactccgcaagaaccccccacgccttattcccttcctcctcctcctcctgttggttttggaccaacgccaccagttgctccgcgagctgcgcgccattccttaacaccttgtgcctgcagcctgcgctgagcaatcggaccagcttctcgtactccggtggagcacgaccggcggcgagagcacggcgagcgtctgccttgacggccttgtacaggtccttgctccagccatcgtcgtcggggagcagctcgggacagcaggccaccaggtaggcgcagtagcctgacaggtgagtggcaacaaccctgttgctgctgtcagagcttgagcttgcagttgtacttggatttggatacttcacctcaaggatggtggtggcgatgtggcacaccaggaggacgtcggttgtggctgtcacatcctcccagagcagctggctgtcgctgccctgcagatgcagagacgccgtgcatgctttggtcagctgcaggctccccttgctgctcctgagcttggcgacgatggcggacttcacttggtcgggcaccttgacgatcttggttttctccggcagcggcgaccactttgctgttggacgatgcatgtccaggattgagcaaaggttgatgttgtccttccatgggttattcaccagcttgcaactgcatcgcaataataagcttcagcatccaattaccaatgatgatcgtcgtcgtcgtcgtcttggcatatcaactggaggagcagcaggagacgaagatgtggtctggtgatgatgatttgttggttgcaggtagcggcagatgacaacaactttggtccagttagagaacaaaagggaagcaatattcctcgcctcggaaagcacaagtagcacacaaagaagaatagctggcactagatcaaatgtgagacttccaaatgtataataatcttcgaatcttttgaagtgcccaaggaaatctctggccccgacatctttgcatggcatagtacaccatagttggaaggagttggagaaattcacgcaagcaagagtggtcgacaaaacggctagacgtaagctgtaagccaaggtgaagactgaggtagagaaggtgaggataggaagccagcaggtgtttgaataaaaggtagggatggatgcatagtaataatcgtgaatgaatgagagctcatctgctataaccttaaacaccctcctgctgctgctgctgccaccatcatgagtactactggtcagcaacaggccttgccaaatgaaattctcgacccaggtaaacttgagctcatcagctgtgtaccttgcgaatcgacaacgtaacagcttgaacaatgcaaatgaaagacaaacatctttcagctgtttgtgtcctgcaggtgtccagcttgtcagagaataattcgtgtactcgtcatccatttgctgccaaacttcatctaagttcaccaagccagcagctcctctctgctgtagattattatcaactacactagtgtaactattgggccctttttgtacattaacagtgtcctctcccataactaaaagtggcggaggaggcacatcatcgccagttacatgcattactgatggtaggacgacgtccttctccttctccttcatgtatccaagcacaagccgaggattccgtccaagagcaaacgattgtcgggccatgaaaaatgcaaccaacttgaaaaccaatttgacaaacataagacacgctgaaaccagcacaaatattctacgaaaatcactcatatcctgtgagatggttttgactgaaaaatcattgccactaccaaggtccgtccccaggaagtagatgaccaggtagcaagtccagattgcatgaataatcaataatgcagatggtgcaatgcttcgtcctaattctctagcatcagttgccactagtgttatggtgttgatagcggcaatctgaacaagcactgtccactgtaagatacaaaacgtgtgtaggagccatctgcaggtcgctgtggttgtaatgggttggatgagaaaggtaacaaaagtactatcagagacaacataggacactataggcatgaagagtgcagcggcaccctggaagaggaagcgagtcaaggggtggtgtcggtagcgcggggcataggctccaatccccacaaccactcccatcaacatggcgttcaccattgacagagagttcactcgccatatctcccatttcgcccgcttctccagcaacctcacctcagcatcagtacagtttctgataagtgaacttgcgcggtccatcgtcgacctccaattccagaggtatgtgtgtgtgtgtgtctatatatatatatatatatatatatatatatatatgaagggtatgaatcaaccgatgaagagttagatttaattgacgaactagccggtttaaaaatagaaatgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttcaaaacagaataaataaactagaagtagaactagagaacctaaaaattaactataatattaaggcattaccagaaatataaggatattgatgaagcattaagccaagctagaaaaatattaggaataaattattatctagagcctgctgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacaattaaagaaggaattgaaggaagaaatacttaaagaattaaaacaagaaatggatcagaaatttgagcaaataaaaaaggcagtagatgagaaattagaagtttctttttctgatttggacacaatggatcttggtgaccatgggcaaccagatgaataaattgatataagctaaatatgtttttcaatatatattgataatagaatatcaacaatttgggcgtggaagaagaataaaagaataaaagaaattcagaaagaataaaagaaattcagaagactacccaagaaagaatccagaaggacaccctataaagtataaggggacaatatagggtgcggtgaatgacatatccctgtgaagaataaaactttcggtggaaaggcctcaactttagccagctctcatgaagatacagtagcgaagagataagcaggaggcacaggcgacgccatccctggcctctataaaaggagacgttggccttcactccggggacacacaaccacgaagacaccattcagagcaaagcttccaagcgcgctctcaccctccattccatctttcttagtagtagttcctctagcctaccttgcataatatatattgaagcaaggagttgtaatataaaggtttgtaaagtgagaaaaacttgtttgtatctaccttcggggttcccgaaagggaaaaccgtatgtaagcctatttgcttaatatgaagtaattttctttaagtttccctgtttgtttgctctagataagcgtttatgctagggaccctataggagaaacctctcggttgttctcgtttttagcctgcatcttgcataggcgtctggagaaccagtatccgtagagaagtgttcccctcgggtggaactgcctggggagacggtaaacgcttagctagttcaaatatgactagggatacctgaagatggttgcttaaataggcagataagtgaggcatacggctagtaccgagtaggactttaaaatttctaaatcaagcgccggctgttattggattcgccaccctgcaaagatcctaaaaatttaaagaaaattttcgagtgaacagtaacctgtgaacagtaattctgtactcataatagtgaattcagcactaagaatagtagtgaataataaagtggtatatatatatatatatatatagacacacacacagtggcgaatccaggatagacaaagagggtaggcttgacctccaagtactaagttaataaaaagtaaattgcagtacttacagtagctgttcaacacatacatgatacatgattgaatagaaaagaaagaaataaagaaaaataccttgccaatgcgaagtaattgcttacatcagtcatatgagaaatcagtgataaattgaaggaaaaataacattaactgaaagatttggcctaccattaatcaaaaaatacatgtaattcatttaagaggcaaggatattctatgggtttctaatgcttggaatatatttatgatgattgcatcatcgtcgtcatcatcatttttttttgaatatttctcgctcagtatagcagaccatcaaattcaaatctataagccacccatccgatatcttattgtgcacatctgtcttgaaatgctcgtgcttgaaaatatgcgctccactcaatcaatagattagtttgcagaaattgaatagaataatagaaataaccaatacagccaaataggcagcaaccagcaagaccatgattccatttattcaatgactcaccggacgctagtttatcctgctgctgttggctgctcctcgccgcgacgccgcctgacccgctgatcctgagcctgctgctctgctagtgctagcggctgctgtggtgctgctccgcgcgctgccacggcgcctgctgacgcttccccgcgcggccgctccgcctgcagcctgccggcttccgcgccccgctcgcgcctgcggccgcctacgcttgctcttactcgccaccggacagctagctacgacgctgcagcctgcagctcgaggcctcgagctcttgcgagttgcgactcgcgtcggccgtcggcgtcggccgctcccagtcgccaccagccgccagcccccaccccaaacgcccccaaccctaagtccccacctgacctgtgtgagtgtgtaagtgtgggaagtgggccactggactgggccattactatcgaattgggccaacctagtttatctgcataccgcttcgcttcttctctctcatgtgccctgttcatcttcttcccagcgccgagcacatatcgccatgaactccaggactccggctgatgcttgaggatacctagttgatttttttttgcaaaaattagagggtaggctagaacctaatggagcctacctgctagaatcgccactgtatatatatatatatatggtactcttaattaatgggagtatctagctagagacattaatttttgtaaacaaaatttcaaatataactatagtacaattattctaactacatatattccagttaattataatgtaacttgtatataagtaacttatagtcatgaaacacaagcgcgcgtagtgtgcgcagctggctaccatcgggatcgagttcgaatcccaggtccacaaattgattgtagtttttgttaggttttcgtgtgtctatccggcctacgtaccctgtattcctctgcattttccatggtgccactcacagacataatgcatattgaggctagctagctagagggtagggatctatttatagaatcttcttccagatatacactatatctatttccggtgggagatttgcaataatgatactgtaaacattaatctttgctataatgacactggacccacatttcatagatacagataggcctatttgccatccactcggagtatcaaaacagcgaagccccaatgtttgcagtctcaatattgcaattttcttcggtacaccgttaaactcccaaccacaataagacagttcagttaaatgagtctacaatataatagtcccgagcacaaatgtgtgagtcatgtgccatgatcatattgtatatgagattaattccaatataatcatgtgggtcaatggcttatagagcagatcatgtaaacaaaccctgctattccaccttctgctatacccaggtataaatatgtatgtacatataaattctatagtatatctctattattcatctactgtatttcagcacagtcgttcttggcacctctagtattaattcctcgagttaaattccacatcaatatataattcctcatcacatgcagcacaaatgttttccacattgagttaaataaataccataatatataaatgttgtaagccatataaaagtccaacagttttaactaagagggaaattaaaaaaaacttgcttcctcgaaaaaaaataaaaaaaaaacttgggcaagaaatctagctagcaattccgatcttaattatttgggcaaaagtactatatatatatgtaccaagctcgtgtgcatgcacatcatcacaacatgcaacaattaattaaaaactaacaggtgtgtgtaagtatgtaaaaggtagctggaaccggatcctttaacgtaattcattctacgtcagagggacgttcaaccacggatcgtcgttccttgcgcatccgacggcaaccaccgtttcagtccgtcctcgcctcagaccccacaagtgcgatgtctctgcttgctctctggcccattcgttgatagcggcagcggcgccgcgccggccggccacccggaagctcaggcaagccgtgcgctgccgccggcggggaggtcggactggaacgcagtgctaccgccgtccgccggcgaggtcgagggcgaggactctgcaccgcctcggtgtctgctgttggtcccatcgcccagcaactgctgtttctcggaaccatcgccggcgaggttggattggaatcgatccgtagtctatcgaacttgcatcatcaggttgccttttctcatggaagaggcagctagttgaaattcttgctaaggcattcgtgctgtcattggcttgtcccagaaactaccaagtaacctgaagaattaaaatcagagctgaaaccagaactttgccaacagattcatatagaatgcggcatagcaagtctgcaattgcaataaaaaattaccaaaaaagatggtaaaagatggtttttctccttgaagaagagatcaatcgagtgcagatgttaaccaaggaaagaaatctcatggcacgaaccgaagagaagatgagtaatttttctgttctttttgttccccgtgtagctcaccaaggacggttccgagaaacaccgacagcaaacaccgaggcggtgcggagtcctcgccctcgacctcgccggcggacggcggtagcactgtgttccagtccgtcctccccgctggcggcagcacacggctgcctgagcttccgggtggccgaccggcgcggcgccgctgcccctatcaacgaatgggccggagagcaagcagagacatcgcgcttgtggggtctgaggcggggacggactgaaacggtggttgccgtcgaatgcgcaaggaacgacgatccgtggttgaacgtccctctgacgtagaatgaattacgttggaggatccggttccaaggtagctagctagctggtataaaaacaggtctgtaagagtattgagaaatcttacattcctttgagtctcaagtatctcgaggtatttagattttacattaaaatttctactatcttaaggtacttagcatatgatgatattaaaattttatattaaaaaatgtggtatctcccactaccttactctaaggatggtaaaaaaaactgacgccaaactaactaattaaaggaagatgcgtgcatgcaagcttcttaataattattattttttaaaacaagctagaaagaaaagtaatagctagaaatgagagagatcaattacctggtactccctccgttccaaaaaaaggcaaaccctgggtttgcgtgtccaactttgactatccgtcttatatgaaatttttttataattcgtatttttattgttgttaaatgataaaacatgattaatattttatgtgtggcttgtctttttaatttttttcataatttttttaaataagacggacggtcaaatattggacacggaaaccaggtttgtttttttttttgggacggagggagtatatttttatacgatcgaacggatgactgacggcctgatcaaatcgccagctggcccgcagctagaatgaatatataggatcaactaaataattactccgtatcagatagctagcagtagtgcagagcaggtcgctggatatcgtgttaatttgtattatgcgatcgagacaggacaaggattatatatactactccaaggctgtgtttagttcaagcgaaagtttagattttggttaaaattagagatgatgtgactgaaaagttgtgtgtatatgacaggttgatgtgatgaaaaaagtagaaagtttggatgtaaactttggatctaaacacactccaaatgtactactatttacaaattaagatggccccggccccatgaccccatctcatgcatatgcaaatatgccttttgtctttttctttttcttttccttttcctcgtgcttgtcgctcaagagtgttcttctttctcggaaaactatagctacgctacgtactcccccaattcccaattaatcaccatgcatatataattcttttagttatacgtaaataatcatcgtattagttttccttcactaaatctgctcgctatgtgtgcatggacgaagtaaatgtattgatgcatgcatccatgcatatgcatacaaccatttacaacaaacatgcaatatcttttatggtttggtagtggctaggaagtattagggcaagttttatagtggagatgatagtcacccttaatttagttcacatcatcaactcattaattataagaggcaatatatataacaaattacctctagcacacttgccccggtacatcatatattaattttactttatttgtttcctatcaattcattggtctcttgttcttatatctctagaagtttgtggagagattgcctcttgcataagatgtggctccttctctctccttgcatatctcaaccacctcattatgtgagtttatatggcatctagaaataaatgtgtagaggtttatagtacttgcccttagaggatttatatggcatctagaaataaatgtgtagaggtttatagtacttgcccttagaggatggtacatgtattcagttctgttaccaaattaaatgtaatatgggagagctactgatttttcttggttttgtatacattcctataatatgataatcaattggcaatggaaggagtaatatatgggtaaggtgttttagtgatttattaaattgcatggctctgcttttgtcttgcattgccacaccttttcctttttatttcctctgacacttccctcttttcttaaagagatttggatcgaatatattggatcgcttgcattgcgtatgcgtactcgatctctccttttcattttgggaacatggttctttgcttccgatcatgctgatctatcatgcatattgttgcatactcccttcgtctcataaaaaaataaatgctataaatgaatctggacataatgtatctctagattcatccatttgattttttatgagatggagagagtatattgcacaagaaggaaagaaatgctcttgccagctgcagcagctgacaaataaaggccggccgggcccctattgtctcagaggttaaagacggaaggatgtgctataaggggatcaaagtactctgtctaattctgatccgatcggattttgtttggatgggctgggatcagcagagatcttgggccaattaatccacttgtaaaataaggcccagcttggcttcatgatcactcttcctgtacgttccatgagaattttgtaggaacaaatttttgaattcaaataaaaggattcaaaaaagaaatccaaaattaaggtgtgatttgctgtgcagtcgatcacaccatcgccagagccccgcagctaatggatacaccaagggggtcgacagggggagcttagagatgtgcactaaccatcaacactatcgtcgtatttgctgattgcaagaccgtacgtgctctccggccggccactcgagctcgaccagaccgggtgcccctaacgagcgaccagtccgctcctactagctacctgctgctactgatgctgctgctgctactactactgcttctgctgacatgcgctactactactacaacagtactactacatgtatatatacgtatatatatactttatatacatacctatagtttatatatgtgtatacaaaatatatgcatatgtatatataatttttatgtgtaccagaaaattggcgtataaaaaaatatacatgtatacaaactttgcatacgcgtatataggggtgaaaacggtacggaatatttccggattccgggtaagttttcgaaaacggaattggccagtcgaaatttttcggaaacggaaacgaatacgaaaatattttttcggaaacggaatcgaaaatggtaagagcaatttccgtcggaactcgaaatcgatcggaaactttctgaaaactttctcggaatttccgaagttacaaagtccataatacctcccacttgcccagcccaacccactactggctggccagtggccactaaccagctaaccctagttgacgagagtgagaaccagaggcagtgcatcgcacgcaccacgcaggcacaccgcacgcaaccagacctggcgctgtcggccgccgccgtctcgcgccgtcctccccccgccgtcgctcgccgtccctgcccccggcgtctcgcccctctctgtgcttcaccgtcgccgtccccgccgcctctcgccatccacgccgccgacgtcgatgcccactggtgactcttcctcaccgccaccaacgccgacaacgcctcgccgccccgctgcccgggcatcatccccctgcgtcgccgcccatcccctctctacctggttgggaagcacaagagaaaaaagaagcggagaaagaaaagatatagggagagatagaaaagagatgaggaggaaagagagaaagaaaagaaaagaagataaaataaaaagagagtgggacccacgcctctccctcagcccttgactcaacgttgaccggcttacagtcgggccccattaaaatatttcatttgatatgattgtgttttgtaatgtattgttgattgttaaaacttgagaattgtacctgacaaagtttgaagcttagcttgagggacttttgtattctgataaattttcgttaccgtattcgcgccggttcattttcgctccgttttttgtttcgataatattcgattctgttttcgtatccggagtttttgattccgattctaattctgaaaaaaatatgaaaacaaaaaggtaaagattgtttccgtccgttttcgtaccgttttcacccctacgcatatataaactttacatatgtacatattaaaaaccgagagaaaaaaatataaatacaaactttctatacgtacaaatacaaaacttggtatacatacgaatataaactttgcatacgtacatcttaaaaagaaaaaaaaagaagagaaaccgaaaaaaaccaaaatagaaagagaaaaccgaataaaaaacccggaaaacccctccgcgtgggtaccgtccgccgcccccctctgcgcgcgacacgtgttcaatcacgcgggagggcgcgcgtgactggtcaccgattagctttttgtgacaagaccagccacttcaccgctagctagcgctggctggtggaaaggagattgcggctgcaggctgacaccgcaagtcgccgagacgcacactcgcgataaatacggacgcatcaatccagttcaggaggataagggcaaatccgtcctttagtttctctttattatttggcagaaagcaaatgaaaaacatattaaaaaaattatagaaacggaaggcaactaaaacttttgatggtatatttataaacttgtaaactttcggcgacaccaaactaatttttttatataatatattatagatgtcggtttttaatctagccgacccaagccagagggtgtgggagggagatattccagtgaggagaggagcgtgcct

SEQ ID NO: 25841 - DNA, 9690 bp, Oryza sativa
aattccatgaacactttgttcataagattcatgaagaatgcgggtgcgttggtaagtccgaaagacatacccgtgcactcatacagcccgtacggagtggtgaaggtcgtctttggaatatcctcttcccgaattcttagctagtggtagcctgatcgcaggtctatcttagaaaacaccttagctcccttcagttgatcgaacaagtcatcgatccgtggtaaaggatatttattcttgattgtgacctcgttgagtgcgcgataatcgacgcacatcctcttcgtcttatcctttttctccacaaaaatgactggagcaccccaaggtgaagtactcgttcgaatgcaccatttctgcagttgctcatcaacctgcttcttgacctctgccagttcattggctgccatcctctacggtctcttgtagattggagtggttcccggtgccaaatcaatccagaattcaatctctctcttgggtggcatggtagtgaggtcttcgggaaacacttttgggtactcgccggctatggggatttcatccaatttcctcgaattcttctccacagtgaccactgggatttccgcctcaatctaattcaaggagaccccttgctttggtgagactagagatttgaacactacggtttctcccttctcgttggtcaaggcgactgtgcgattcgcacaatcaatgactcccttgaacttggtcagtcaatccatcccaagaatgacatctaggtctttggagttaagaagaatgaggttggctagaaatggtgatatttgaatttctattagcactgaagggctaaaattgaccgaggttgaactatttcccggggtatgaaccctcattggtgtactaagctcttctttccttaacccattcatccccacaaacttctttgaaatgaacgaatgcgttgcaccagaatcaaaaagtactgttgcagggattgagttaacaggaaacgtacccagtacgacctctggtgctgcttgcgcctcctctgcagacgcgtggttgacacgagcctggacgaaccttggcccggcacgcctaggctttgggcatttgtcggcgaagtgaccaagctcaccacagttgaagcaggaccctggctttgttctggtctccttcttggcttgcgcgggcggagctgactgtgctggtgccactagtgggcgtggagctacaccgcggtggggctgacctccatggtggttctgactaccactggcgccctggtgaaagttgcttgagttgaacgggcggtgctggcggacgatcatggtggtaggtccaccctgctgtccgggagtgaagcgcggtcgctgatggtttccttggctggaccgaaactgtgccgcctttctcttcctgtccattttgttgcgctgatcctcctgacggattgccttgtcaaccagcctttcaaagtcggcgtagtctccagatatcaactggttggttagctcatcatccagacctgctaggaatttctcctgcttctaggcgtcagtgcggacatcctccggtgcatatcgcgcgaggcgattgaactcatggagatactctgtcactgtcctgttgctctgatggagtgcccggaattccctcttcttttgtgccacgaccccgtctggcacctgcgccttcctgaagctgcgacagaactttgcccaagtgacttccgtgcctggcggacgtgtggccatgtggttgtcccaccgagctgacgcgggaccttggagctggtgtgtggcgaaagcgaccttctcctgatcattgcactgcaggagattcagcttcttctctatggcatggacccagtcatttgcctccatggggttggtggtgctggagaaagtgggtggcctgacacgtagaaattctggcagtttggattgagggggagggggaccaaactgctggtgatgctgttcggcgtgctgttgcatcctctggtgcatctgttggtgctgctgctgcatctgttgcatcatggctgccatcatctgagtctgatgtgccatcacttgggccagcgtcggattctcgggaagtggtggcggactattgtcggaatcactgttggggtgcacaccatcagtgcgctcttcgccgttgctgccctcgcctgttgtgcgggtgccattcctggtgtagaccatctagaggaagagcagacggggaaacggagaaaaacagatactcaggaactaagctttattatatagaaatttaaactgcaattgttctgatctgaattaaaacacttaaacagcaagcaaccatccttattaagacagccatatcataggcacatgatatcgaccgtcgactgaccccaagcgaacagacctacacacacaaactagcagacagaaactaagcagtcgataaactaagggaaatcgagcctaatgctcggaacggctcctgcggtcggtggagtcgaaggcgtcctcctgctcgtcaccaggtccctctgagcgactcctggagcctggcagatatgtctcgccgctgcccggctctgagccactggaactgctgctgctgcggtcgcggctgccactgggagtagctggcaaccaacccccattgccactggcggggcccctgacggctgatgcaggcgcgaaggagagagcggatgccggagctgacacgggaacaggagctggagctgctggagctgcgggtggagctggaggagctgcgggagctgctgacggaggtgggtacctgggcgcaagctggatgcgcatgggtgccgttgtcgacttgcggggcgtagtgcggatccggactcctcttggcgtgggtagcccctttaactgagcattctccctcttcaggcgcgctatctcgtccttcagtgcgatgatcctcacgagcttcccatcattcaaggccttggacgccttgtgcaggtccgagtgcatcctgtccatccccctcatcacagcgcacatgtgaacaaaggtggtgtcgttcttgccggctgtcggacggaaagaactgacatcgctgccgctggctcgacgagggtggatgcggtacgccgtgtcgtggaagatgtagttgtggcgctcccgtactctggccatcatcaggtatgctgcctcctgacatgcgtgatctgctgtgcctccagacgcctcaaccaccatgttagcgaggcaagtacccacatagccatggacctccaggcggacacggtgaggaagctcgccactgagcggtggaacagttgtgtactctggcgcgttggggtagcccaccaccagtgtcatgcgtgccaattctgccacgaaatcatccatgccttctccgcggtggttgggtgggtgctcggccatctagagaagacaaaggagtaggatcaatgcatgctcaaatccaaattaaataaagcaataaaggactcaaataagagaatcgaataagagcgaaattttatgcagagatcattttgcatgagagcgaataaataagacagacttacatcgcgataaagtaatgaggaaattagatacatactaataataactataaaagcataaataccttacaacccatattcctgagctaggacctaatgcacttcccccatcaaatcccaactgactgtcgaaaatgtctcaaatatttttactaaaaccctagactgacttgttttgacaaatcttactcaaacgagcgaccaagattttttcccttgaaccacaagaacagatcccgaattttcccggaacaaattcaattgcaaagaacttatgcaatgaaaaggattcagagggctcctaagtttccatttggcttgtcctacggtcaaggtcggctctgataccaacttgtcacgcctagaaattcccgaatagaattccaagcagaatgtgcattaaaaccccagtccaggaccggccggggtacacaaacaacaatgttgacatacagatccacgtcttacaaacattataaaagtcttacataaatgcaacggaaaaacgaaagataacaggagctaagccttgacttgaactgcagcgggaacaccactccacaggcatcctcgacggcacggacgaagcctactcctcggagaacccgccatcggacacatactcaaactctggggttggggggaaatagagcaagactgagtactatccactgtactcagcaagtcataccggaatagaggtatgatgcagggatttaacaagggatagctatacatgttcatttgcataatactggcatttataaacagaagttggatgcgaaaaactgttgtaataatttaaccaatattaatcatccactgtccaacgctaccccacgttgcaacaggcccaaccatccacctgtactatccaatttcattagactaaactaggataagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggaccgttcgcataaccccctctagccaagcacaccacacctcaggtttcacccccgtccccagcgggcgacgggcagtcccctctcgtgcctaggtgaatccggaagacgcattggccgtcgcagggcccatccaaactccatcacgcccacccttgcctggatgcgtcaactagagaaaagctacactacaagcccagccgttgcccacgctggcttgtggtaagcacgataaattcttccagggtttcccgtgaaccggtccttaattgccatgggtgcgactagcaaaaccatgcacccacagcccaccatgtgattcattttaattaaccaataccaaaacggtggtactaaaccaacattaccatttgaacctaaagtctatattttaaagagatttccccattgtgtgctagttgaactaagcatggctaagcaatacctagtccaaagtctattcatgttaggacccaagctaacaaaggagcatggtaccaaaatagcatggctgtaacaataggtaaacatcccatagtattattgcaaaacaaatgcaatatttgaaagaaaacattaggacatttgcaatataggatcaacatgatcaagtgacaggcatgacttgccttgctctgctgctggaggaacctcggcgactatctcgaagtacaccggagcgtcggaagagccggaatctaacgacatacaaggcaaacaatgcaaacaggctataagactactgaaacagagaacaaaaccatttttaatggattctacatatttttcttgatttactgagacttgaatgggcttaaatggagctcggatgaattagatatgaattttagaagattcactgtgtttatttctataacaaaaagtccttaaataatttattgcgcaataaatcccagggctgacgtcatcaagggggggcggcgccgacaggcggggaccgcatgtcagtggcgcaaggggagagaggggcgccggcaagtggggcccccgggtcagcggcactaggcggccggtccaccgtggaccgggaccacgtgggtggtccaccgccggtccacgggaccgacggcccagatcgacccggggccgatcggacgggcggcggcggcctcgttcggctcggctcggcacaaggccggccgaccggccacggcaagggcggcggcgcgcgcgcgcacgcgttgccggcgacggcaaccggcggcggaggcggcggcgcaaaggcggcgcgaaggcggcggcgctaaagcggcggctaggaaggagagggaggggaatagaggggaggggatgcctcaccgagggtggccggcgcggaggaagacgacgtcgaacggcgacggcgagccacgggaggacgacggcaaccggcggacgagcttcgggatgccctaaggaaggaagagagatagattagagggagggagatgaaccacggcggccggaatccatggccgaaggcggcggtaggggtagagctcaccggagtgcgaggggatgcgggttccggcgacggacctcgacggaggaggggcggacggggtggagttcggcctcgcgaacccgtcggcggcgacggtgcggtgtggcgacgaccctaacggcggctagcggcggccggagcaacggctaaggcggcggcgggcggaagcatggcgagggagcgatggggagcacgagggagttcggcgagatgggaaaaaagagagagggggtgacggtggagcttaaataggggaggggaatcccggacgtggccggtaggggcgggatttcgccagccaatgtggggagtgggggaggagagagaggcgggattcgaaaatcgaatcccggccatctcgcgcgcgggcgcgggcgagagaaagggggagtgtgcgcggaaggtgcggcgcatgcgcgggcgtggccgacgtggcccggagaggcgaaggcgtgggcgcggcggcggttgccggcgcggcggcgcgggcgcgaggtgggagacgggtccgacaggtgggccccacctgtcagcgaccccgggtgagaggagggaggcggccggcccgcgcggcttagctgggccttggccttcggccggcccagcgggaggggaggggaggaaggagaatgggccggcggcccattcaaaagaaaagagaaaggaaaataaggaaaaggaaaaagaattttccagggattaaatattgcttatgctccattttaattggttaaatttatttctagggctctgaaaattccactaaaaatcttgttagcgaatttcgacatgtagaactcaagaaaaattccacatgccagtttcgattattatttgcattaatttattagggttttctcttgatttgcaccggcattttcttagggtcatttataaattcaattttaggcttgggaggagaacttcagggtgtgacaaacctaccccccttaaacggaatctcggccccgagattcggaggagttggcgaagaggtgcggatgggcgactttcaactcatcttcccttttccaagttgcttcctcctctgaatggtgactccactgaacacggcagaacctggtgaccttgtttctagttcttctttcactggtcttaagaatgcgaattggcttctccacgtaggtcagatcctcctggatatcgatgtgctccgaattggcctgttcttcaggtaccctcaaacacttctttaattgggatacgtggaacacatcatggatgccgatcatattggaaggaagctctagctgataagcaacttctccccttcgttccaagattttgtagggtcccacgaagcgtggtgccaacttgcctttggtttgaaaacggtgcactccccggagcggagtaacacgaagatacacgtaatcccctgcttcaaaagtgagctcccttcggcggttatccgcgtagctcttctgtcgagactgggcaattctcaacctttccctgatggttatgactttctcttctgcctccgctaacacctctgttccaaacagttgacgctcgcctgtctgatcccagaagagaggtgtgcgacacttccggccatataaagcttcaaacggtgccatctgtagactggcttggtagctgttgttgtacgagaattccgcatatggcaagcttttgtcccaagctccaccaaagtcaagagcgcaagctctcaacatatcttccaaaatttgactgactcgctcggtctgaccatctgtctacggatggttggcggtactgaaatttaaacgggtccccaattcttcctgcagtttctgccaaaattttgaggtgaactgactccctcgatcagatacaatcttcttgggtaccccatgcaaacacatgatccttgccaggtacaactctgccaatttctttcccgtataggtggtatgcactggtatgaagtgagctaccttagtgagtcggtccacgactacccagattgaatcgtgacccgatgatgtccggggcagtcttgttataaaatccattccaatttcctcccatttccattccgggattttaagaggttggagtaagcctgctggcctttggtgctctgccttcactcgctggcaaacatcgcagagtgcgacaaattcaactatttctcttctcatgctgacccaccaaagcttttctttgaggtcttggtacattttggtgctgcctgggtgaatggaatactgtgtctgatgagcctcggtgagtatcatatccttcagttctttgtcgtcaggtacgcacaatctttcccccatccagattgtgccatgctcatcctcaaggaaatctcgagcttttccgactctcatgttctttttcagttctgctatttcaggatcatttacttgagcggctctaacttgatcgacgagcgtaggccgtgtttctagagcggctacgaacccctgttcaacaattcccacgttgagacgctcaaacaactgctgcaattcctcacacatgccctcgatgcatagggcagtgcagtaacttttcctgcttaatgcatctgccaccacattggctttccctgggtggtagtgaatgctcatgtcatagtctttgattagttccaatcatcttcgttgtcggagatttagatccggttgggtgaagatgtattttagactcttgtgatccgtatatacttcacaacggttgccaatcaggtagtgcctctagatattcaaagcatgaaccactgctgccaattgcagatcatgagttgggtaattcccttcatgtggacgcaactgtcgcgaggcatacgcaaccactctgccttcctgcattaaaacacatccaagcccgtggcgggatgcgtcgcaatagacttggaagtctttcatctggtcgggcagaatcaaaactggtgcggatactaatttctttttgagctcctcaaaactcttatcgcactcagctgtccatttaaacttctcatctttcttaagtaactgagtcatgggtcgggcgatcctggagaagttttcgatgaatcggcggtaataacccgcaagtccaagaaaactccgaatctgcgacacggtcttcggtggggtccatttggtaactgactccacattagatggatcaactgctacgccctgagctgtaataacatggcccagaaatttgacttccgtcaaccagaagtcacacttgctaaacttggcgtataactcgtgctccttcaacttctcgagtaccaaacggagatgctgctcatgttcttcttcggactttgaatagataagtatgtcgtcgatgaaaaccacaacaaacttgtcgagaaattccatgaacactttgttcatcagattcatgaagaatgcgggtgcgttggtaagtccgaaagacataaccgtgcactcatacagcccgtaccgagtggtgaaggtcgtctttggaatatcctcttcccgaattcttagctagtggtagcctgatcgcaggtctatcttagaaaacaccttagctcccttcagttgatcgaacaagtcatcgatccgtggtaaaggatatttattcttgattgtgacctcggtgagtgcgcgata

SEQ ID NO: 25842 - DNA, 4800 bp, Oryza sativa
  unsure (1)..(4800): unsure at all n locations
tgggccttggccttcggccggcccagcggaaggggagggaaggaagaagaatggcccgncggcccattcaaaagaaaagagaaaggaaaagaaggaaaaggaaaaagaattttccagggattaaatattgcttatgctccattttaattggttaaatttatttctagggctctgaaaattccactaaaaatcttgttagcgaatttcgacatgtagaactcaagaaaaatccacatgccagtttcgattattatttgcattaatttattagggttttctcttgatttgcaccggcattttcttagggtcatttataaattcaattttaggcttgggaggagaacttcagggtgtgacacccagtatctctctcccccttcatccttttccatccgccgtccctccccccccccctctgtccgccacccctcctagtccctctctttccaccgccgcccctcctcctcctctctccagctgcatcctctcctcctcgacactttctcaccacttccgagctgtctctctctctataaccgtgctggatgttaggggccaccagattcaggctccttgaggtcggggctcaccggatccagccgccgggcagcgacgcagctaatgtttcagctttttatttttcacgatttttattttttttcggatttttgtttttgcgtgcggtcaacataagcacccgcatactaaaatccgattttcgcgcgcggtgcgtcacccgcacggtaaaattggatttttcgcaacccttccgggcagacaggccagagatccacacgcaaaaactacttttgatccatctggaacaattgttttttactagtgagtggccttattttggtaccgattgagaaaccggtacctataagggattctcaattggtacatatggagtgttatgtagtagcagtgattagtatgtgttaaaaattttcttactgatatcattttcactttcaccccaaggctagcactacgcagtaccactgtgccggttgaccaagttctacgaccaggtcaagtcgacaacgacacagcgcccactaattatctctgtccattctacagataatgatcgtggtgtgtctaccttcaccgttccctgcccaccaaggcaaaaaattctccaatccaataaattctccacagacaaagacagtgatgacaccacatgcagatttgcaactagctaggccatcatctctgcactctctaaagctttgtctgatgacggatcatcattcaattcgtagctccgatccatcgtcttcttcccggcgacgacccagccatgaacaacacaatgtccttgctgcttctacttcttggcctcagcatccttgcaatgaattctaccgctgctaccaccgataatggccagttcatctacaccgggttcgccggcgccaacctcaccctcgacggcgtagccacggtcactccggcaggcctcctccagctcaccaatggcaccagcgcgctcaaagcccacgcgttccaccctgatcctttgcacttccgcgaccttccggtcgccggtggtggtggcagcggcaatggcaatggcaacgatgtgcactccttctccgtctccttcgtcttcgccatcctctccatctaccccaacctgagctcccatggcatggccttcttcgtctccccgaccaagaacctctccgcagcagcgccgaggagctacctgggcctcttcagcaacaagactgatggcgatgtggccaaccacatcttcgtcgtcgagctcgacaccatccagaacaccgacttcatggacatcaacaacaaccatgtcggcgtcgacatcaacagcatccgctccgtgagatcctaccccactggctactacgacgatggcgacaacggtaacctcaagaacttgacattgaacagccatgagccgatgagaatctggatcgattacgaccaagaaaccacacggatcgacgtgactgttgctccgcttgagatatcaaaacccaaaaggccccttggctcagtgatctacaatctttctacagttttaactgattctgcatatggtggcttctcatcatcatcaggtgacattgactcacagtactatgtgctggctggagctttgccatcaatggagctgctccgcccatcgacataagcaagctgcccagcttcccagagaaggcccaaagagttcatcaaaagtaatgnagatcaccctgccgatagccactgcgatgttcgttcttgttattggcgtgatcgttcttcacttgttgcgaaggcagttgagatatgctgagctgcgggaagattgggaggtcgagtttggtccacatagattctcttacaaggatttgttcgatgcgacgcaaggtttcaagaacaagtacctacttggttcaggggggtttgggagtgtgtatagaggagtgctaaaatcttcaagatagaggttgcagtgaaaaggatatctcatgaatcaaggcagggtatcaaggagttcattgcagaggttgttagcattggccgtcttaggcatcgtaacctagtgcaactacttggatactgtcggcgaaaaggcaaacttcttttggtttatgaatacatgccgaatggtagccttgacaagtatctgcatggacaagaagataaaaacaccttagattgggctcacaggttccatatcatcaagggaatagcattaggagtgctttaccttcatgaggagtgggatcaagtcgtcgtccaccgagatatcaaggcaagtaatgtgctccttgatagtgatatgaatggacggctaggagatttcggcctagcaaagttgtatgaccatggcgtcaacccacagactacacatgtcgtcggtaccatgggctacctagcacctgagctagcgcgcacaggtaaaacatcccctcttactgacgtatttgcatttggcgcgttccttctagaggtcacttgtggacgaagacccgtggagcataacaggcaagataaccgggtaatgctagttgaccgggtgctcgagcattggcacaaggggttactgacaaaggcggtagacgaaaggttacaaggcgagtttgacaccgacgaggcatgcttggtgctgaagctagggctgctatgctcacacccggtccctcaagcaaggcctagcatgaggcaagccatgcaatacctcgacggagacatgaagatgccggagctgataccggcaaacctaagcttcggcatgcaggccatgatgtccaatgaagggttcgattcgtacatgatgtcgtacccatcgtcatcgatggtgagccatggcacattcatgtcagactctcaggaggaaggtgatagctagctggcatgaaggggacggtatgtgatcgatggcgattgataatacccggtaaactactcaatttgctagctagaagtatatatgtacattacttatgtgatcatatatgctgttatttaaacatttttacatcagcgtgtgaatgaatgctgctcttttttttttttgtgcatacgaatacttgaagctgccagtgattgagaaatgagcatgccgtagcattgtagccagttggtacggaccgtattggagatttggaatagtggttgatgggctgaaagagctttcacagaaagcccatacacaagaagctctttgtttctgtctttgtggagagctgagtagaaccgaattcagatagctacaatagtttttccccttagaagggagtgtgatggatggataatttgttttttccatatatttgtaggtttaaattaatggattaactactataaagttgaatagttgctttgacaaaaaaaatatttaagaagattttatatagaaaattttgcacgaaacacactctgtttaacagcttgatgaacgtgcaagcggaaatccaaaaaccagaatcaaagcagtatagtgagtattcttcaccgtttgatttgcaatcaacgaatgcggaagagagaggtatacataagcgctatttttactgcggtctaagtattgttagagcaggtacaatagcagactataagttagctatagacatatttcaagaagatataataggagagaagagcagcgggctacaaatttgtagccagctgcagcacggactccaagatacttgtgtgtataacaggtgggaccaactatgaattgtgtagtatacgtttataggtactattgtatgaatcggctattaaattgactataaatgatttggagccggttgttggctatactattaaacttgctcttactacaaggtagttcaacactgtttagcgcatattattaatttgcggtattgcacatatacagtagttaccgctgacacgtggaatcggatccaccggacgtggaaccggatccaccgattttgccactatcacttcaggagtgtagtactatatagaatccgtgtccaacaacaatatagatggcacgtcactgtaagtaccaacaggtgccgtttgcaatacttgaggggactaaaatctggacgacacattgggcctgttcactttgatgacatttttaaccttaccaaactttggtaaagttgtcaaaaaaatggctacatttagtttgctgccaaatttttgtaactatataagaaatcctaccaattttggcaagttgtcaaaattttgacaactatgctaaatttttggcattgccaaaatttggtaaggttttttttttcatcaaagtgaacaggccatggactctccggtcagcaggctgtc

SEQ ID NO: 25843 - DNA, 4274 bp, Oryza sativa
caccagataggtggtaaaaagctactagtttttcctccgatcatgtccctctatttctcaatgcttcaaccactatccctcgctcccagcttttccgtttcgagaatcacctccttcttaaccctaattttctgccgtcggttctttctaactgggatcagcccaccaaccttgctgacccagctgctcgcgtggctttcaaagctgaagcatacccgcaccacaattaaaggctggatgcaggctaacaggaaaagaggaattttatgcgaggattgcaagttcaccatcgactacttagattgcattgaagaattcaggcggctatctgaatggggaacggtgcctccgtcgtctggtgcaagacagattagttttggaggtgcaaggcaagctggcatactcgaaacaaagaggaaaggttaagcgtttaaaactgggactggataatacagctttcttcaaagctcatgctacaaaaaacttcaggaattctcgtataaagacaataaaacacgatggaatagaagttgccgaccactttggaaagtcccaacttatgttttccttctacagccggctcctgggatcatctttgcagccttcttgggagttcgatctacaacacctttactcagatgaagggagagattcaaacttgctggctgctcagggtctaccgttttcacaggaagagattcttcttgctcttcaggcaatgaattctaacagtgcgccagggccggatggtttcagtccaagcttctaccgtgcagcatggaacacaattaaagaggaggttcttcagtttagcaacaggcttcacaacttctggggcagacatagagcgaatcaacagagcctatattgttctaatccaaaagcccgggaaagaaaacacagtcgatggatataggccgatctctcttcagaactgctcagtaaagattctttccaaagtgcttgcaacacggctgcaaagggtattcctgaggatgatacatttagaccaaacgggtttcctcaaagggagatgcatctctgagaatcttatatatgcgacggaattgattcaagcatgctacagaaggaagtgccaaactattattgtaaagcttgatttcacgaaggcgtttgattccgtcatttggtcaagccttttcaagattcttgctgtccgaggtttcccagaaaactggattagctggattaaggggttgctttcctcctccaagtctgcagtgcttcttaatggagtccctggaagatggatttgctgcaagaagggccttctacaaggcgaccccctatcttcatatttggttatcttagttgctgatgtgttacaaagattgcttgaaagaaatactgaaatcagacatgcaatctaccaagacaggccatgtaccaccatccagtatgcggatgataccttgattatctatcgtgcggaggaggctgatgttcttgctctaaaggagactctgctacagttctccaaggcaactggactgcaaatcaattttgctaaaagcactatgattactctaaatgtcgatcaaagcaaggaactagttttgtcgggattgctacagtgcaagctggagaaatttctgatgtcttatcttggacttcccttatcaattcataaactgtctgcagcggacttgcagcctctggttaacaaggttgatggtttcttatctggttgggaagcatctctcctatcgcaggcggagcggcttgttctgataaacgcaatcctgagcagcctgccggtgtatgcaatgtctgctttcaaacttccaccaaaaattatagaagaaattgatagacgacggagggcttttctctggacaggggatgatgtctgctcgggagcaaaatgtctggttgcttgggaatcagtttgcaagccaaaagaacatggaggacttcgtattaagaacttaaagattcagaacgaggcaattcttctcaaatgactccttgccctctacaacttgaagacctcctggactcgatgggtctgggacgaaatttcagattcctcgttactgtcctcaactcgtctagggcatcactgggcatcctttcaaaagttgttgccagaactgcgatctttgacggaagtcgtggtaggaaatggtgagcgaacctccttttggtacaacaaatggttttcgactgaaagcttttcaagtcagttcagcaatctcttctcccacgtgtgtgacagacaaatctcagtaaaggaagcccttcacataggaatttctgaaaatcttgttccacgtttatctgaaactgcatcggcagagctgggctgcttacaggaattgctgcagaacttctctctgagcgatgagatggatttccgcctcagtgcaaagctaggaaagttgacaactaggaaattctatgaggcaagattaccccctggcttgccatctccaatctgggatcttatttggaaatgcagagcacctctaaaagttaaactcttcgcatggcttctggtccgtaatcgcctgtccacaaaagaaaatttgctgaagaaaaccattattcaggaggcaatctgtgacatctgcaatcaggaagacgaaatagctaatcatatgtgtttcttctgtccgttcgctcaggctttctggacgcagatcaacattcaaccgcaagctcaagacatcacgcagttccatcgtttgggtccaactatgcaagtgctggcgctacactggcaggtcttcttcctgctttgcatgtgggctatttggaatcatcgacacgatgttgttttccaggggaaaagcccctcactaagagcctgccttacaacgatgcatcaccgaggcagctctctgggcagagaacttaacggaagatgatcaatttgtaatctctgtttggaaacagatcttctcctcccccttacaatctatcaatcttttgtaatgaacttcttacctctaattgctactagtcgtagttgttacaaagattgcgaaggtcttccttcacttcattgcgcatagacgacagaatgaagagggccatacaatatgctgaaacagcacccgttatcaccatcctgttgaagcttctccgttcttcatatcgtttaaccaattcatcaaaaattctgtggtggatcgtattcaaaatatttgccccagtgccgccccgtaggagcttcagtcttgggagatgtcgtgccgcccagcttattatcctacaattccatcaaggaaaggaatatttaataataataataaactacgatgaatatataataataaactacgatggtaactagatatattttaagtgttaatttttatttttatttatttatgaaagaaagggacagttgcatccacgctctcactttgaaccccagctgttgttttactcttactttttaggatttgcaattgtatcccatctttttaaaaacgaacccaccgtttgccctcacttttaaccctgttagatgggtcccacggttttgggataaaaaacacaaatagaaatagaaaattcattttatgaaatattaaattactgttgtacccttagtgaatggataaggatccaagcacccattccttcacagagctcaggtcaacatcccaaaactctagaggaggcggcggcggttccagcatcggcgtgcgcagcgacggcggcggctccgttggaactcgtgtgcgacggccgcggctccagcggaacgcgcggcgacactgacgatggttccggcaagaagcgcggcgatggcggcgaaactaacgtgtgcgcggtgacggcggcggttccggcgggaggcgcggcgacggtggcactcaagtgtgagtcgacagcaagtcttcggcgtggcggcagctgcgtttcatctcccttgcgtggtgaggcagtcggcataaaagttggtgcaaaaatacaacaacaatcaagggtataaatgttcttttgctctaaaactaacaccgtcaaactaggcatcaaaagtgaggacaaaataattggtttgttttcaaaaagagagggaaaaaatacaaaccctacaaactgatggtaaaacagcagttgagattcaaagtgagagcatgaatgcaattgtcaataaaaaaaaccaccaactaatttaattgattggacccagttgttcttgtccgttcaccaactgttcctgccctatacactcctactactgcttacgacaattacgtgtccgtcacttctgttactgcttttattatatatatgtg

SEQ ID NO: 25844 - DNA, 9264 bp, Oryza sativa
ttttctgaaacacatatagataataaaagcaataacataagttaggggataaaccccattatgttgccagaagataacaaattaaagcaaagagccacccttttgaaaagggaggttaattggactaaagaagtagacttcctaatggaactgagcagcagaaaaggagcaagtcgatagggagctacggcaatgtcgcaacgactgctacctagagcctcataagacgtgcaaaccgcttgacaaaccggtaatccccatctcggctgcctccacagaaacagcacaggacagaggtgtgatgctgagccgtagatattggtgtgagcttcaccggacacagcaaaggatctccacggagctcgtcattgaatctgaggaactctaacaaaaaccctgttgaccgaaatcgcgcatgtggtccgagctcaacccgaatgacaaactcggcatggtttctgctaatcaggcacaaaagagaagactgaaccaaagaccaatcaaccttcatcatgcgagcgttgtagtggctgcaaagatcctcctgtcttgctgagacgacgaagttggctggggaagatgaagtctgcatcaagagtctacaagagtctggcaagagcatacacccatccaccggcggcttcagaactccaaacatggcctcctccacaagaccacccagcaccaggaccatcatcgatgaggtcaacgacaacaacaaccggcgcaggtgagactgatggaggggaaccaaaggaagaagccgaggaggagggaccaacgaaggacacgagaagccaccgcagccgacgcaagggacaaggcggcgacctcccagccgaggatgacgacgctgccgacgccgccaccaggagccagctccagccgacgatttgcccacagatcttcggatctcgcacctccactgccaccaaccatcaccacctccgaccactccggcacccatggagctagccggcaaaagcaccaactagagacaaaccctaacaataggaagaacctgacgacctaataacagacctaaccacacaatactagtaaggggaggtggccggacccctataaccctcgccggcggcaagccgccggaatcgaggaggaagaggggccggagagcaggagaaacggggagggctactgtagaaaggggaaaggggaaagaagactcgagaacgaaggggtattcattgcctccttctgtggccattccagtcaccaagatagaccggagtttttctgttctcatgatagacctaagtcttaaccaggggtggattcacaatgggggcagaggggtcttgagaccccactaccgccccgggacagtggagacccccctaagccccactaattttttttccatagatccataggatatagggactggaggtttgatttatgctgatgtagtttattcagcccccactactatatttttctagatccacccctggtcttaacggtcactcgcctgatctgatgactatggattaccagacaagtttgcgaggaaaatttgtgaagtgatggacgggtaattgtcgtaatcggcaggggtgtagggcaggaacaactggtgaactgattaatcatggattcatgggttggtatatatttattcaaaaaaaaaaggtgacatacattgaacgcaatgttgtcagtatcccgatccatatcatagtatcttaggatactatacaatcctaccaacccggaatgataccgatcacatcttgtatcctaatttccatagtatctcgattgtactattcattattacacgatcctacgaaatcttgggtaatatcctaattctacgatcctacaaaatattatttaaaataagatggtttgaaaataatgtaaataaatatgctcaagtttatataaaaatcagttaaatatatcaaaactaatgtggtttctcttaataaatgtctctatttgtatgatatatattattactatatttttttatatataatgactatatgtaattaatacatatattaattgaattttaaaaaaaattatagtatcccgatcctacgatacgatattactttgatcaaaacggataacctttattgaacggcgctgatagtgggtatgatatagattgatagactttgttgttgactgacttgggtcgacgaccattgacgaaggcagtccaatgaaacaaactcacatatagagaacagtcatgatgaataaacaactgatccaagtgcactagaaagttaagtttcaagatccagcaataacagaattaaggcaaggctgcagcaccaccatgcccagtctcgtcttgctcttgatgatgaatttcgtgatgatggtaattgccacctttcctgaattcacatacaacggattcagcggcgccaggaacctcctcctcgacggcgccgcttccgtgggagaagatgggatcctctccctgacgaatggcagcagcggcgcccagcagcaggggcgctgcttctatccctaccctattcccctgcagtacaccggtggtgagacccgctccttcacctccaccttcgtcttcgccgtcacatgctccggctccggcagctgcggggatgggatgacatttgtcatctcctcgaccgccgacttcccggccgcctcttcgccggcgtacctgggccttgccaacccgcacgatgcatcgtcaaaccctttcgtcgccatagagctcgacaccgtcgcagacccggacgcgacgaacggcaaccatgtcgccattgatttcaacagcctgacgtccaacttgtctagacctgcagggtacatctacgacgacgaaggagccgtcggcaactctagctttcaggcgctcaagctttccagcggcgacccgatgcaggcgtgggtgagctacgacgccggagcagcccggctcgacgtcacgcttgcgctcgtccccatgttcatgccctccgtgccgctactgtcttacaacgtcagcctctcgcgattgctgtcggcggccgacgattctcccatggcgaccaaagcatatttcggcttcaccgcttcgacgggtggtgatcccggtggcgctggcgccacccatcaagttcttggctggagctttagcaacggtggattgccactcgactactcgctgctgcccctgaaacgagctcatcagggtcaggattatagcagaagtagacgagccaacaggaagagcttcgtcacatggttgcctgcagctgcatcagtgctcgccgtgcttgcagccatggcagcgtgtcttgtgctccggtggtgctggaagaagaacgcccggagtcgggaaaactgggaagcagagctgggacctcgccgcttcgcttaccgagacctccgccgcgccaccgacgggttcaagcatctgctggggaagggtggctttggccgcgtctacggaggcgttctctccgcgtccggcatgcccatcgccgtcaagcgtgtctcgtctgagtccaggcatggtatgacgcaattcacggccgagatcatcattcctcggccgcctccgccaccgcaacctcgttcgcctcctcggctactgccgccacaaggaggagctgctgctggtctacgagcacatgcccaacggcagcctagataagtacttgcacgagcacacgtactccagcaactgcaggacgctgggttggcctcagaggcttcacgtcatcaagtgcgtcgcggcggggctgctctacctgcacgacgactgggagcaggtcatcgtccaccgcgacgtcaaggccagcaacgtgctcctcgacgccgacatgaacggccgcctgggcgacttcggcctcgcgcgggtgcacgaccacggcgccgacgcgcacaccacccacgtcgcgggcaccaggggctacctcgccccggagctcaccaggttcggcaaggccaccaaggccaccgacgtgttcgcgttcggcgccttcgtcctcgaggtggcgtgcgggcgccggccgatggggcacaacgcccgcggcgagctgctcgtgctcgtcgagtgggtgcgcaacgcgtgggcgccggccggcgccggctccgtcgtcgacaccatggacccgaggctggaggagtactccggcgaggaggcggagctggtgctcaagctcgggctgctctgctcgcacccgctccccgccgcgaggcccggtatgcgcctcgtcatgcagtacctcgacggcgacgtgccgctgccggagttctcgccggattatctctgcatcaaagacgtcgaccaggtccaagttggagactactctccctcggtggtcaccacgatcacaggtctgtccggaggaagatgacggccaatttaggcgccaccatgcctcatccttgaccacgctacatacttacatagtaggcaaaagtaatgcatggttcctaaaggtgagatggatgggtagctagtaagttttcttcttcgtttgtgttcaaatgttctttaaagttgttggatttcttacatgagatttgcttcggttcaacaaaaagtatcccgaggtacaggtatctcacgatatcaatcgtttccgatcattgaatctaacaatgcccatcctgtccaactaaatcaaacgatagaaaatgatttagtactgcgaggtaccggtactttttgttggactggagcaaatctcctaacccttacctctacggcggcggccacgacgcccccacggagggggtgcccgacccatactatgcctggagcggcggcggcgtcttacaagcatgtagaggcttgtgaatgataaagtgcttacacacatgtgcgtgcaacggatgaaggctattttaaacttattatttttatatggtttagttaagatgaaattcaccgtgggaattcgtttggatatatatatttttagaaaatcatgagctgcagtttctgtccaagcatctcaagttagcatgcgagtttttttaaacagatttcttatatgactccttttgtatttccaaaaacgaacgaacttaaaaatcgactcaaatatggacatgaatttccacaagcgatccttctgtatttgcaaaagcgaatgaacttaaaaaccgattcaaatacggatatgtattaacacaagcgaacgaacttaagaaccgactcatacacggatgatgtactaaagtactggtaaaaacatcttcaatttttataatagtagagatagagatatgttgtgtgtgcgcgcgcgtatgttgaataaacttgaagctgctgatctgcgagcaatcgcctttggttggttggttgattactgatgagcatgggtactgtagagtgctgatgagcttcaggaaagagctagagagcttaatatacagaaagcccaaacaaacaagacaaacaaagggatggcttacggagagcgctacaaatcgaacgtccgatgaaaggcgaaacatcggacaagttccagcacatgcaaaaaaatgtttcatatgttcataattcgatgagaaaatgtttcgacgagaattgttttagcatgttccatgacttgatcaagaatgtttaattgctctatcgaaaaatgttttaatcacatgcaacattcaagaacacttgttgcaacacacaaaaccagaatattgcaacatcaagaaattattgtaccaatttatgcaacatccaaaagagactgatcgcaacatcaagtaaatattgtgcgcaacatcaaaagaatatggcgtgcaacattcttgcccaactagtcgggcacaccagtctcacctttgtcagcaccagcatctgcttcttcacctgctctgacggagatggtggttgcaagaagctcccaagctgaagccatattcgtgcctctctccccatctctatggtggcctcgccccggatctgtcgatctgatactcgaggtcagggatggctagatctagccggaggaacacccatgttgggagagctgagggtgggagaggaggaagagtacacgagttgaaaaggagaagaacaggaaggcttcctaggagccaagaggtatgcggtggcggcgtctcgacgactgacgatggtggcgtgtggcgagagagagggacggagcgagagagaagaatcggggaattgaagaaggggcagttacaacgaggaggaggagttgtggacttgtggtgcgagaagtggagaaacgtgtggagcgtccgatttttgtggtggtatcgaacgaccgagttaaagcgtttttgatggcttacgcatagtaccaatgggctgcaagatcgaacttgatttacagtccaaacaaaacaaaaaaaaaaggccgtaatttacagcccaaacaagcaaaagaaagaattggtgacggactcggagaaccgaacgtacccgtatacacgcaacgtataaacgtacgtacggtctcgtcgatcgatcggtagatcggcatggctatggcggcgctgcgctctctgtccctgtctctggccaggacgacgacgacgacgactctccgccggcggccaccgccgcgttctctccaccaccaggttcgtttcttttcttctcttcgttcaattctctccctccgatccggccatatatattctcaatccgccatgtctgatatatatgtgttcttgatctcttgttcaatccgtcgtggaactgtatctgtaattctgaatgtataggataataagctcatgatgagcagctggagtacttctcgcaacactactggttgtaagggttgccaagatcgggatcggcttatcgatgaactggaacaagaacggaggcggtttgcgaggatgacgacggtaatcatatatatttatattttactagaaaaaatgcccgtgtgttgcaatgggtaaagacgtttttcactgatatattaagagctgagcaataagttgaaatattaggatcgctatatacattataattgaaaaagttaatgagaattttaacattgggatcacgttaatgagaattttaacattgggatcactatagattataataaaaaaaagttaatgaaaatctttcctgggttgggtcgatagacttccttccttttcagccctaggccagtccgctacctccctttgtttggcctgcttcccttcgacccagccacaagtggagccgaagcacagctcgcacagtctactaccatcttcagccagtctactacctccctccgtttggcctgcttcccttcgacccagccacaagtggagccgtaagcgcaaatctgccacaagtggagctgtagtgtagctcacatagtctactaccatcatcaacctcccgaagatagtcaagtggccgttcggttgccagagcaaatctccccattaaatctgggccgtacggttgccaaagcaaatcagcccataaaatctagtcgaatttttctcgatcacattatggttgagggtttttgatcattcgatcttctctttctgttttttttccaaaatcagagtgtaaaactatttgttcccatcaaatccggtcaaatctttctcgatcatccaaaattggttgagggtttctaatccactcctctttccttttttttccaaaattagtgtaaaactcggaataaaaacgaccatggaagatcgccgtcatcatctgcaactgttaaacggagattaaatccaccgaatcgaaaaggaaaataacggagaaaatgatgagggaggagtggggagtcgatttttgcaatcaaattggaggagaaaacgcacaatcgatatggcggcggcgcagcgctagggttcaaacataagaggtgtgcggcgaatagatcggattaaaaagccagatgaaaaaaccaaaagcgcataggagaaaaaaccgacgacaaaaaaaaattacggaaaaaaccaaaagcgccagggaggcgcgatcttctttttttacctatttgagtcggacttttttctttcctcttttaacatacagcggaaatttaagtagtagagataacataaaattaaaaaatcgactcaaacacggatgacgtaccaaaataccggtttagtacttcatctgtatttctactattataaattattattatctctactattataaaaattgaaaacgtttccgccagaattttagtacttcatccgtatttgaatcgattttaattctatgtttcgtttttaattttatgtttttgtcaaatcattttcttttttcttactatatagtgtccctctaatacgcacgcgacttaattgggtctgctcctgagtccgttttccacacgcgtctttgcgtgccgccgtgattgttttactttcaaaaagaacatgccaattaaaataaagaataatcgaagttgctcggatccatcaattggcttatgttgttgcttctcagcataagcagtctgatgcttatcggcataagcatttccatcagccgtagaaaagagtcgggaatgattggacccactaccaatggctgatgcttattcagcccaataagtgaaccgatgggcttttgctgagaatcagcctcagcaacagcgaaccaatgaggccagctaattatgtccatcatcaattcctatccgacttgtgatcaagctggatgacaaatcgagctcgtgtttgaaagcctaattgtttggcttattcaatcctagaagtcaaattttaaattttagaacttaactttaaattcgactttttggttttttattatactttattttacaacattcgcttttgtgtcgctaagaacatgtatataaaagatttgcacgcacaaatagtcttttatttgataataagtgattcgaataagcacatgaataaatgaaacaatacgatgtgattatttatccattgcaacacatgtacaaattaaattttctctacccgttgcaacgcacgggcatcttttctagtttttataatagtagagaagtgttaattttgatgtttattcatcgtagtttattattattattattattattattattattattattattattattattattattattattattattattattattattattattattattattattattattattattattattatccctttccttgatggaactgtaggataataataagctgggcggcacgacatttgccaagactgaagctcctacagggcggcgctggggcaattattttgaatacgatccacctcagaattttgatgaattggttaaacgatat

SEQ ID NO: 25845 - DNA, 24891 bp, Oryza sativa
accttatggtccttatatatctgttgtcagtaaagtatatggtaagaaattgcatgctaatcctaccaatttgtgttgattttcactaatttacaatgcaacggcatgatgtatgcatctgctttaaagtaacactttgtgatgattgatgattgatctatagcgatgttacttcggatttttcgatgaaattagagcgctatgcacctgaaatttctttttaaagtttttatatgacaaaatctaaatgctaaaagttattatattttaagatggaggaagtaatattcaattaatgatgcactaatgactaaccttattttgtgtatcttaccactttttcttttttatctactctcgaaaacacccttagtgtaaacttttaaagttgtgttcggcacttattgagaactaattcctcgcgcatgtaaagcggaacaactcattagcatataattaattaagtattagctattttttaaaaacaattaatatgattttttaaagcaacttctgtataatatctcgttttcttagtaaaaaattacactgtttaatagtttgagaagcgtgtgcacgtgaaaaacgtggtagatgagttgggaccaaactcggcgtaaaaagagcacggttagcagcctaataggcttcaagagaggaagcccaaacattataagaaagaagcccatacacataaggccatcataactgagagattaaagtggcctaacaagttgaggcagagatcgtcgtacagtccggtccgcatctataccaatctatttcgattctgttcctataaatcggttacagagataaaacagtttctcgatgtaacattgatattctcaaccgatctgcagtacggtgtggttatctcgcattctcgctaacataaaccgcggcttgcatccatccatccatcgatcgatctatcttgttcctggatcaatcggtaattaatcaactcgattctttctcttattaatctctcctcttctttcaatcacaatcaatccccagccatatttctccagcatatctgatactatatgtgttccaattcttgtgttattaaactgtaggttaattaagaaggtgaatatatcgatgagctgcacaagtagttcgcctgatcgtgattatggaggaggaggcgataattactgtaggcgttgcgcagatcgggatcggtttgtggatgaactgatgagacgagatgcaggtcggaagaggttttggaggatgctcaaggttgttgcttctctctatggcgtagcccttctcattgggatgtggtttgaaggtgaagcacaccacaaccatgatcaccagtagcttaatttacctgttcttttaattttagataattgattgaaggttgagagagcacccgagcatgcatgatctaattaattatacggataaattacatattaataggtatggttatatttcaggtgcctaaacatttgaaaattttcaaccataaaaaattccatgtttctatgcctaattaaaattgtagtgctttgtaatgtgcaattatacttctttttaatgtttgttatatggttttagttactttgaatgtttttatatgcaattttgtttctttttttatgaattgtaacattttttgtagttttttataggctataatactatattggctgtgtttagttcgtgtgccaaattttttttaaagtatatggacacacatttgaagtattaaacgtagactaataacaaaacaaattacagattccgcctgtaaactgcgagacgaatctattaaacctaattaatctatcattagcaaatatttactgtagcaccgtattgtcaaatcattgcgtaattaggctcaaaagattcgtctcgcgatttacatacaaactgtacaattggtttttttttcacatttagtgctccatgcatgtgtccaaatatttgatgtgatggaaaagttgaaagtttgaagaaaaaaagtttgaatctaaacatggccattgttcgtccttttatgtaagaaagaagggattttgttttaagtcgtattagagcagtgacgatcgagaaccatctgattgtcatccaacggaccctagtgcacccaacagagaaaaacttctattggaatctgtaaatggtgccatatcactcctcatgggattattatcggctggaaacactcccgtcgagttgagcggggcacagttgaattaaggatgtaaagcagagacaagtgattttcttcgctacaaagacaaaaacctagtgttggcttttatggtagaacctgttgggaagacctgagagccagtggtttaccctgtggcggatatcagcagttcgagtccgcttatctccagtccacgaacttagcggatactatgataacactaaaatttgccaatttgatagtttgatctataatttcacatgtacgtcatctactgatatgtgatccttatgaatcatgaatccacctgttagtgatagaaaacggtgtctttaaaagcaagcatctcgatccgatagaatccggcgggtgcaaccccggtgacacgtacgcctagttaaaaaacatgtttatactttatagctacattagcttacaagtgcatcgtgggtactgtagcaactacacaaatacactctggatttactgtttgctaagtactatagcgagttagttaatcctgtcgtccgttcgtgattcatcgtatagatcaggttccaaaaaatcaccacacaaaaagtcatgtgactgtttacctctgacttgattcgttgaactcaagtctgattcgctgttgaagcaaacgtacagggccatgactgatttgccgttgaagcaaaccaacaaggatagaacaaacggtgccaaacgatatatatggaaacgaaaaataatttataaataaaatatttatatatgtgtttttagtaatataaagcaaaagctgaaaataatccccaatggaaaatcctaaaataaacttcaaatttaaattttgacatacaatcataagcggaaagatgaggctaaaaattttctagcctcctctctctctcgctgtatcgtcctggttctcctctgtcatgcactactgtaaagatcgtactgatatagctataagcttattttagcttgctcctctctaaagctagccaaacctgaaaaccagcggcctctgcctgcatatatgatcaacgagctagctcgagaagaaaacgaaataaagtatccctcactgatggaatcagctgtacaagtttgcttgcaagcttcaattcctcccaatctaacgcatgccttgccttgatcagtcgatcaggtactactgaatacatgtatgttatgtacacggtagcatgtccactactgcaaaattattttctgcagacggccaaatgtgctgcgtgttaattaagacgtggaaagtgcttattttcatagtaatcaatcttcacatgcggctaaattatgccatccgtctacacaaaccaaatttcgccgaaaaaagaaatcgcagccaagggcagcagcagccgacgacagcttcttcgaatccaatcccaaacatcgatcccaaatccacaccaaatctgatccaaacatcgcccaaatacaccaaatccagtcctaattaaactttccaaatccacaccaaatcaatcacagtctgcgcggcggcgccacgttgtactccataatcaataacacagcagcttgaaaaataaaaacaagtgttgagaaaaatcaagtaatgcgagcctatgtacagaaagacgcaggtaagtacatgccagctgatgctaattcacccactgcacgtggggcccactcgtcagtgagccttccgggacagtactggagtagcatacagcagggttgatgttaccgtcgataaccgcgcggttaccacggggtacggtaatagaaaaatcacggtaacctccttaaatttaaataaattttaaaaataatttgattttttgataaattttacacggtttcgtacggtttttcacggttaccgtgcttaccgccgaggcgcggtaaccccggccccggcggtttgggaaaccccgccatatagtacgtactagctggagtagtagtacaaactaaatatgaacatcgatcgatctgtacgttcaatgcatatatcaggcatatactgctgcctatccattatgtaaaaaaaaggtatatatacactgctgcctgtctcatgcatacatgaggtgcataaattatttaatcgaaacagctctggtacatgcatggttcggtgagctaaggtacatatatataaggccaaggtttatcgataattaagttgctagtacagtaaatggaagtactataccaacaacatatactcgccttaattaataaataaagaacactgctactattactagctaccagctcaattaacctgaacaagtacactgcaattactccattgcagcaattaattgtggatcttcaattggatcctcataatgattacctcgattggtataactaaccaaattaaggacgatatcggatttagctgctcttgatcgagctactactactccagcttgcttgtgatgctgccgtatcaatagcttttagttactcctgattttgtacgtgttgtgtgtgctgatgtgtgtatcagtggaaggaaggagttgtgagcaacagctggacctggaaactactaccatccatcattccatctaaccaccctttgctagcttgtacgtatatgtagtaaccacactaatgttactggttgctttggatcagctcattaatctcaagctagcaatatactccctccatctacttttgatagtcatattttatcttggcacacagactaacgataagtgattctacttatcatccatttaaacatgctactagtcattcctcgtgaacaagcgattcattaatatttacatttctcgatgcccatgtagccaatcttgtgtggaggaatagagaatcacgcattaaattcgagaaagacactaagatgataggttgttggattgaaatatgcctatcaaaaatagatttttcagatttggaaatatgactatcaaaagtagatggagggagtactttgtcaagtggtcctgtagaaaatgctctgtacactatttaaaataataattttcagcaacaatctctttattcaccttcgccacccgcgcgggggtgtggggggcgcgctctcgagacggcgaaaggattaaaatcctttgcagtcaaatgcacggtgcatttgtcactaatctatgggcccacatatcagtaacaaagtcacgtgatttcgattgcagatgatccttatccgcagtggtgacgccccgaggaggtgatgccgctgcccctgccgaagcacaccactatcatcatcgatgcgcacctgctccgttggtcttctcgcgcgtcgctggacccaccgtcgtcgtcgtcgcagtccaccaaccttctcgcacgccttcgtcggcctacatattgagagagagagaggatggacagcggaggtgagagtaagagagagggagagggagcggcgaaggagccatcgtcgtcattgccccatccactggcgccggatccgcccaccgtcattgccctagccaccatcgccaccattgtcatggctgaggactatatttggtggaggaagggtgagaaaggggggcgctggaggagggggtgaggagaagagagaagaagggaggagaggggtgaggagagtgtgcggtgaggagattttttttaagagataggagaggagaaaaaagagggggagtggggatgggccgatagctgacctggtgctaggtgggcctcttaacagaaccgcttacgaaaataagtttattttcgcatgcgggcctgttaggaagttcgcctataaaaattggttttctttttcatacgagttttgtcctctcggaccgatattatcacaggtggacgatgtaagctagaaggtgactcatatgccaaaatccaattttatagtgcgttatgatcttatatatcttttaagacaaatatttgcatgtctttttaaaactaagcatctgagaagttattgttttaaacttttgaatcttatcctaaacatatgggtagtaaatactttctgttgctctctctcgaaggttttaagacatgagactccattgcaagaagcaaacaccgacatacgcacttaagtttctctcttggagaaacaaaatggacgatcagcaggcatgtacagtgctccaagaagagtaacaaagaaactaccactacagaacatgcatgtacagtgctccaagctaacatttaaactattttatactactccctccgtattttaatgtatgacgccgttgatttttcgaccaacgtttaaccattcgttttattcaaattttttgtgcaaatatgaaaatatttatgtcatgcttaaagaatatttgatgacaaatcaagtcataataaaataaatgataattatataaatttttttgaataagacgaatggtcaaacgttgataaaaaatcaccggcgtcatacattaaaatattaaaatatagaggtagtactatatatcaattttctaactttctataagtgcacattgtgaagggaatttgatccatgcatgcatgaacagaagaatcatttctgataatctgatagactgatactatacacgtgggggacgagtactgcacgtgtgagagtctgcaatgtgccaagaagcttactattcgatcgcatcgtatccttcttcatcgggcattacaaatttacaatacactgaggaagaaacaagatccggatcatcttactgggtcgtaggaccaacatgttttttaatcataaacatcaattattttacagtcatttgactccaaaggcatatgtgtacagctaatctccatatatattcttctactagttcttcgtttcatttcatatacagagatctgatagagccactgtttctagtcgccattacaagacactataattggatttggctaattaaaaatatattgatgataaagtagcaatataatgacagccctatctgcttttgacaatgaaaataatattgctatataggagtactgacctggttcaaaaaactttgcagctaagattcaatgtactacagtcccaacgacacacacacacacacacagacacacacacacacacacacacacacacacacacacacatatatatatatatatatatatatatatatatatatatatatatatattacgtgccaatatcgccttgcacgtcgcaatctcactaatttatatgaaaaattaatttctcaggtcaatccattttgatctcctttagacaaacataaagatatacttatatatttttattattttgtgcaatgtctaatggatatacttatatctttatgaacactaatccataaaggcattcatcataatcccagctaagtagtaggagtactacaagatttcaggtaggtacatataacacttttcacataattaggagtggtccgcatcatcaacagctagctagcagctgcaatcccctttttatatataatttttcaagaacatatgatacaattcagatggctccaatgcaagcgatcgaaagcttttgttaataacaagactggattagactaaactaaactaaattaatggcgaacaagttgaattaagctgtcatgattagctaaacaagacgtaattaacatgctaccagctgattagtgtactaattaatttgatgacgagacagagtgttggctatagctagctatataggtaagggaattgatgaatcaagggagggttgagctggcatgatttggatccttgtttaggagaagaaggcgagacaagagataggtagaggaagaattaagctatgtttggttggatttgggagggttgtctcatgtctggctggctgaaagctgctgaacaacagctgggcctgaccctcttgctttgcttcaattcaattccaatcacattcgatttattttccaaaatggaggcgtcagtcgtttaaatcaagaagacatttgtaccggaattccttttctgctggtccatgtactgctaccagcagttgtgggaaagaaattgtactagagctcttgagcatatttctatgggtaataataataataataataataataataataataataataataataataataataataataataataataataataataataataataataataataataataataataataataataataataatgtgtttttataaaatatgctagtattacttgtttgcttatttgaatacatagtactcattcgattaaaacaaatattagtttatcgtgtaatatcagaaaatatatagtagaacaatttgtcaaagtaaataataatggtgagccaccaccaccattaataccttttcatagtagtatacataaaggtctttataggttaaatggcattcgatcttaggttacgtgggacggagacggtaatactacttttgtctcaaaatataataacttttagctataaatttagacacatatatagtggtgtttgaatctcatgaagatgaaaataaatataaagattaagtgtttcacgtaaaacgaggtggtaataatatgtgattaattgagttttaattactacaaacttgaaaaatggattaatctgatattttagaacaactttcatatagaaagttttcacacgaaacgcaccgtttagcagtttgaaaagcgtgccattttaatctacaatttcatccactccttgcaggggattcgaatgggccataattgtttggatttattgctaaaagtgcttatatattttaggatggatgacgtattttttttcttgccctgcatacttggatcttgaaggctggagttgtggcttgtaaagttgcgatgagcatgggcgcatggcgtgcgctagctacgcgcggcgcgacggcaccgatcccaaccacccacttcgcagcagcagcacacagcttcactccactctccgctctctctgccacccgctgggccccacccacgagccagtgggacccaccccgcatactcagacagataggaagagtacaacccgccgggtgggcccggcctgtgcagcatgaccaaagcaaagcaaccaacgagacatcccatgtggccgtggaccccacagcccaatcacccttttccagctcggctggcccacttcgggctcctcagcttcggcttctttctactctactccactccactccactccagctggtgagagcgcgagttcctctctcttcccttccaagttccaacaacaacccacacacctttttgactgccgggaccgatttggccaaaataaactccgaatttgaaatttaaaacataatagacacgaaaagtttttataacttgttcattcattcatcatgatcccgaacttgctcttcttcttcttctgcttcctcctctgcttctagactttaaaaagcacctagaagtctaccaaaattacaaaccccctcatcaccatttcaccacccaaaaaaaccacaaaaaaatcacgagtagtgatttcaaaaacaaaataaaaaacacaacacaatctgatcacccaacaaaaacgacagagaccagaaaacgacgacgacgaacgctagcgctagctgtacaatgttgttcccgattccgatcgatcgatcgattcaccgccgcctcgtgtgcctcaccggagcaggtcggagcgcgacgccgagagctcgcggcggaggcggtgggagaagagccggcacgcgtccatgctcaggtcgacggcggcggcgagcgccacgaacgccgccgcgtcctccgcgcacccgacgttctgcacgcccacctccaccgccggccggctgcatttcccctccccctgcaccgccgccgacatcacgaacccgcggcagctgccgaacggccacatcccgtagtcgccgctcccgcacgggctgcacgccggcgacccgctccgcccgaactgttgcgttgccgtcaggtcgatcgcgaaccggccgcccttcgacgccgggatggtggactccgccacggacacgcccacgcccatgccggttgggtcggggaggacgagctcgaaccggtacccgaggctgtcgccggcggcggcgcccgcgccgcgctcgcgccagcattccaggcgaccccatggcttccacgtgccgtcgcccgggcggagcaccagccacgcccccgggttggatttgctcaccctgtccgtccccggcgacgccacgaacggcgtcaccattgatgccagcgccaccggggagcctgacaggtcgtgcaccgtcaccgaccaccccttcctctccttccccgcccgctccctgtcggagccgaacgccgtcagccagttgcgcccgccgctccccatatcggccggcattgacctgaatcgtatgaaattgtcgtcagaacgatgtgacatttgactgggaatttgatcgaacaccatgagggcaagaaattttaccgggagcggaggtcgctgttgctgcggcaggagaacttgcaggtgaacatgggctgcttcatgctcccctgcacctggagcacctgcgggctgcactccggctcgccgtcgaactcgaacacgaacctcgggtcgggctcggcgcgcaccgtgatgttgagctgcgcgttcgccgccgacaccgacgagggcttgcgcccgcgcttcccgatgcagatccagctgctgtggtacaccaccggcttcgccgaggcgcccttgaggtcgagcgggatgaccaccttcccgagcagcctcccggagccgccgccgacgccgcacgtggtgcccctccggccagcgtacaccacgatcttcagcctcgccgtgcgcgacccgaacagcgacggcttcgcggtgaggcggtcgaggtcggccttggagaggtggaacgcggcggcgagcgcgcccgtcgccggcgctggcgccggcgccgccgatgcctccggcgagggcggcagcagcagcggcgcgtcggcggtctggtacggcagcttgttgaggcggatcttgcagtagcacggcgaggtggatgggtgcaccccggccccggctccggcggggcgcggcgccaccggcatcttcagcgagaggttgccgaccagcacccgcacgaacgggcacgggtccatcgagatcgctccactcgaagcttctcctcttcctcgtcggcggcaatggcgatggcggtgggggaggtggaaggagtggtgacgagggatcatagggtataagactcgcgcgccattgccgtggccagcctggatccccctcccgcgcgaggctactactatttcacgcgatccagctcatacccaactcacttccatgtgggccccggtgtttcgtgaccccacctgtcagtggctattaggtttcgtgcgtgtgggtgtggttagggtggcgtggggatgcgtgtggcgcggtcgcaccggatccgggttgcgggccgcttttgcggcggggccatcgctgtggccggaaataactcgaactccgcggtaatttttttcttttttttcaaccttttgcagtttttaccgtgggtgaagtggatggaaaaggaaaaaagaaaggagagggtttgcgtgggaggaggaaagggaaggcgggagttcggtgggacccacggtgtcggtgagtgatgatttgtgcgtggagtgggatcgggggtctcctcgtgggccccactgtcagcctcagtacgtggaactcccgcgcccgcggggctcgggtggttagttgcgatttgaagtggagtcaagtcgttaacggtcgtgggtaaaaataacggaaccccatctacaaaaataattctaccctcgatcccaaaatataaaaaattttaaagttagagacgattattaagaaaatatgtaaaattaaatatgtaaaatataaaattattgagaagtgaaggtatatgggaaaaatgaatagtgcaggattatgattggttaagaagggaatgttggtgaagatattattatattttaagcaaattctaagtattaaaagttattatattataggacgaacggattactcctagttgcaatagaaaaaaagaaagttcttttactgcattttttactcatactctctccgtctcaaaaaaaaaaaaaagacaaaccctgagtttctgtgtctaactttaacggtcggtcttatatgaaatttttttataatttgtatttttattgttgttagatgataaaacattattaatattttatgcgtgacttatctttttaattttttttataatttttttaaatacgacggacggtcaaatattggacacgaaaatcagggtttatctttttttagacggaggttactgatgtttttttttaccggggagtacagaatgccagtggctgatacggaaagtgcggtttaaattcctgctcgacgaatcacgaaacctaaacagcctgtcgatttgacctgcacaaaaaggatcagagtacgctatctctgtttttttcttttgccctttttgataatcttgctgtcgtgcagtgcagacagcagggcacgggatagaggcagaacgtaccagtaccaaacaacacatgatgagaaaaaaaagggaaaaaagaaaaaaaaaaggaacccgtgcgtgcgtacaggtacagccgcatctatccgtcccgcgagctcacgttaccctactgtcaatgtcatggggcccgacgtatgctggccccacctgtcagcgagagtgtgtagagagagaggataagaaggggtgacgaggaggggggcagctgggaacaggctgtactggatggatgggggtttgttctagttttgatttaaaatttttgaaattattatgtttttttttctttcaaattcgaaatgcccatgctgcggtggtggtgtaggctgggctggctggaccacctcccagctgtttgtttgggttgcagagccaaccgaagggggtggggcccacctgtacgtactactacactgaccagctcgtgctcgtgccgctacagttattttcaggtaggaagagggtacgtgtgctgtcgcatcctgtgattgttgttttccacattgccacgatttccacaatataattaacgctaatgtataatttaacttgtaaaatataccagtcactttttttaaaaaaaaatcgttgctctaacttaaactactactctatctgtaaaaaaaaacatagcaacacaatagaatatcatctaattctactaatctggacttttttttagataatgactaatttggacatgtttcagattaattatattatgtgatgttttatttagtagtagtattaaggttgttatattttgaaatggactgactgactaataatagtaattttttaatggttagactacgatgaacgaagattagtgctaatgctaaggacataataatctttgataatatggtatctttaagtgcttattattctttttgcaaaaaaaaaaagataagtggcccaaacttgaatagttcttggtgataagtagtacttaggaatgaagggagtagtttttttatatataattatctagattatttttatacataaagttatatgcattctgggagtgatattttgtaattcagattgaactgttgagctagactgcccttctaaatggcagtctaaatcttgtgttattcagattactagctagcctgctgatttggggcctgcactatcatcaataccaagctaattgagctaagcatgaccttcctccgtttcaaaatgtttgacaccgttgaccttttagtacgtgtttgactattcgtcttattcaaaaaatttaagtaattatttattcttttcatatcatttgatttattgttaaatatactttcatgtacacatatagttttacatattttacaaaaatttttaaataaaacgaacggtcaaacatgtgctaagaagtcaacggtgttaaacattttgaaacggagggagtacgtcctctgacttgctctctgtcctgtcctgattgctcccagctggagcaacaaatggccactaattctcctgcttgctccatagctgttggttatcacatcatcttctactatccaattatttgttgcagctagcaatcatttctttaatgccatcaccttaaattattaaccctaaattgattggcaattagctgctgatagccagtggttgggttcagtttctttgtcatttggccccagcaggaagagcttttgtctgcaaattcagcttcattagattacagtagtagtactagcttagacccacagcatccttcttcttttctttatcaacagtttgacgttttgaaaaagggtgcacttttaatcatccaaaagtgcatccttagttgcatcctaaatagctatagtagtactaggggctttttattagtttttgaaggcaattcagtgtttgtcgctgtgttgttcatgattgatatgatctaccgttaggttcaattgtactactgtcactctgtcaggtgattaatctgtaatcgccctgtcttaagctaaggttttgtttgaaggagctcatgattcgaaatacgactgatgaataaccaaagctgaaattctaaggttttcacttctaattcatttttttattatataatcatatatttctaggatccatgagaaaatatgtatggttttttcacttctaatttattttttattatgtaatcatatatttttagaatctagaagacaatctagatgatttgaggagctggagattctaaaagaaaccataccagaagctccttaaacatggcctaaagatcttatgctttgcttggcaatgttgatcagtgagtacaattagcacaaatcgttcaattgaagaataattcagtaattaagctgcgtatgctgtatctgagcaggcatcacacaacaagctgagcagtacaacaacataggattccacctgtgctcttctgatctcgtctattgtacaatttaaactactactaaccacgccactaatcaccaagctgggcttggctttacgccaggagatcatgtgattaattttatccgatcgagtagtgtgcttgcactgcaatttacagcaacttgcaaacctctgaaaaaaacaaacaaacttgcaggcctcgtgcgagtagtttactgctgcagcatgcgcccgatttgattaattacaaatgggaagagagaaatgtaatcaaacatacagtttacaaggattcgatcagtgatggcatgattagtttaaaccctcgttgtgaacttgttataagtcagagctgtgtcagaggctaattaacttgcagattttgtttcagttgagttggatactttgaccactactgcattgaggataccggtagccgatgcaatgcggcgacaggtgaaccgttgcaaaaacttgaagaccttgagctgattaatcaatggattaggagtagtaattaatcctgatcgacctgactggcgattaggatgcagggattaggacaagatgatcgatcgagcttgtagtcaagcctggttagtgattgtactttgaccaaattattcaaatactaaggagaaagcaaatgtttaattggggcaacttgtttctctcctatatttgcagggaatcttgcattgcattgttcttgttaccatttttttaataagaaacacagaacaaacctctcatgcgctcataacacgcgtaaactcatccttataaacgtacactaatttactattcgataagtgcgctaattggctaaggaagtagccaacactaattttttttcgatgaactacatataagagtactacaaagctataaaaatctagataacattagtactcctatatacttcctccatttcacaatgtaagtaattctattctacattcatatcgatgttaatatgaatgtagaaaatgctagaataacttacattgtgaaacggagggagtagtaaaattttggaagagaaaaaacatataaaagagagaagaaatgggctaattgggccttatcagcccagcccagcccaagcgacgcatgaggcagcagcaagcaaagcctatctccttctcgcggctacgcgacgccacacgccggcgccatcgccttcctcctcctccgactccgacgagctccggcgactccgatggacttggtgcgcgcgctcgccgccatcccggctcgtcaccctctccctccctcctcgctgacaaaggctcgccgccatgggcctcaaccatcgacgaccgttctggcgccggtgccaggtaaactcgcgtcgcgtgtagaggtctagggttcttcaaggccgcagctcgcagtctgggggaaaaagaaaagaattcttcatttgaaagtgtgaaatactgctgcagaaatttgttgggaatttgtagtcctgtggtgctgccaatacactcaatagcttataggaactcatttccaagcattttctcatgttatacttgtcttgaaaccatgaatgattaggattgaagaagccattggttattgtgatagtgccactttaggcctcgggatgcattttaatttcccttgtccaattaaactatgtgttatactacaattctgaattgggactagtaaaaaaaaatggccaaacatttggagcatcaacataatagtacatccccaagtcccaagtacatgcaatatgagaactcaatgtagtcttgaggagttatgagaagataaatttcttgggattaacaatgatgttaagcatgatatgcatgtttactggatgaagaaaaataataagcgaagagaatctgttgcaagaataattatattgcatcgatggattttttttttttgaagagcaggcaaaagcatcaatggattattttgactccaaaattaaatgcttattacaagacactgttaattacttctgtacaggtggaatgttggatagaagaagactgctgttgattcctgcaatcagcatcagcattggctccttcgacaagggggcagcaaaagctgagtttgctgatagtgagtcatttatcacactcgatactccattgagtgatctgtttactttttaggtagaatggaatcactcttagcacatactgttaatcatgtcttgcttctttcatgtcacaatttcagtgcctgcgcttcgtgggaaggattatggaaagacgaagatgaagtacccagattacactgaaacagaatcaggtcttcagtacaaggtgaatatatatatacttttatggagtgatttacattttgtagcattatccaggcatgatcacacatgttccttatttctgttcataattataatggtaaattgtaggacttgagagttggtgatgggccttctccaaagaaaggggaaacagtagtggtgagttataagcaccacatttgatgttcacccatagataatctgtatatttgcatgtgttatacatatttcaatctttagtgttatcatttgttgatttatgccaaccctgatatagatttggattgtgtgagtgcacttaaggttgattgggatggctacacaattggatactatggtcgcatttttgaagctcgaaacaagaccaaaggtggttcctttgaggtacatattgccacctgtagactgtagtttacactacagaaaggaatacactcaataatattggaacgctttgcagcacagatatttgtttagatttgatttgaattatttattttatttgattgattccacatctgtaatatgaattgcagggtggtgataaagacttctttaaatttaagattggatcaggacaggtgaatgacaaatttaatctagccagcatctagtgtatcattttttggttcatactattttccttttatcatggccatgttagtgaaaactaactattcaattgttcgtatacaaatgctcaaaatttcaactccatagaaatgtagtcaattctgcccaattgagaatcttgtagctgctgtctgtaactctgtacaagtgcctttctgacaaattgcatttttaacatttaggtcataccagcttttgaggaggctatatcagacatggctccaggtggagttaggaggtcaggagtcattttatcttttttgaagaaccagtttcaatataggtagatctttatagtttatatttatgacatgtaaatgtaacatggatgaaatttatgcatttcaggataatagtaccaccagatcttggatacccagacaatgactacaacaagttgggtccaaaaccaacgacattctcggtaatttctcttcttttttttttttggcatggatgcacaaattatgtcgatcaattttcttaaataaccaacataacattgttttcagggacaaagggctctggattttgttctgaggaatcaagggttgatagataaaactctcctgtttgacattgagcttttgaagattataccaagtcaatagtacatgtatatgatgttcatttgttcctttgaaagtaaagtaattctggcttctttcatgttcatttaccgttctatcatttgtcttgcttgacccagtaaaatggcttgcagggcaatgttgctgaccacttggagaaaaaacacacaagtttttggcgtcgtaccagtaccagtcgacatgtaaatatgggcctgtttagttttcaaacaaaatttttcacgctgtcacatcgaatgtttggacacatgcatagtgttaaatgtagaaaaaaaaaccaattacatagttcgacaggaaattgcgagatgaatcttttaagcttaattgcgccaggatttgataatgtggtgctacaataaacatttgttgatgacggattaattaggcttgataaattcgtctcgaagttttctggcagaatctgtaatttgttttgttattagactacgtttaatactttaaatgtgtgtccgtatatccgatgtgacatgtaggggcaaatttttttgccaactaaacaggccctatatatgccatcaatttgaatatgaacagaaaattttctaagcatatatacataaatattgtatgccaaatgcttgttgtacagaactgacaccacggacgaattcattacgacagtaattattattcaaaccatcttgatatgagatgaaccacttatacatcaatgctacaaacaaaaaaaaaatctgaattgacctctcaaaataagcagttgatgaccagtttactcgatcagatggctcgttatttgtcaaatgtcaatggaacttcagaactggatggatgtagccagagtagcaaggaatcagagcatacgcagggaccccaattgtttctttcataatcagacgacaaggacccatttcattgacaggagttgaacaatgagtagaaaacagagtgcatggctgatgcaattggacagacattgctatgctactcaacatcctccagaattctccacaaagaacatatgcagagcactacaacctatactaaccacaagcatcaacagccagactaagaacatctccaagggacttgctatctcattctccatgccaaaagaacaaaagaagaagaagcaaacatgcaaaaacaggtgctccaacagattggttttttgcattgctattccatctgtctggctaaatgtaaatgagagaatcaggtggctaaatctggcagcccctgtgactctccatcctgatgatcatctccatcttctagcagagcaccgagctgaggctcgaggtcccatgccgcctcggaggcgcgtttcttgagctccattgagcttggctgcctcgtcccgcgcattgccggctccccccagctctggctcctccgtctgctgccgcctcacccctaccagggccgcctcttcccttggtggcgtgtcctcctgagcttcattgagctcagccgcctcgtcccacgcatagccggctccacccagcgccagctcctccctctgtcgcctccgcctagttctgccttcagatcactgtcgtcgtcgtcgtctcctggtttggcagtgtgcgtgtactaggagtattgttgcagccatgaattcatcgtcgtcatctgaagacgacgactccaacacaatttgcatggataagctcaagccaaagtgattcatttgtggtgtggaggtgaagaagcaaacaaggaagaagaatgttgtggtagcctggtagagaggtagagaaggagcctatatatagtgttgcaaaatagctgttgggaactagctgttgtaatatggagtctgttggagtgtgttggaatatggagagcgaactagccgttgggatatggagagtggaatatggagagtctgttggagtgtgttagaatatggagagcgaactagccgttgggatatggagagactgttggagtgcactggaatatggagagggaattctgtggagagatggagagccaaatttgccaatttggtacctttctagaagtcaacaatcagcattcagcaactccaaaaggaaaaaccattccagttaaatgcacagactgcctcccaggagtggcttcccgctcgctcaccgtaatcccacttgaagttccacacgacgttcttctttctgcaagggaagccaaaactcaatacaatagcacatttgaacacaatctcagtgagaccagtgagcaacgctttccgaaaacaagcagcactgttgctttttcagatcaccaaaaaacccaaagttaacccgtcaaaattaacttaagtgttaaggaaattgtctgcttccaagaaatgcctatgcagatcattaccggttagttacctttttacaaaagaacaaaaacacatccttaacagccaccaaacaagataaaacgagaatcagaagctttatatttgcagtgatcaatggagtggaccttgcctgcatacttatcatctcttgtcgaggtccttcagaattctccaacttccacagccaattagaaagcagacgtatatcataagattcaaatcaacgaacactaacctagcattattaggtttgcacaatagggtccagcaacaaggtggcatttttttactatactagtctggatcagaattctccaacttccacagccaattagaagcaaacatatatcataattcaaatcaaggatcactaacctagcattattaggtttgcacaatagggtcctgcaacaaggtggcattttctactatattagtctggatctgagcaagtatgttcttttttctttaggaataccagagaaggaaatcaaggcagaaatcttatctttccaacaacaatctgtcttctaccttctgtcactgttgcttaaacatacaccatataatttattattcaatgatcaaacgatttatacacgctgatacatcaagggatgatctaggcagagaccccaaggaattttttgcatctaatacaagttttattctactcactgccaatagacattcaattaattaatgccagacacttaatctcaatccatttatttagaataatacataaaagctactcttcaacctatgaatcaaataacttatccctatttttccctgttgcttttctttttctttcctttggcatgtgtggattatctgcaaatatttgaatgtccaaaagttgtactctcatcagcatgtattggtagaattacgcatttgtggacacttcgatgaattggaattatgttaccatgctaaagacaaagtgttgtgtgcaaaaagacttcgtaactggtacttacaatggagctcaccatgccaatgtgaaggatgtaccacctgtcagtgatattgtgtggagcttttatgagagtgtttatccaccaaacaaataaaacgtaagcatcttgatatgtacaacccttacttccttctatataaggtgcctatcacttctatcgatcaaaggagcacatttttgctcgacacagatctctataaaactatttgcagtagtaatcatttaatagtatctattatccgactgaggatacctttgttgctaaacgtagatctctataaaactatttgcagtaatcacttaatactaatagtagtccatctattatccaattgttgaggatacctgctaaacggagatctctgcaaagctatttgcagttatagcttagtggatttcattctccattccaggacatttatgagacagaatttaggcatcaatttccaaggattgaaacttctttttcaatcattggagcacatttcctggtaaatgtgatctataggaagttttctatagcattcacatagtagtatccaatctcattggagtatggttttctcatagattttagcaagctatttgcagcaataaaattgcaattctcgttctcccttgcgaatgtcttcccctcatacatctccactaagctatttgcaaacatagcaatttccattctccactggagtatggttttctcaaaataggtctccaacaagctataatcgattagtagttcccatcctccattggaaaatggctttctcgctgtagatttgtaggaactatttgcaacttacacgcggtagttcccattatccattggaggatgcatttcataccatataaatcaacctagctacatggtatgtagttaatcgctttcgtttttaggccattcaacatccaaaaatgtctctcaccataaaactataattagatattgttggtatcgtattaatttgatttctatttgaggatgcccttctcgctatatatatgtagccagcaagctacaccgtatactatacagtattctctctctatttactagtcaagtatggtgaggaggggtagaaggaaaggcgtgaggtacatcgaagaggatagagatcgcagcctcaccctcagcaagaggcgtgatgggctgttcaagcttgcaaatgacctctcccttctcactgatgcaagcgtcgcaatttgcctacatgacagcaataaggtactgttgtcccactatgcttatgaatatgtcatcatgctgtaccttgaattgtattattattattgtaatgttaaatggaattcgtttgaaatatttggttatattattgcattatttacaacaggcacaattctttggggcaccatcggtgaaacctgttgtcgatgcttttgtatctgaggcagagccatttgccgatgaacaactgaaggccaagcttacgtcaatgcaaagtgagctggtccagctagagaatgaagaagaagagaaggacaagaagactgaagaatcaatccagcgcttcaaggaggcccaagaagagagcttaggtatgggtatggccaagcatctattctccaggctagaggatctcagccacgatgatatgcgtgaacttttagatgtactcttgccgctccagcaagaattcaagaagcggctgcctcccctacgtcgtgggcagcaaagcctgcccaaaaatttggggttgggggaatttccaaaaaaggtttgggcccccgtttttggtggggggggcccccaaaaccccaaaatttttttccccgagcctcgtgttctcgcttcttggcctcacaccgtccattcactccattacttcctggagggacatcaggagttccgatgatacctccgcctccagtgccgggctccccatggtctcagatatttccgctacggccaccactgtttccttctccagagttagtgccatcccaacaattacccccagtatcaccgccgcagaacacagtggcacctcctccaatgcatgctccattggggcaacagccacttactaatcaatcatcggcgggttcccctgctgacgcaatggcaaatgcgttttggggatcagccacccgctgaagtgcaagcatgcactcccgtagagcaacctcaaaatgacaatgcagtccataccccaaccttcagcgacagtttccttttggagttgttggctgatgtcagcgatgatggcattgctactgctgaaccattgtgttctcctcctattgatgaccagtttttggctgacatcgactggcttgctgaattggacactatcgatggaaatttataggtcaagttgctgatggttacagccttcctcaagcacttggtggttctatgatatgctgccagagttttcttccggtgggggatatgctaatgctattgcagggcaccaaggaactgaattagtttttttaaactacttaatcaggcctctttggggcaaaattaaagtgtcgttgtttaagattcttagttaggcctctctgaggcaacagaatacatgtcttctatgtaatagcagtagtacatgcactgctgtcttgaggttcaaactcatgaagtttgttttgtgagcatgatcctcttgcatcattgcaatgtcttgtatcctcatttttattcgagtaatgcacaattattttgtttgagaaaaaaagtgaacatgtatctgcaagaagtacttaacatgttgtgaaaccgggcttaattttcttactacactcatgatctgaaaaaaaaatgcagttcatgtcacaactgaaaccgcgacctgagtatgacaaaaacaaagtgcaaggtacaaaataacagcaaatctaaagcaagataaaggtttttggttcatcttacatcatcctcatgtagcacattgcagaatcta

SEQ ID NO: 25846 - DNA, 10450 bp, Oryza sativa
taagagcaagtttaataatataaccagctgctagctttaaaaattgacacattttttacacccaatctaatagcctatgcatacaatagttttatataaatacatattgcaacattaatatttggcctacctttcatacacacgctatatagcttatgctgtagctgactacaaacaagcagcccgtttttcttctctctctcctctatatgtgcttgtaactaatctatagcatatgctattgtatttgctctaaggctgtgttagctaaggttgggaaccttccctccaagcaacgaaacggagcggtttattaacatatgattaattaagtattaacgaaaaacttaaaaaataaattaatatgatttttgaagatcctatgccagactcatcctttaatatgccttggacttacgtaattatatcagttaatgcaaagatggctaaaattgtgaaaacggcctcaaaattgcaggataagggctctaccagatcgtaggaatttcattggtgtatagacctcaaaattaaggttattagaacaacacatatttacaatcggagggagtatctcatatcatatctgccactttaatctgaatgcagatagagccattctaaaggtcaatgggttcaggaatcagcatgcaggataagcctctagcagtctgtagatgacatgcatgcatatgcatgctagcaaggtgccaatctttgtgtaagaaagatgatcaaatcatcatcaaacgcagtctcaataatgactcaatccttggacctcacaccaatatatccaaatccaacgtcgtcgtaagcattggctgcatccttgactttgcactcgcttctactctatctatctgctatatatatgtataggaataggagtattctgctctgcctaggactgcgccgctatgactatcagactatgcctacctcacacaagattcagcggcaacatccaatgcatcatcctgtgtgcagctgtaaattgaaaataatttctctgcatgcctttgtgacataggagtaatattcaggctatcatcagcatgaactttctgatcatttgggtgaaaaaccaattcccttttggacttttaagtctttcagtagagttgaatgctgtaaaagatttggagagtttggcgagtagtagttgttggtcaacactttgcttgaaacttcatcccctgctgattctgactaatgagtaataccatgatgcaagtcatggtgtatacttttttcagatgttgcaagtcttgatatcctctccctttctttcttttgctttttcataagtctaaccagttgggatattttgttcggttgagtgaaggagaatacaagtaaattactagaagatgaagaagatcatatggtgattctgttctgtaccctgcttcaacatgactgacagtaaccttggtttttagcttttgactccttacagatgcaggaatcagaactcaacaatgacaattgagatcgactgataatcatggcgcaataataaatgatacgtttatttacgtggtcagactttgacattcatattgttgtgacagtctgacaaaattgaggttaactaaaataaactacaccacctgaagaattatagtcttcaccttactttcaagcatatatatgtctcattttccaccttaatcagggaaatatagtcaactgaaaactttttaactttttgaatccttacagaggcaggattcaacaatgacagttgatactgacaatcatggcacaattaataataactggtacgtcatttacatggtcagactttgacactcatatggttgtgacagtatgaccattgaggttaactacaataaactagaccacctgaacagtaataatcttcaccttacattcaagcatatatatggcgattttgtcaacggaaatctagctgttaacttgttattgaagttcagactgatatatcatccatttaggctactgaaattctgcaactaagctactactttgttacattcatgtcaaatttaccacttacatgacatccattcagactgatcatcatcatcatcaggctaaatttaccacttacatagttaattacatctgacgaaacacttgagcactcatctcaaatcaacctgtcgatctgaactctgaaagacacgcacgaacacgacttaattaacatctgattgattaactatgtattatatatatcattcacgatcttgatcgatcgatcgatctcgctatatatatatatttgttcttcatcgatcgatggatcatatcatcatcatcatcagtattaacaaataattattaatttgatcatgaggagacgctgaatggcttgtaatgtgcgacggatttgatgaggccctggatggagccggcggcggcgaggagggagacgacgaggcaggcgaggctgagcacgttcatccacgtccacgtcggcgagaatcgccggaccttggcctgagacatgtacatctggacggggaagtagacggtgagcggccagaaggagacggcgccgatgaggccgaggaagtcgttgaagaaggggaacgccatggcggcgacggcggtgagcacgacgtaggccgtgcgccagacgaggcggagcgcgctgacggggaagtcgccggcgccgagcggcagccggagcacgcgctcgccgttgacgaaggcgctgtccggccaccgcgagcgcgcccaggcctcggcgaactggtagatgggctggcagaagacctggtaggcgccgacgaggtggacgacgatgcagacgttgccgacgtcgacgagccagaagggctcgtagaagccgaagccggtgaggaagttccccggcgcgcggttgccgaacgccgcgtagccgagcacgccgcacagcatgtagaacgtcgtcgtcgtcgagactccgatgaacgacgccttcttcatcacctcgttctccgccgggctcgaccgcagcgtgtcctgcacgtttacgcacacatttttgtcatttcgagaaattttacagttcttgaaaaattaaagtacattgagatttagactaaaaattttggtatctcaaaatacataaaatacatagtatcaggagatattaagttttatacttcccgatatctttttaagaaaaaggataggaaagattttacggttcttgaaatgaaaaggtagttcgagatttagactaaaaattttggtatatcagaatacatagtatcagaagataccaagttttatacttcccgatatttttaaggatagaaaaaaaattacagtacattaactcgagatatctaaattttataaaataatagtatattttaatatctctagatacatgcatattacttgaagatactcacctatcggtaactcacctatcggtatcggatgataaaattacccaatcatgagatgctctcaaaacgcatcaaattattttctcactacttcatacaaattagtgtaaaaatttgtgtttgattgcaatattgacctagctaggagaagtaccactagagttgcgttgagatttgcgtgagacgtaaatgtgcaataaatgcagtgaaatgtattgcctcgagacttgtctcatttttgtcatccatcaaaacgccaaaggaaaggacagtattttgattgaggacaaagacatttcaagatttgaagctcatatagtattagagcaggtacaataacaggctataagctagctataaacatattttaaagagataaaagaagagagagaaaagcagcgggctacagatctgtagccagctgcagcacggactccaagacgtaatgtgtgtgacaggtgggaccaggtattactagtatagcaagtaattattgtatgaattggctattccattggctatagaaaatttggagctagtactatgctataccattaaacttgctcttagtaattaggttaggcagtcattttcagaaatggtattagtaattagattaggtagtcattttcagaaatgttcttgcatgtgaactctgaatttctgactgccgattcatgatctgaaatttgatggccgacaggttaagtataataagggatatatcgctatctacttgcaaatttcatggcaaaaccagtggtttcaatgaagaacagagactctatgttgaccagtatgaccaagattctgaaaaggaatatatctgtatttttcagagtatttttcatgtgcaggaaactgcaaaatctgtcctcttgtagggttcacccatactgctatctttcagaaatctgtcctctttgacagagctcaaaagatcacgggcatacggaacatccccaaaattttcctcctatttttttctctcacttttcctaatgtactatttcctccctcctaaaaagaattaaatattagggataaatttggacacatagattcatccttagagtttaatttttttcttttagccggagagagtactacatcaatttacttttctcattttatacttgtctaaatttgtttcactgaaaaagatagcttatcgctcatgtttgtatcaagagaaatataagcaaaggttaattaaaattaatttacctgaatttctatgaggacattggagtaggagtatgcaaaggcaatgtcaccaagtgactgaaaagttctccagattttctcacttgcagacacatccactccaacagtcacccctgtgagggttgcctcggggtgggccccacctgcagagaaccacatgaattcaatcatacaaatgcactgcatcatggcccccccccccccccaacatggatgatacaaacaaaaaccaacatgtcaagtgtcccaggctatgtatatacatttttgcacgcctcaattttgtttctgccctaccaaaaatgtatatttataatatcagcatcatatcttctttgttttggccatttcccttgtgaattaattgcatgatgtgtacacgggaacagaatagatgaagtaaattaaagacttggtcttcatttttggaccgaggaggacttgggtctctcctttggaaagtagcggttttacaagaattttgtcggattttcacaggaaccagtttcagttctatgtgcggcgagaaccagaaaaaaatatttcttgcaatcctaagaataagatagccacacaaatttgtttttgtcatccatatatatcagatggtatatatttacctgcaatttttgcaatggagaggccaaggccaatggttgagtaggccagtgacatgacagcagcgacaatggagagccaccaaattttgtgaaaattcggcagctgcgagaggaggatttggatgccagcaaatatgatcatgttggtcgtgtcagatgccaagcaagctgcgtcgtggccgttgcgatggaaccagttggaccgtttgatcgcactgcatatcatcaacagatttgtaaattaaccatatgttagtattcagagaaattcagagtaacactgacgaaaatcatatcagaaagaaaaaggagtgtactgaaaatgaaatgaaaggtaggaatcaaggtaaaagtgtctgatttttttgtttatcaatcattagtggtagtagtctagtagatgcttatcacgaataagattcttctccatagccatgccaatatgcagagcagagcaagaaccactcctttttagctcgctgtttctttttcagtggaaaaagttttggatactcactagaatctgaatattttccaactacttttgaactgtccagtaatgttatcttccccaactttttctctcccactatatactctgcttttttttgcctttgttggatcctcaagaagaccacctaacgtactcaacctaattaatttgactgtcatagcagccatgcgacatttcagagaatgaatgaatgctttaattacaatttgctttgcttttgagaattatgagtagcctcttacctatgttgtcctaatcatactgtcaaacctaattaaacatggcgacgcattcactatgacaacaatttttgcaaatggccaaaacatatactacctcctaatgtatgacgccgttgactttttgtccaacgtttgaccattcatcttattcaaaaaatttatgtaattattatttattttattgtgacttgatgaatcatcaaatgttctttaagcatgacataaatattttcatatttacacaaaacttttgaataaaatgaatgatcaaacgttggtcgaaaagtcaacgacgttatacattaaaatacggagggagtattttttttttctttttgaggtggtcgggccgcgggcgtgccgcctgtaagtaaaggcacgtggaattatggaaatgagatatatatttgcgctccagaaactaaattaagaagctgacgaaagctaaacggaatttgggacatgcaaaacattatcctaccacctagatatatagttacaaacaaacaaattaacagaggggcaggctgcatgcagagatatatgatggaggacatgtacttgtacacatgcatcatcatgcatgcttgcacggctaattaaattgactgaattttctcatctactgctactcactctacagtctacagctctcagtagcagtaacgtgaagaatgggttagtgaagtgtcctaatcaaggattaagcttactccacactctactatgtacgtgctagctctctccatcctaaaatacaataacaataacgcatataaatttaaacagactctgctacttatactttttagataatggattatattaacccggcctctacacctcagaaggtgtacacagtctaaaccacaatcaagagtacataagttatactgattcatagctaaaagcttactgcccaaatttactagagtaattagtcatagtagacagtaggtaccccatgctgatggccgtagtgatggtgtagccaatggtgacgccgacgagattgacgtactgtgccaccgagcagagcctgtacttggccacacctgcacccacaaaatatctccatctccatattagtaacaagctaagtacagtaattattacagtattaattagcagtaattgtagtgattaattaaatttacctaggttggccctgacggcttggccgtaggtgtagttgcgcttgccatggacggggtcgggagatcggtagcagtcggcgaggaggctggagcagaaccaggttatgaccgagaacgccaccagcacggccggcccgatcacccaccccagctgcgctatcgcccacgccagcgacagcacgccggagccgatcaccgccgttattatgtgcgcgctcgccgtcaccagcgtccctgcatatatgcatccaagtgttcgtccggccgccgccattgttattaccaacccattagcttgcttaattagcttagctctagctacctcatccatggacaccggacatacacccacctgtgcgcttctcgcggccgtcgtcgtcgaggtcggggcggtcggcgtagccggactcggcgaggttaaagacgacggtggtggtggtggccaccttctcttgcggcctctccatccccatttcaattcctagcttagctagcggcggccacgtacgtacaggtagtacagactgagtgcgcgaggtggaggtggtaatgggttaatggcgatgggggaggaggaagaggaggaggaggcccttttgtaagcggaggggagaggagagagcgtgtgcgggttgggtttcgcgaggaggacgacgacgagcggtggattttctacgctcaaaaaggcgatctgtgcggcgtttcttgtgtcttttctttgcttctttttttttcttctctcttcttgtctcttgtcttgtgcatctataccgggaaagataactaaatctctactattataaaaattggagttgttttcgtagtccgtcattcgtgtttgagtcggttataaaaattgaagatgtttccgcggttcgtcatccgtatttgagtcggttttaattttatgtttttgtttaatctatatatcttctctatctctatctcttctctactaatataaaaattgaagatgtttttgccggtattttggtacatcatccgtgtatgagttagtttttaagttcgtttgtttttggaaatacatattcatatttgagtcgggttttaagatcgttcacttttggtaatacagaaggaatcatataagaaatatgtttaaaaaaactcacatgctaacttgagacgatcggactcctaactacagctcatgattttctctctctctctctctctctctctatatatatatatatatatatatatatatatatatatatatatatacatatatatcgaagcaaactcccacagcgaataatgtcatcttacctaaaccatataacaataataagattaaaatagacttcacccgttgcaacgcacgggtattttttctagtttaattaacattaaatttctcatagaactacatgtttaaggtggagtatcaccaaactatagatttagtaataaaattatcacaaaactacatgtttagtgaaaatttaatcacaaaacttacatgtttataactcaaatataacactagtgctaagcatttaaactccaaaatctgtagtgttgtggtaactttgttactaaatttatagttttgtgatactctaccttaaatctgtaattttgtggtacatcaccttaaatatgtagttttgtgataatttgatgaaagtatatatagttttatgaaatttattcattaatgtattatataccacttcataaacatacaaatttaagttttacttctataaattataaataaataataataattataaatgtggatgtacgtaagaaacgaggggaaccccatctcactatcacactagctaactagaatatagtgttacctatatagctggaataagaatggaatgggctaacaatatatactacggactataccaacaatgaaatgacaggggggagaaaattagaataaagttaattttgaggaggcattaattgacaagattggagcttctctcttttcttgaaaaatacctgttatctgccgtccattctttatggtctatcaagcatctgaaccaaacaattattgggtttgctttgacgacgcactgcaaatcatccctagtacatcgacatgtttcttcttcctcctcttcttttgttgctagcacttgcctcctgcagctgctacctagctagctatgctccaggtcacctaagctaataaccttgtccgataatactagtacatgttaacaggatttctctatgtgcatatatatgtaatggatgcatgattttcaagcaattcaagtgttaactattaacatagggggatgctaattgaaattgcaaggaatttcggtcacctttcaacctagcaatcccctttgggcacgatgaagaagctagtctggtctagcgggccctaataccgttgttggcgtcttctggtattgacgaggctacggggagtggttggaattggagatgatggtatcagaggagatgagcgcaggtgtatgtgttgcaggaaagacgcatatggggaggaaagggtactaaggttaatgagtttgttatctaattaaaagtgactgaaatttgtgggtgttttcagactagtggttgtgtggaattatggaactaatgagatgtgcattggctatgtgcttctctaaggcctcgttcgatctcctgcttgggagggagatttttgttgcacgcagaacgagaaagctcattagtacatgattaattaattattaactattataaattttaaaaatagatttatttgttttttaaaacaaattttatatattgactttttaaaaaatacaatttaaccgtttgaaaaatgtgctaacggaaaacgagaaaaaagaagtttggaattgaagaatataactgggcctaactgctgaagagtttaaagtttataacaacgatcgacatccgcatgtacgaactaggtgttgtctcctcgtcaacactcgagtcttctcttcagctggggtcacacacttacatgcaaccatgtgctagctagctagctacatgatcagatgatccagtgtacactgttcttgcacaattctcccttcgttttcaattcgcatatatcagcttttgcaaaaagggctagctaagctagcgtaatctctgctattcattctggctcacgacagccacaagattgccccaagaggctagcatttggtacgacaaacagttgacgacaaaaacaaatgtgtttacacatcgatcaacaacttagctatcgtgctccaactttattcgatcgatgttaccatcgatgaatatatgcatatat

SEQ ID NO: 25847 - DNA, 29773 bp, Oryza sativa
  unsure (1)..(29773): unsure at all n locations
gcatgctgccacacgtaaaaagcgactcgtgtctttgtatcttgtgctttacgactccgtgatgtacgtcgtcgtacgtatctagcaaaggtcaaatgttcacaaattactaatttgaaacatttcaaacaatttttgagaggttatgaaagcgctaacaaaaccactcaagacagatacgtggtgatagagcagtgggtggctgggtgcatatatacatatatattctactattatctataaaaaatatacatattctactatctcctttcggaaatattttgcctacatcaaacaaagaaaaataaaagagtacttatcaagatacaagtcctagtattcacaattaattacacacatatatgctctccatatagtattacatcaaggtgatatgatttttctaagaacatttctagtctatacataactaagatgtacgcagtcgaacatataaaatcatactaaaaaatgtgtataccaaatgagagtttctcgagcataacaagacaatcactaatatttcatcttctaatctcaagtcctcaatattctagtggagactggagagtacataaattcagtgactagtgagagtgagccaaaactcctttttgactcttggggcccctgcacgaatttttcaagctgtgcaaaacaatggagaaggaatcaatatcaatcaatcaaattataatccgcacggaacgatcactaaataaagaacattaatcaagccgctcaggcatgattgatggcctaaatttaaagacaaggggaaatgcagattaaaggcgaggaatgaatcatttcggcctgattatatattatgctgctgcatgcaactactagaacattgctgttcctagcttacattattacacaggtacaggatgtgacaagctttatttcgatttacagaatatccgcatacgtatacagtacacgtagcaaacaccgcacatttcttgttctttggaaattggctcgtgggttccactgtatgttgggctatttggttagtagaaataatatgatttttttattaaaacactatcaaaacctcttatttgcaggtactttttagggcaacatattgactccagggttaggctcaactacaaaggcacgatgatgatatcaagctaataaagtatgcatgtcgtaaacttgagtcgacgattacgcacctttacaccaacttcagatagagattctcagatagaatttagtaattgtgggttcttttatcttgtgttggtgtttactagtttgtgtttactttatgttatgttagtgtgtgctgagattgttcatgtgtggactttgtaataattgaatgtaactcgttgagcaaaggtcggaatgttattccattatcttaaaaaaaagaccgagtttttcaccttgccctagttctatataattccaagcatttttttccctaaatttgtaaagaatttgtatggagttaagatcctagacctagagcttgagtcctagctagtccgcttagaccagtggtatatttttgatcttactatatcttttgttagaatcttactataattactaacattaagattgaaagaaaaatagattcacgtatacatatagcatcccacttacgacaccatagcggtggcaactttgcaggcagtgccggattctcaacccctggccgaaacaaaaaaagttgcaagtaaagatcgtgctgagatgcattataccccaccaagtaatgtacacgtggacggccaggaaggcaagattcagatctcaccgcgggatgagattgagtggctcagaatggctctcgatcagtctctcagttacaccaagtggcagcatgcactcatcactgatcgcatcatcagctgcaggaaattaaatcgagcagctaatgtatagtggccggggcagtgggccagtgggacccacctgtcggcctcacgtgttcaagagcgaaaataaagtaaaatatgaccatttgatagccaccatgcatatatatatatatatatatttatatttaagagaaaaaaagggagaaaaggaggttctagcttaggttcttccacgttcaaaaattcattcccatgggtctggacggttgccatggaatgtcctgcctttcttcacctaacgaaccaacatatcgtcactgttttttccgaaatgattaatcatgatgctccccactaccaagcatgcatgtatcaagctcctattgacacgagtaaagctcaagcatagccttcaaattaattaaattgacctctaattaattaatttttgttcaaaccacacttacgtagttatagtgatggagccagcaacaaccgtaaagcctagtcaatgaaagctcctggtgattattggttngtcggttgttctatacaatagttatttgggtagctcagcatgatgtatactgacgacactaatttattcgtaatggctagaacaaacaattgtatggaaatgtgagtatatatatgcatttatataaagtgttcttcaagtacgaaaagttcgattggaatcttgttatgaaggtcaagatacatggaatcacaatcaccttgatctgcaagtggagggtcactactccatgtctccacatcgaagggaccaatttggctatctaagtagggtatgctgccttgacaaagagtgcatgtgtgtgcctttcttcacagttcacagttaccatacattgtggtcttgtggatgagtttggaaccagatcaatgctagctcatacagctttctttaatttttatcttgcatctccatcaatgtttggaatgaagcttcctcctatctagcttaaagctgtcgcactacattgacacatgtcacatgcatggacactttagtagatatgttagaatgaaggcatgagctagcttgtgtgaatgtcaacttcaattctgtttgttactctcggtccattctaaattgtatttatttttagcatgcattaaatattacaatattagaatttaatattttaacataagcatttcttcacctatgttcttgtctcaaccgatcactattatgtctcattttatttctcacatactttaatttctcatgtcccatctcagatccaatcataactatttatcatctcgatcttaatttcttctaaaacttttataaatacttatattttaaaacgaggggattactatttgacgcagggctgcgaacaaattaaatcaaacaagcatggacaactagggcttgagcctcatgcctgactccatgatctccattaattgtaatcttgaacgataccgtgcaatttttgagaatatttaaacttcattagttaaaccctacgcgtgtagattttctagctctgccactatctctgaataatactactgttcatgtgttgaaaacatgaaatggatgggaataaagccgaaaatcctggcacaggaaagtctaaaaagctagctcgatcgatgcaaccagcagatgtgcctgcagccatccatggtggatctatcaatcatgtctattggccggctggcctggatggaattttctcggcgcgtgccggcctagcttcttcgtctaatggattaaagctaccatttggaagatgagataagaatttaactcccaaagattttgagagcaactttgttttgaggacagtgttgactcaaagtcaacgacacaataggatcagcgtatgtacagtaacggtcttgttggtttgaggaatcaaataaccatctaggatatgggtcacctattatgagatcatatctcanatttagntgaaaacgtacattgtcatattttttttacttggaactatatgcttttgatgagtgaagtcgatcgatgggcaaaccaattcccattacatgtatatatatagaccaacctacacatttaattagaatcaagtcatcagttgaccatctcagtacttaaaccaaacgccctaaaccacccaaagagtatatattttgcgtggttgctattgctgatcgatatatatttataatatattttgactgaattcaagtttgggttattttttattgctaaagtttcacgttagactatccttgacaaatcatttctactttgaattgggtaattaaattacaattcactcatataacatagatggttaggcacttatggtgtgcgtctagatatgaagagattgtctacattagactacattgaaaaattactgagatgaaataaaatatataatgtatctatgtgggttttagtccaaaagcctcaagccacctagatccgctcctgccgatggtaacattctctaacagtatgacaagcattaatcaaaataagtgtgtatttttaagttttttaagcaaacattaacaatctctatagatctctctattaattcaaagaaatagcttgcctctattatccttaactaggaagatagcccacgcattcacgcgggcatgtgtcgtatgctaagtttgagatatttataagagcgaaatattaaacggagcacatctaccacgatttcttcataaataataaacgtcggcattaattgattttataattttctaacctattagttttatattgtatcatatttaaataatatctcaaagcaattatttataatcttatttatcatttgaaattaagtagacttattttttagaaaacatgtcaactaaagtaaaaataaggtgtttttgaaattgcatatctattatcatagttcattaaaggattaattaggtggaacatgaagctccactaaatgtttgggtttatatagtttaatatgattgatgtagtttgagaggcgatcatatatgaacatttcatgtagggtgggtgagaggctccatgcagcctaatatgaatacgataacgacgaaatataattgcgcattaatattttaaaaatatcatgtaccatgaatatattcttatttttttattatgtaagatagatttaacgattataactaatagtttactggtttaaaaggcataggagtattgcagaaatgtagtttaaaaattatggttgttttacatccaacgttattgcgaagtgagcgcacctcaactggttaggtttcttgtggtggaacttgcccacctggattcatgtcctagatttgacatgggtatcagtatttacgactaattattctttcagtaggtgacgtacccatcgacagcaagacgtcgtggtaacttcttcaaatctcaaatgtgccggctcattcttttagaggtactaaaggggtagggtgcgtgcagtttctgaaaattcccaatatatngggttgttctggttttagttttatagctaagagagaggaaagggacgctaaaatcaatttgattttttcttaaaaatgtatggattagtgaccaatagctagtccgtagtccgtagaatatatataatccgaagtaatgaagttttttaataatatagttaacttggttctttaattttaaattttatagtaaataatctaatttatctctacttaggctacattcgatctcatggttgagcttatgtagggcacacaaaacgatataggtcattaccacatgattaattaagtattaaatattacaaacatgaaaatagtttttttattaaaaaaatgtatagaatgtatttgcacaacatgcacagtttagtagttgagagagcatgctcaagataaataagggagccaatctgataagcacattacaactcacttaaatttgttacttatgtacttaaaagcgtagattgagccattaacgactaacattctgaccgtgtttagcgagaaaaacatgcgacatatttttagaaaatacattttttatttgtgttttcaacaatgtcctgagtaatattttaattactcattatttcatcttgaactatcaatacaggcttattgatgaaaataaattctatctatactcaacaataatagtgtgaaatgatacatttatttgttattttatattatattatagatctacttttggctgtgtatgtttgtgaaataatatatttttcttatactaccaccttcaccaaatatatgacgttggtcatcaatatataaaaaaaataaatacccacaaaggaggcataacagaaaatccagattaaagagcgttgtttctttcggtagtttcactaaatatttaacgttggccgtcataaaaaaatacagcggaagtgaaaatctaagtttaaaaaaagcgatatatttttttaaatttccagtagtacgtacgtatacagtatttttttgccgtatatagtttcttcttttctcagtgatggttgttaatttgtagagtaagtacgtatgccttctcaaccttttctggtcaattttttatggaaagtgttactcggtaaattaggagggatagattactatttataatagatctaatccaatggtgtaaactaatgggtccaccaacttaaatgaaaatcgagggctagatttttttctttcttctcagaatttttaagttttttctattttattatagcgtcatgtagcagcttgagagcgtttttagagcacaatgtggcagcatgagagcgtttgtaggaagtttaatggacttttagtatataatagatagaagatagatagatagatagatgtacatagacaatgtactccctccattttatattataagttattttaactttttttcttaagcaaaattatttaaatccgatcaagtctatagaaaaatatattaatattttcaatacaaaacaaacatattatcaaaatatatttaattttaaatttaataaaattaatttggtgttgcagatgttgctatttttttataaacctgatcaaatctaaagaattttgattaagaaaaaagtcaaataacttataatataatacagagggagtatgtctactgcgtagcctaccacacatgccctagttgcacaaaatatgatttttgcctatatatgacgatctatgtgccatcatatattctattactcaatcaatcaaagtagtgagcccatcaaagtatataaagtttatatattgggaatattattttcctattatgatacaagacaatgtggctctcacgtgtaaccgctatagtttctgcctctccgacaccctaaaagcttttacactatttatacctcgtaactaatgctcttggttccgccactgatagtgcatgcagtagtgattctactcagcttgaatgagaacatacatggcatctcgatatatctcatcaaccatatatatgtggtagcaatgcaaattggatcgaataaaccgatccatacctaactcgatctgttatttttgacgtgtgggccctgtcatcgtacacattccctgcacgtacacttcttcggccgtgtgcatcccgatcaatgtcgacgacgatcggaatcctgacgtcacatatatagcacctctgttttttaattgataacgttattgactttttgtcacatgttcgatcattcgtattattaaaaaaacattattctaatttatcttgttatgacttgtgagtagttttatcacttaaagtactttaagcgtgatttatatcttatacgtttgcataatttttttaatacgacgaatggttagacatatgtttaaaagttaacggtgtacatcatcatttaaaaaccgaagtatgtacctagaaaccttatcgttgacagtgaattagtgcgcgtatatcacatgagatcgattgccagaccgatcaatgcaaaggtaactaataccttttgacaccagaatattaatgtgatggatctggatcaatttcagggccagaaatcgcctgaaggagctagggagacagcagaatatatgatgaatcctgcagtgactggcctgcagagaacgtaactgaagaagtggatgcactggtccatgcatcgagatcgatcgatcagtgtcgacacaggcagctgctgcaatgcatgggccagatagatagcacttcgggtttgtcaatttggctcatcagacattcgatcgaacaggtcaaatttgcatccatatatggtaccctgtaggtatactggcccttggcaccgtctagaaagccagggcaatacatgcgtatcgcgatccatgtgtacatgtgtatcgcgatcattgtatatacttcattcgtcccaaaactgaaaactgttgattcctaagtttaaaatttgtcgtaatattaaataagttgatttatactcttttattctctttgtcctataaaaacttgatttctagtttcaaatttgcactagggcatattcgggggagttcagattcaagttacatagatgcagaattatctgggattcacacaagctgtttctcagaatctaaggccctatttgaagaagtactttctggccgccgtagcttcttacataatctccacttcctccaaatagtccagattctgagaatttgtagctatagaatcttaaaataaactaaaatccaactaaggcctagttttgttctcaactttttcttcaaacttccaacttttccatcacatcagaactttcctacacacataaactttcaacttttccgtcacatcgtttcaatttcaatcaatcttctaattttgacgtaaactaaacacactatgcttattataattttaagctctcccagacatgccaaactctcctacataggcaaaaaaaaaactttacttttaggagagttacattaattagtaatagtacaaatatttgattttgggataaagaaagaacgacgagtaattaacaggtggaaaaattaatttcggacttaggggagtatgcatactgctactgattaatctgatcccggccggtggcttactaaactatcggatcacatgcatcgcatcagccatcaggtgataacattcgtctccgcaagcttaaaatgcacagaggtcgaggcgccgccctgcactcaccgaccgtcagatcgaccatcttagtacgcatgaatggaaagattacatgttaataaggttgatataaacaattcaccagttagctnnnnnnnnnnnnnnnnnnnnnnnnnncgtttagtaagcgggaggtcttgagttcgactctcaacgaaagcatttttttttctcttctatttttgttcattttgtccctcacagcacttgtcttcacgtgtcagatttcaccaactatcaaaatgtgcatggttgagtgtattccaaactcatcttcttttttttttttttggtttcattttgtccctcacaacagttagtcttttcacatcagatttcaccaattattcaaactctgcatggttgagtgtaatctcaaactcatttgtttccatgtcactgatgacacataatcgcacaacaaaattatgcatccgatgtgattaaaaaaaaattgagcccatccaccgtgcaaataaagatctaaccacttcaaattggacttgtccatgctgtgtccaaatggcaacaattactgcatgccactgaatttcccagagcatgaaatggttgcaatcagtaaaacgttagtggaattagatacccatgtcgcatcgaatcttaaagcagtctgaatgttggacaagtcctcaatctggcctgcagaacagatgcatgctcatgaatcatctcacatcaggatgacaggatcagttgcaatttgccagttcagctccaacaaaccgaggttggtgatccgggaaaaagtttaatgaaaagttgttaatgtccaatgctgcattttgaaggcagacagatgggaacatgtgtgagttggctctgtaattatttcaggtgttgtttgtagtaaactagtattgttcttgctttgctgctagctaatctctttttgaccatggtgcatattgatccatctggttttgaccatgtgcttatatatttcacctcagatcagctcaattagtggtgttgccttttgaatatagattgactaaccttgtagtcaaatattagtggaattggatcttgtcaatctgaaatgtgtggagatgaaagcgcgaaatcggtgtctgttcatacaatacaggctgcacatactttggtcagggctaaatgatcggttttagaatataaaggaagaacagcaactgttcttttcgcgatcggtttttttttttttttttgaaactgagttgactactgaggaagaacaatgaaacttgataattcctacttcctagttttccaaagaggtgggaaacctgttgaagatgacaaaaggtggtcacctaagaggtgatcatttttttcatggtttatctggtttcttgattagttactatacaatatcgtgtacatattctttccggtttcaagctcttcactttgatacattttgcaggtttaatttgttgctttttatcctttgacaattctgtatgagcttatgttctttgctattgcatttgcatgacttggattatgtctatgttaatgggcccaaattatgccatggaagtagcacaagtaccatgattctgaaggcccatcactgcaagtcactgggcctctgctatgaacatgctattcctgaatcttgtgaaccttcaacagttttgggtctcaaatgcacctctacagagatcaaatttttattttaaacacacaagagatcaaagtatgaaagtaacaattttaacagtgtaccgtttggagcatcttgaaacttaccaaaaaaaagtaaggtgttaattgatcaattccaagttgtcagaaacacacctgaacttgcatgtgcttcccatggtgccaggcttgtatgagctactgaaccgaattcaatcaagtttgggtggtccatcttagcatggattcaatgtattccagagcacactaattaacaccattggctctgcaagaattctctgatcatgaattctaacatgttgacttgcatttagttttcttcctgtgccattcccatttctgaaggttgagtacagacatgtttgctctgaattcactgcattcaagaagaatccaaagcttgagtctttggacaagtcattgagatttgttggttaagtcagtgcagggaagtacaaattaaaccattttcagcaaccaaacatcatttcattagagagaaacagtattgttcagatcatctactgtaactgagatgatgcttactatacatgtgtcactaaacattttcagagtcctactttgactatgcacgcagtaaacttcagtgcagaaacagctgaggtgagttgattactgcctccaaaaagcaccacagggtggtctgcagacaatagtacctgcagaaattcagatcttttctctatgtcttctagtttaacctgcatttctagtcatttctatccagttaaatgatgaaaccatgtaataattagggttggtcgatcgtgtgtatctgatgaatcgattgattccactaagatctgtctcttgttctctgaaacaatggcacgtcagtcttcactcttcagtctttcacccacaaattttatagatttttgtaaggcaaaaaagctttttttaaaaaataacccggctttaagactatagttggattgctattattgcagattaatgttggcccttctagatgaaaattctttgcccacaaattaaaattagattttactgaaaagtgaaagtaaaaaaaaaaacaatttctttgatttgtgttattagactgaagttacaggtatgcaaatgtcattgctgaaaacactggtaagatcagaacatacagttatacttatactacacaacatttgtgtgagccacctactagatgctagaagtaaaatagtttacctctcctctctctttttttttcttctgagcatgcagcaagtcatgcatgcaagaactgcacctaggagcttgtgagaaaaagcattcttcagtttctttcagaaaaacatgattcagagccgtaactgtaagcctgtaacaacgggttctatcctctcatcatccttctgagagcagaagagaagagaaagaagaaaacaacagtgtgacagtatgacaatatgggatcaagctgctacatgtaattaatctgtagtactatatatggtcccccattattcataaaaaaaaattctaatgtgcagcatccactgcacaaaaataaaaaaaaacacaaacttcagttctggaccaccaaaaagcctcctttttttccccacaaaacactgtggatggattacagaagcagtcagtccaaaacacatcaagaacaaacaaatcatttaaactgatctgaagtagtagttctgaatctaacaaatgtattgctggagcttggacagcacaaaagcatcagaaactagtagtagtgtcaagtttctaatgttgactgatcagaattaagtagattggtcagtgtgaccaacttatactcagcttgctctgaactttctgatgatagctgttgccaaacggcagtgcataagcaatcgaagatctgtgggtgcgtgtgcggtgagccatgatcttatcttgaaatcgatcttggcctggctggctgaatcaagaattgctccaaaagacatgaaaactgctaataatgtaattcgagtacttgcagtgatcatcgatgcatgcatgctcatctgtaaagtgtacatatggcagttggtgcaatggcttttcagtggtttaattcatggactcccttcaaggaggcagcctcctttgctctcaatcaatgtgaaaagaggatagtggaggataatactcttatgttttaactactccctccgtctcaaaatataataatttctaaaagttttagcagaaattaagagattaaggtgaaattaaatcatagattgttgtgattggttgatgcgaagaagtatgcagagaaattaaataggagatggtagtaattggtcgagatgagggagtaggtgaagaagttactatattttgtgataaattttgaatgatagaagtcgctatattttaagcggtgtagaaaggtagtgtgagatactgcaaattattagggtattagagaatatcacaaattaaagctaaatactattggaccttcatgtgcctctttaagaaccataaaattgctctttttaactatggtagaagtaaatagtgaccaagataggcttttttggagatcacaacattaggtttaggcttgttggttagatttcttgtcacctttgcagtaggagtgccatgttctcttcataggacgacaagaacatcaagttggaaaggactatgataattgtgaaattgcagatgctcaggaacccacttaagaagaggaccctcaagttggtgtgcatatatgtgtctgaatgattgagtgatggataagattagagcagttgtacggggctaaacacacatggtgttgcttccttgcgattgtgaccggggagatctgatgctgatgacatcatgaaaattttcccaatttgcatcccaaaattttccaaacgaatggttgccaaaaagaaaaaaaagaaaaactgaattcatcttgttctttagcactgatgttttactgaagaatttaccacaaactcaatattttttctgctaagaaataactagaatgtagatagttcaaggatgtgtttatggaccttatggtcagggaggcaaatgtcaaatgtgcaattagttagtagggtttaggtagagttgcagttggagccttccaggcttctctgaagaaaacagcagagttgctggtccagcatgaaaagtcaatgacatgtggggcccactttggagtgagagaaggctggcatcagccaccatgctatcatggatcttacctcatgcacatctttccagctcacacattttgacctctttacagagatagtagtattgggcatctgaaagtactcctaagttttatcaagtcaagatgctgagtgtgctactctgatgaatcctctctcgctttcacttcactttaaagttttgctcccatactgctgacctgatcctgacctgcaactctgcaaccacaggttggtagttagttgttgttattgttaactgaacaaaatacacctgtttgatgttgtaaagtttcactctgaatcttgcccaaatccttttgcaaagccttcattatgctgatcattgctattggagatttggagtgatttgaattagtatagccagcctgcagtagtaaactgcattcgaaatatgatgaaccattaaaagatgagtaacatgcagtaatgtattcggtaaaagaagaaagaatggtgaatgagtatagtagcataatcttcagtaaattaagctaagcaagcaaagcttaaggacgaaagcattaatatcacccagggtacatttcaacagtcgaggagaagcatcttatacagtggagaaagggatgatatgcattaactggccaaatctgaatgagtggttcttgttcaccagatgtgaaagtacatttgttctttgccttcagacttgaggtttttgagtacaactcttgaatgcaacacctgctcacttcagcagtttacactctcaagtacagataacagaacaccttgataatcatgattccacagttaaaaggttatgctgtcacattggatggagatagcatttgacattttggggctcagattgaaagaaaaaaaaaagaagctaaaatggattcagataactaagctcttaacttcctacaaagtttcttgattgtagcaggaaactggaggttaagaagcttatatttacaacacaaatacctaagataccaaagatacatgccacacaagaaattcagtggcctacaatttccacaccctaaatgcgaaggcctacataccacacaccctaagcattccagattagaaacccaaacttcaccaaatcaaactgaactgtaacaatttagttcagcatttcttcatatgctgatgagatcaggtggcggtgaagatggtgagtttagctgctgctgctgctgctctttggcttcattggcctctgcagattcagctggcactacaagatcaaacacagcaccttcaccactaggaggctcctctccttgcttcgatgtcggcttgggaagctcactgaggatctgcaccacctccctcattgtcggtcgctgcacgctctgctcctcgacgcaaagcaatgcgacgtagaagacgtgcatgacctcgtggaccggcacagttgagagcctagggtccaagatcttgatcacatgttccttgttcgagtccgtcatcgtcttgacccactgaacgatgtcgacgccatccccaaactcccctaccggcttctttccggtgatcagctcaaggagcacaacaccgaagctgtagacatcgctcttctcatcgaccttgagcgtatatgcatactctgtaaatccacaatcacaacacagtgcatgattagccaacttgaagacatcaattctcttctagaatagcaagacaattcttaacaagttaaaacaagactacaacagaaacacaatagtggtatatcaaaatcaagcgaatttaaaccatatacgaaggcagcacaaatgaaccaaagatcaatcttttacctggagcaatataaccataagagccagcaattgcagacatgcactctgatgtgccagagtcctgcaagaacttggcaagcccgaagtcagcaacatgcgcttcgaaatcggagtcaaggagaatgttgttcgacttgacatcgcggtgcaatatcggcggtgagcaatcatggtgcaggtagcagagccccttggcagcctcaacagcaaccttgtaccttgtgtcccaatgcaggtggccacccttcttgccatggagtagctccccaaggctgccattgggcatatactcgtaaacgagtaggttcgtctcattgttcgagcagaagccgagcaacctcacaatgtagcggtgccggatcctcccgagcgtctgaatctctgcggagaacccgtgatcatgggaggaaccacggctcatggcgggaagccgcttcaccgcgacatgttcaccatccggcattgtccccttgtacacagtcccagctccacctttgccaatgatgttctcctccttgagactatcaagcacatcgtcgcaggtgaattcgaggcgctggaatgcggtgagcttccaagcacgcgcctcactcgccttcttcagtgatcgggccttcaagatcgccatggcagcaaatgcaattgaaagggcaagcaatcctagcacaatcagcagcttgaagctattggagagtccaccatggctgcggccgccatggtcagtgccgggagcaccgggatggcatggcccgaggtacggcccgcacaatcccgggttgccgacgaaggatgtggcattgaagtagctgaattgccctgtggccggcacgagcccggacaggttgttgtacgagaaatccacggcggtgaggctttgcattgcggcaatggtggccggaatctcgccgtcgagctggttccttgacaggttcagatagttcagtatccgcatcccagagatggccggcggtatctcaccggagaggttgttcctactgaggtcaaggtaggtgagcagccggcatttcccaatctccggcggcacgccgccgtcgaacgaattgccactgaggtcagccttggacagctgctgcagccggccaatctccggcgggatttcgccggtgaacgcgttctgatcaaggagcaatttctgaacaccggagaagctcccgatgaacgccggcaatgctccggtgagctggttgttggagaggctaatctggccaagattcggcgcgccggtgccggacaccgccgggaagccgccggagatgagattatcctggagctccacctgagtcaggttcgggagctcgaagagaccctcggggatggagccattgaggtagttgtcgccgaggcggacgcgggtgagcgacgtgcacttgccgagggaggcggggatggcgccgaagagcgagttgccgagcgcgatgagcgtctccagcttgccgccggcgcagaggtccggcggcagcgtgccggtgaggcggttcgacgagaggtcgagcagctggaacctcccgttgcggcccagccggcgagggatcccgccggtgaagttgttctcccatagctgcagcacctcgaggctgggcaggtcgccgacgaactccgggatgtcgcctcgcagcttgttccggaacaggttgagcagggtgaggttcttgaggtcggcgaacgtcgccgggatctcgccggcgagcgcgttgttggacaggtcgagcgagctgaggctcgcgagcttgccgagctcgcgcgggatgccgccggcgaggccgttcacctgcaggaacagcgtgtccaggttcgcgaggttgcccaactccggtgggatctcgccggagagcccgcagttggcggcgtcgaggcggacgaggtcggtcatgttgccgagctcgggtggtatcccaccggagtagctgttgaagtagccgatgtagagctccctgaggctcgtcaggttgcctagctccggtggtatcttcccggagagctcgttgccggagacggcgaggtactggagcctcccccaccggccgtactcgggcgggatcccgccggagaaaaagttgccgccgaggtggaggtggcggagctgcgccatggacaccacctcgagcgggagcgcgccggtgaggttgttgttgtagaggtcgagcacccggagcgcgcggagccgcgacagctgcggcgggaaggtgccattgaggccgttgttggagaggttgaggtgggtgaggaacggcgcgaggcgggacagcgccgccggaatgggccccgacagcgcgttcgcggcgaggtcgaggcgcgccaggtgctgcagccccgacagcgcggcgccgggcaaagccgccggtgaggttgcgcccggacacgtcgagccccaccaccgcaccccgcgcgttgcacgccacgcccgaccacgcgcacgggctcgaggtggtgttcgtcgtccacgacgcgagcgcgcccgtcgggtcgtcgagcgccgccttcaccgcgaggagcgcgtcggtttcgccaccggccgccgccgtcgccgccgccgccacggcggcgaggaggacgacggcgaggtggtggtagtgaaggcgcattgcgcggcccggcgtggcgtggcgcggcgagtggagacaagagagtgtgaggagagtgaggaggcaaaggtgagagctttttggcaatggagtcgtctcctctcctctcctgctggctgctactgctataaaaaaaacacatgtgattattttattttatttttatttttatttttgctaggaaaaagaaacatgtgatgttttgttggattttatgcttgaatttttactctctttatttatggacgttttttcctcttttcttgcataaagtttgtgttcttgttttttctttttggtttttggctggggatggatggtgtgttgctgttgtgaatttgtactggtgtctggtgtctttgagtgtgaaattgggtgttgttaactttttaggatgggacagacaagtgtagatttgtagttcaagtgttatttatcaaaagttgcttttctgaggtgacactttttttttcctttttgttgcttggctaaatatttggctgccaagtttcaaaaaggctaggtagcatttgtcaatagtaaccttgatttaaggtggtgtttggattcagggacttaactttagtctctatatttagacactaatttagagtattaaatataaactacttacaaaactaattacataaatgaaagctaattcgcgagacaaactttttaaacctaattaatctataattagagaatgtttactgtagcatcatataggctaatcatggattaattaggctcaatagattcgtctcgcgaattagtccaagattatggatgtgttttattaatagtctacgtttaatatttataattagtttccaaacatccgatgtgatagggacttaaaaagttttagtcccatctaaacagggtcttagcttgattgtgatcaatctaaggtatattattttttataggaaccttgcaacaattattgcaggattatgttggagctagtactatatttgtgtttaaggtctttgtttttaaattgaggttgttatgactttgtggccattttagacatgccgttttggcctacaatttcccctgacaaatgtaaattatcatttttctgaagggctggaaaaacaaactcatataccatgatctcatccctgaaatataccatgaacaaaacacatcactttctaaactaacaagacatcattccataatcatccttagaagtttagaacatgcacttaaaagagacaactgcatatttagtggtacatgcaagagccattttcaggggcagatatccaattaaaccctgtcaaattcatacaacgtccgggtcaggtaagacctcacatccaataccagttatcatcggcaaattcaacataactaatttttggagtggtatatgacacgcccaaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccagctccactcccacaagcagctcaactggggtataagccaaacgccttctccttctggatcctttttctttaactgaggttgattgattattgcaaggtgagcatatgacatactcagcaagccacacagcaaatatgcaaatgcacaaggataccaaaggatggcataatatagtctcatttgcgaaagcaacatttagcaaagagttaagagtagtaaaacaatagagtaattaatcagaaattttaatcaacactgaacagcacacccatgctgcacaggcccaaccatcctgaacaaccatacccggctgtacagatctaatctccaaaccaggagctaagcaaattattaccaggtataacatctataattattgtgagaagtgtgagactaatcacgaaaaacattgctcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacattacccctcgcataacacaatccaccgcagcgcaccattcctgaatcataatcaccccctcaaaaaccagaggcatggactccccagccacttctcagtctggtgccccacaatgaaccatgctatacaaaaggtaaagccgttgcccacactggcttgtggttggcacggttaatgtttcacaatagtagctcgcgaaccggtccttaatcgtcatgagcacgactttcaaaaccatgtgctcacaacccacctttaccatattttagttggcaagtaattatttaaccaatcacgattgaccatcgtgaactatcattaatccatcattaaataatagtgaataataagttatcccaatagtgtgctaatgtttctaagcatggctaagcaatcatatctaatatctagctgaaccaatatatatagctcaactagttaagttataataacccaagatatcaaggaataaagtaatcaatacaaacaggccataacaaaggaatagattcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcacaacgacggaaacgacaagctaacacgcaaaacgaagaaaaagactaataaaaaccaaataaacaatacataaaaagtaaacaaacaggtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttacaatgaattagttatgaattttcaaagattaaatcggattaaaacctttatatggattttaattgaattatgacgcaataatgaattatttttgaaaaggaaaaggaggattattgcgtcagcgactagggtttgcggtggaccgggtgcacggcagcggttcacgggaatggacggccgagatcgatcctatccaaaacggacagccgagatcaaacggtccacgaccggctcacggggaacggcaacgagacgtcagcgatgacgtcagcactggcggcggctcggcaacgcaagctcaccggcgaacgacggctcgacgacgcgaacggaaggcaccaacgggtagagggcgacgcggcgaactcaccggtgaccaaaaccacggcggaagagcaacggacggcggcggcgacgaggaagaagcggcggcggtcttcgggtcgacggtgacgacggtgctccgacggtcttcaacgacggcgaaggggcggacgaggacggcgacgacttggcgatcccgacggtggccttcccgagtgatgacgacgaccgaaacgacggcggcgcacggctgaagcggcggcgacgacggcgacgctaggctgcacgaggctagggcgctacagacgacagcgagcaaaggcgagggtggcggcgggtagcggcggacttggggatccttttataggtgcaaggaggcggcggcgaaggcccacggcgaccggcgacgagaaggaaacttcgggttcgggagagagagaggaatccgattcgatctcgaatccacgaacttccaaagcgagatagacgatgattccaaaagagaaaaggtagaggagatcccgaggatcatttcccctctatcattcggccggagaaggaaaggatcgaccgaatttggaaagcgacgacggcggcggcgctagggtttcgggcggcggccgacgcgaggaggacgacggatccgacaggtgggacccacctgtcagcgacggcgagggcgcgcgcgcggctgcggactgggccggctgggccgggggagagagagagaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagattttctcttctaggcttttaaaataaattctaataattccaattaaacaaaaatttatatatttgggatttttagggtgtgacagtatatcatttatgtttgttcatcaggttcaggtttagccattgtttccaagccgaatccaatgtgatccattaattctgatcatgttggtagctgctagctatgatgcaaatttggcattttgacagctctgtcggctaacttcatacagattcatgtatacatcttgttcattaaagtttttatttctctaccaacatctttgactcggcagaaatgcaacattgcattgtacgtataccagctaggtagattccttgtattcctccgaagaacagtgctgtatagtagtgcatcattgtacattaaaactccataagggcgatgtttggatgcagcataggaaaaatataagactagggagagagggagagagagagagggagggagggagggagggggacatgtttgagatagctgaaattgatggataatttatttttttaataactatttgagggtactcataaataagtgacttaactactacaaagttggaaaagttactttagaaaagtatttcaagaaaatttcatataatttttgtacacgaaatacattgtttaggagcttaggaagtgagcaaatgaaaatccaaaatccatgtaaacgaagaagattaattttctccaaaaatttctttgaattaattaaaccattttggagcatatatatgacacatttgtgtgttctaagacctctaaatagaatctctcaacctatttcctttatttcaaagagccatatataatcttcaagttttggcttttccttggaacactggaatttcacagcaattttaagagaactttgtgttcctacaatcactctaaaataacaaattagataatcactcgttctatctagtacctaacatgcaatgcatgatacaagtgagacgaagttcccacttgatatcgaacaaattctcacaagttagtcacaaaaagaacacgaacgtgtgcttggaagcatgaaggtcatcattgtaagtaactttgtttagtttaatgttcttactcgtaacaaagcatacactttctgttttataggttccttacttgagagcatgcacgcttctttttttttcttttcttacagaaaaagagcatgcatgcaagcttgatgactcacaaatgtatcatctttttctgctgaagcttcgacgattgttagctattggacactagcagctgcgctctgcctcattgtatgttgtgtttgaactgttagaataggtgtcgaatatactagtcttatttggttacagttagacttggagttataatatgtgttaggggatggagttagagtcggactctgtaactcagaaactctcttaaatagagaggggggcaccacaatgtaacgatggcatctacaatgtagcgtagacacgcaaggagatgatggcggcgaggccatggactcgtagcggctaggtgctatattggttggggaggagcgcccataatcaaagcctcggggatgtaggcttcggctgaacctcattaacaaatatcgtgtgttcctgtgttgtcatctagcgtatcttagatgatcaataattaaagcgatctagaaggttagtcatcgttccgctatatcgactaacttttataacatgaactaacatcaatttatcccttcaggtctcaactattacatttgtcaaaattcaccccaatttaaaaacgggtactagacacatcttaactcttaaaattgttcaaataacccctcaattcaaactaagctggtttttatctgttggtgctagcatgacggtacaatcgagagacccaggcccagggcactctaggccatggctcggggcctacggctaagaacccatgaaccaacattgattttcgcttgttaagctaagttcctagaaaattaccacaagctgacccgagatttgctattaggccatgtccgcccttaagtacaatcagacacaaaaataaaagaaatttatagacccacctgttagtgagcccttcatctcctccttttccatttgatatgcttcttccttctccctcattgtcccttctatgttgttgagatctccaatgtgtctctcctccaaggtactacctccgttccataataagttcatttttagctcaatcaatttatctcaaaataaattcgtttttagagtaatcattgcatctgggtttgtgaaaatagagaatatttgtattctgagtagacaaagtgatgaatagttgtattaggatttgttaaagtaaacgtattctagtcttttttattttgtattggtatatatgtaagaaagatgaaaaataaacttattttgaaacagagggagtttgtccaaggcgaactcagcttgccgagatcggcgaccacgaacgaagatccaagttcctccaatggattgttaaatatgtgatctgaattttggacccacagtatatccggattagttatctaataggactctagtttataggattagtttcctattatgactcctagatttctcctatatatatccttgtaagccttacggggagggtgcgatagcccaatgtatctcttgcgtttgtatccaattcctctatagtgatcattaccggccggcgtgtcggagcccaaaactaataacttggatccaactgagattaatgtatcaatccctggatcagtaaaaattgatacatacaatataactggttcttcattgcatacgttaaagtcttacaatactaagggttttacaataataggtactcacctatttaattagtacacagcggaagtttctatacattctgactagtgaggtataacctttagggattttctaagttatcggggtcttcgtagtaataatcataagggtccttctcttgacccagatctgaaaaaggggttattaaagccaggatgagtattcacaatactcagcaagttatcacggaattatgttatgcattgacatataatagggttctttgcaaaaagcagtattggacaatctggaaaacattatagtagaatttataaaacataaaaactttagatttctaactagggtaccatatgagtcccggtactcaactccatgagtacggctattcgaatagttttgtagatattctactgcagcagatgtacgctttacccgcagtccacgacttgctgataattatcggctttagtcatggcccagcattaagtcattaacaattattgcacctgttccatgaacttatatcctcatatgctctgaacgtaatgttaacagcaacaagaggagttctggcattcccgaggtatttaaggggaactgatcgtatgacaccacgtcatcttgatcagggtttagaaatataccatatagtttatactcgagtatcacaaaccatttacctgtacatggtaatggttaaagttgcctttcgcggctatagttgcctcctgcgcgaggacttaaaaataagaaccactatacataggtgccatattgccaattaacctaataactaggtctgtccccattctagaaactgcggtcgtacccgttcgtttgacataagtacctggtaaaacttatatcgattgagacaatactagccacccggaaatcatccaaatcttacgtattgtcccaatctaagtatagggtattttaaccagattgtaagcaaaataagcaatactaaattatctgggtttctatgattaatttatgcatagaaaatagaatattgaatagaaggctataaataaataatttgtaaaatataggcttaaatgatcaataggtatatggtaacttgccttgctcgatgtcctgagattgattgatattatctagagtgtcaaaggaatccttaagacctagggttagacatataaaattcaaattcaaaaaggagtttaaataaaatctaaaaaaataagaaaaatagagaaaataaaataaaatgcaaaaatagcaaaaaggggcccaaaagatagagaatgattttaggagaatattggtccaagtttcactgaaattggatttatattttaaaagatatgggcttctaaagtttgaaaatcgaataaaagtgaaatggcactgtgtgcggtcccacctgtcagtctctctctctctctcttctcttcttcaacctccggccgttcccccaaaagcggccggcggcgctagggtttgggattgcggcggcgttagagggagaaagtggttgcgaccgaggaggggagggagctagggatctccggcgatggcgagtggcggcggaggagttaatttgaggtgtggacggcttagcggctagggccgcggtggcacggttaggccgagatggcgatcaaggtgataagagttagacatggctaggggaggggttctagagcatctacgaggtgtctagagggatttcgacagcttgccaacctttagcaaggcgcggagcatagttgccgacgagcgcctccctaggcggcggccgtgctcacgtcggcagctcagagggtggcaagatagtgcaaaccaattgcaaaaatggactctaggtggtatgtagatggttaaaacggaaaactcaccgagatcggttaaacgacgaattgcggccgnaanaacttcgcggcggcgaagaacagagcagtgcgagggtgncggtgctcggcttggtcggcgaggtaaaacttgacccgtgctttggttagggcttattatgctagaacatggtaggatataggtgttctaagggttatttaggcgggaggatggatagagaggggtggagtcgatcgcgcacaaggtgttcgaccgacggggatggtggttgatgaaatggattggtgaggcagagctttggggttgtggggtgatggttgttgatgatcgatgatggacaaggaagggattggggtcctatttatagggctagaaggagcggatgagctcggacaccgtcatcgccatggatgagctcgaccttaggatagggctggggtggcaggggctgtgagagggcggccaagatcaattttagtggtgagaagctacgttcgaatacttaccggcgaaggattgacttgaccgcggttggaattagctggcgacgtgagggcgccaatccgggcgcgacgcgcggcggcggcgtaggtgaaaacggccggctcgggggtgaatggtttgaattgtgagaggggaaacccctgtctattctcaattcaaccgtgcggcaagatttggcgcgattcaccccaggtagaatcaaaatcgcactcggcagcggcttggacgggagcgcacggcgtcaagcggcaaattctcgcggcggtcgttgtcccagctttgtcgtagtcacgattggtgcggtggcggtgggctgagggcgtcggacgggcgacggcgcgccaagacagtaaggcacgcgcaagcggccccgaggccgacgtgcggcgaaacggcgcgcggctaagtcggatgcccggccggcgcgcgtgaagggaagaagaaggccaactaaaccacggtttttgagtgggttgtggtcccctaggatcaaatctaaactttgcacaagattgggtagttgttaggctgctctagctgggatgggcatttcatcgagcaccttatgtgcgatgaacagtgaatttcagaatttttgaatatttccctagaaaagatttaaatttaaactatcaatttgcaatttggataggtttcactagggtttggagtaaagtaaatcctcactaatattagggtaagctaaggaaataatctatagtttgaaatttgagagaatttgctcaaattcactaaggtttggaataaagggaataattagagtaagttagtagggttctaaagaagtaatacttgaaccaaattaagaatcaaatagatttttaaaacacactaatttaatcaaaagccagcatgatgcagtcaaattttagtttaaaatttaaggatgttacacggcgtccgtggttttttcccgcaagggttttccacgtaaaaatttatgtcttcgttgtgcatctatttcataacaagtggtatcaaagcattggagatcgatctaataccatctcggctgccgacgagttcgtctgcttggagatcctatctgcaagttttagccgccggtacgctcgtcgcaagatttgatcggcagtagcaggcgcgtgtcgtcgcgttgttccatctatcgctgccgtcagattgatttgtttgccgagataagattaaccggtacgaagcggagtcacccgtcgactccgatcgggatttggtgccgccgtgcagcgtgttggagaaaaagcagcaatccatctactccagcacgttgatcaaggaaagaaaaatcagcagatgcactcagccttgttactgttcatgtgaattgaatttcacgttggttttgtgcgcgtgcacatgccccttcgtaccagggattcaattcaattgcggtgcttcggttctgtttgggtgaatcaaattcaggttcaattttgtgctatgttcacaagccatgtttaccaggaagttgtatacggagatcaacttcgttatatgcacccagagtgtttcgcgtttctgctagggtttgtcaaattgtaccagcagattcaggattttattcccaaggtgagtttgaagtttgatctactgcttctggattgagatgcaatattctcattatgatgagcgaagtttcattatggcaagtgaagttttgcagcggggtatttacctaggaggagaagtatgctaaaaaaaaaagagaagcacattcaagtcatcgagagggagtctcgctcctgtctagatcacaaggtgatcaaattgtccggcgaattttgctaccattgtacccaacatacaaggaggttatcaggggatctaagtacttcattttgtgcacaagaatttttcgcgtttctgtttggattccagaaattaatgccagcagattcaggattttattcccatggcgagtttgaagtttgtgcatca

SEQ ID NO: 25848 - DNA, 1083 bp, Oryza sativa
tttcctattaggactcctagatttctcctatatatatccttgtaagccttacggggagggtgcgatagcccaatgtatcccctgcgtttgtatctaattcctctatagtgatcattgccggccggcgtccgtagttttttttcgcaagggttttccacgtaaaaatttgtgtctccgttgtgcatctatttcataacatggattgcttcacaagcccgccatcctcttcaagctcctccagaactatgtgtcacctctcctagctctagcttcaccttccttgacaagttttgcctcttacgcctcaatatcgatcccacgccgtctgccacagtggatgaacttggtcacctttccataccttagttcttggcctctagtgtaattgcccactatgacgaagttaaaatcgatggtgatttcttaaacttctcttcatttttaagttgacggtgatttttagaaaaatgtggtagttgaaggtggtgataaaacggctcttatcccaattttagatacacggactgtaccatgacctgtaaaagaaaacggaggtaacattataaataggtaaacatgttgtgtgcaaattaaaaagctaggcattccatgcaatttgtcaagattcgagattgcccgtgcaacggtgcaagccagcaatcgcgatgagacatggcatgtgagacaaaaatatttggacacgagtttttgtggctatatatgcgcgactaattataatcaggtcgtcttccctgtagatcagggctcggtctagtgagcaaatcgatcactgtaaacaaatgtcactaatatgttagtgaagtggagtatatgatgcagtccccgttgatgctagtagagcaacagactataaaccagctataaatatattttaagaagataaaaaaaaagataaaagtagcgggctacatacttatagccagctgcagcacggactttaaaacgtatgtgtgtatgatatgtgggaccagatattgattgtgtagtatatttatatataactattgtgtaaattgattattaagttaactatagatgacatctataaagttagaaattggc

SEQ ID NO: 25849 - DNA, 4696 bp, Oryza sativa
cccctacaccattcatcatgtactcccataattaattaattgagacctatttaagctaatggtattattaattatatatttgattagtacattggagtacgtagaattctactgttgcaaaccacgccgatgcgtgctatcgataggagtaaaatactgtccgcgaagtctgaaacttgcacagtctttgacgcatgcttgcaggtcttcagaaaccacaagttcagaagaacccatcatccggccggccattattttaatctgccaatattccgtacgctgtcaaaagaagaagaaagaacagtcgaacaatgttgtacagctcgatccgcagaatcgatcagagtttagtacttactactataattgtttagcatgtagaattgattagaagtaagcactaaaagttcagaggaagtcaaggaagttcagaggaatcaattaacttgcagattaattcaacaaagctaccagctgatatatgctcctaatgatgatgattgccatgatcataaactttagattcttccatgctccatggtgaagtcttaagctagtttggctgtttatattagggcctacacataggtcctgattggatccggagggctatttaatagttcggaggatccaaacaaggccatagttaaagttcagaaaaatgattgtccttttatctgaagaagtatgtactactactgttgcatgcaatgaacacgtacatgagagagtagatggatctgatcgatactgctactgatcatccagccttgcaaattatccaaggacaggacagggagacagaaaccaatcaatcagacgagaagatttgcgactcgacgaacggccggccgccatataggcaggattccaaacaaggccgcggtgataccgttgggttctcaaaaccgcgcttttaatttgattcatctgctcgccaattaatcttccaatctttgatctgtactgctccaatccactgttcgtatagtattaatttttagtaatttttagctcgccttggctacccatcttagtagagaagtaaagagagagaagaatggtactcttctcctatcataaatactaattgatttagcataaatttagatcattttgactggtactttgatacgtcatccctgtttcagtcgatttctaagtccgtttctcttttataaataagaagaagtcgtataaaaatctctttaaaaaactcgtatgctaacttgagacgattggacttttaattgcagcttacaattttataaaaaaaatccaagcgaacaacagtaataatattaaaatagcccttcacccactgcaacacacgggcatttttttctagttatgataaatataaaaggttttgttactatggcaatgccttcttaaggtgaatctctgtagtgtaacattttgattttatcacaagtcaaacctctctgactttaatcttgtttatagaaaaaaacatcaacatcaacacatactaaattagattttatcaaaaccatcatgaaatatgtcttgacattgtatttatctgttagtgcatttttctataattcagtcaaagttagagaatctcactaaagacaaaaagaataattttcaatatgaaacagatgtggtgtatatttgataaactattgatcaaatgccaaaatatttataaccacagtaacagaatagcagtaaggcaaagccatacgatacgacgacagtcagcatctatcgtttgacccgtatataaatgcatggtacgaacgctaaaaaaccagcgttactacttgatgaaattattgatcagattggcagtagctaggcatgctttcatttgatgggtttttttttttactggcataggattcgccggagttgaggtgaaacttgtgttctttgtacggcgtgtccggccaacaaaagatgggcagcgttgagagccaatgcaaggcaaaagggttgagtttttatcggcagatatggaggccggaatggcgcagggcggtcggtcggccggccggattcgcgcgtcggagcatgggtcactactcactactgtagtcccttttttccctctgcaaaatccagccctgcaacctgcatcattcctgctctcatgttctatggcttcttgctgattcgttcaaaaaaaaatgcattgtactacatttgtagcatgagtctagctctgttttgaaaacgcgggattgaaaaaacagatgaatagaatttttttttaagattttgctaggaatacaagtgcaaaatataaagttccgaaaacggaatgatcgtttggttaggagaaaacgtaggaatcggatagtaaaagatatagactcaaagggaattttccaagaggttagagctcttgctaaccttttctccaaaatctctctctctctctctctctctctctctctatatatatatatatatatatatatatatatatatatatatatatatagtaaatttgtttggtgctccatggtgcccgggcaccattgttgaaattgagtatatacccaattcaaatgagtatgaaacttttttaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaaattttgaaaaatttgagtgattttgtgcattagataccatggtgtccgggcaccatggtgccccatatgagtgtcctatatatatgtcattccataggaacttcaaaggaaaggaaatgattcaacccttataaaggatttcataggaatttttcatataagattgaaatcctccaaatttactatgtttttttttttacaagtcaaaggggtctagtagttagaataccttatagctaaaaaaaacagaagaggatattaagttacatgcccagatagttcacatgaaggtttaaactgaagcataagctgagaagaaaagatagacaatttacttgtatttcaatagaggacgatacattgagatggatagcttaacatattacatatctgacaataaaaaatggccttccagaactgttgttgatacaaaccagaagatacaaatcaaatttcaaatactgagatggctgaatatggcggcccttgttctacaagttgggtcatctcagatgttgaggtaaaagatatcagtgattccattagacaaaatggggtattgcatcagcttcacagagcaaactacaagcctatacatctgctaaaaaaatatggttacatcattttgttttggcgtcacaggattgtgtacatactatcttctaccaccatctttcttcgaaaatatgcgcaagtttgcagtctgccggcgccattcatttatagggacctaaattcagtgggcacagcaaacatttgtgagtgaaggaaaaagttaaacatgtaatgtcatagctataaaatgaaaggcttactgctggaaacccgccatagtcaccgggtttctgaatatcctttgtcaccgaactatttgctgcaagccgaacctgtaaatggattgaggaaaaaaaaattgaatggttaaagggcctttagagttggtcaaggcttaaaagaatagattgagcaatgtagttaaatttgtaatacagataaacacaaaactgaatagagactgaagtagtattaaatcatgttagcaggaagctatgaaaaaagaacagagatgggaaaacagcacctttgaagcaatggagacgtgatcccgaattgccaccctaccacccaaggttacatagtcccccaatctgttgatacatgccaatgacacaagttactaaatctcaaaaagcaggcaaaataaacatttagtcaatgagatgaaggaatgcatacgttgcagaaccagcaattcctgcttgtccacaaatcatgcaacactttccaattactacattgtgaccaatctgcaagaggaactgtcaatttggacaacaagggcggcggaagtccaatcacattaagcagaatatccaatacctgaacaagattgtcaattttggtttcatctccaattactgtatctctccaactgcacttagtaaataatgatgaaaatttccgctcgcgggttaggttcaaccaaacatatattcacaaagaaagagctgatattacaaaatgtttggtatatttaaatcaaccatggagtggccaaaggaacatttgccatttcaaggctgacaaattacctccctctgtcaatacatgtatttgcacctatctccacatgatttccaatttttacatgcaacatctggagaagcataaagcttttcaacatatagccatatgatgtttcaattgaatccaaaacaaaacatctaaatacagtctatgagagtgatagtcatcaaacatttgtatcagaagtacttctcccatgtcactggcattttctcagtttcttttttctgtatctctgataccaggtaagcacattgggtgaacgtgacaaatgaaggactgagcatttccttatccttttaatacaaaatgaacc

SEQ ID NO: 25850 - DNA, 9128 bp, Oryza sativa
ttgggcaaaagtagtgaaattctgaagacagttcacaagttgagaattttttttcctagtttgacatgtgtgcaggtagcagaaagaatccaagattgcagcaatcttgctagttactagtaccctcactggcagaaagagtccaagattgcaacagtcttacttatccctcactgcatcgttgatatcatgtaatcggttgagaactgaatacatagatgtatgctcaccatcttgaccaatgcaggcgccattgtggagagtgcagaactcgcccaccgaacaattgctcaaaacaacattgtacctgcacacacatcaacatcaagcacactcagctcactaccagcaaaatcaaatcaccaaatcaaacagaattcccccctttgtattcagatcgaatcgtagattagaaacaccattaccagatcctggttgactgaccgatggacacggagggcccgaccacggctcccgagccgacgacgacatccttgccaagaacggcgccggagtgcacgacggcgccggcctccaccaccgcggtggggtcaacggacgcggccctgtgcaagacgcccccgccgttgtgccacgggacgaactcccccgaagcaaccgccgcatctggaaacatccaagaagaagctaagctaagctaactcaagatcaagacgggaagcatatataggagaatataagttgattgctaccggaggaagcagcggaggcgccgccgaggaaccgcgcgaggcgagcggcgtggcgcggtggtgcggagagccggaacaccgccgccgccgccatgggagccgcggttctgcgcagagcggccgccatgtctaacaacggcggcgattcaaggtttgagcgcggcgttcgccggcggcgcgggtaggtgggtctggggactcggctttcaggcccatgggtgggcaaggagatgggccagcgtgctgggctaagaggagagaaaattgggctggccttcagcctgtagaataaagaagacaaaattggttatatagcatcaatgttcacgtttttttattttatagtatcgaaagataccggttcactttaatagcatctaaagtccacattgttttccgtccgtcttgattgctattgactcagccacgcacacggtatgatgtctctacccctcattgccatgtattctactcgggtactattaaagtgaaccggtatctttcggtgctataaaaccaaaaacgtgaactttagatgctactatataaccaattttcccaatatagaaatgaaggaatgccataagcctataataacttattgagtggaggaattaaaaaaaaagaaaaaaggggaggatgaaaaaggaaagggggagaaaaaactattccctttcttaaaatgtgccttcttcgtgtttgaaatttggtatgaaattattgacgaagaatttgatctaaaatataaaaacttctagtgtgctacttctcataaatcacttgtttatttttacctaatgttatccgcaatgcacccttccaggcttccactccccatcccctcatttagtgacattatatcacttttcttttaaccttaattcctccgaaaagaccccaaaagtctttttatggagtatattggaaggagtgagtaataattatttcgtttattattatgattattagttaaatttgaattatagaacttatttttgaatttgaatttttggttctttcatcgtagtgtattttatagcatttattttttagtcgctaaggacacatatgtataagttttactcataaataattttttatttaataataagctatttggataagcatatgaataagcgaaacaatgtggctggaggagtggaaagagtttagataaatttctaaaattcctttattttcaaatatagaaactgttagaaattgaaactaaaaccgaaagaaaagaaactagaagtgtgacaaacacacaaaaaaaaaccagtgacgaggcccacagattcatgaaaatggagaaagcagcatgaaactttagtccgcactcgccccaccgagcgaaaagttattcaagcccacagattcacaggtctttcatgtggttgaaggaatctcacggaaattaaacttagggcttgcttagttggcaaaacatttacccatacatgttacatcggatatacggatacacatttgaattattacacgtagtctaataacaaaataaattacagatttcgccaggaaactgtgaaacaaatttattaagcctaattaatccatcattagtaaatatttacttagcaccacattgttaaatcatgacgcaattaggcttaaataatttatctcgcaatttctcggcgaactgtgtaattggtttttttctacttttaatacttcatgtatgtgttaaatattcgatgtgacagtatgaaaaattttgtttgggaagtaaacatgcccttaagaaaatctgtagtacgatccaaatgagcccatccacaaaggaatactttaggagttaggacggctgacaaaagtgatcaggcatagaaaaatggacgaatcaactaaaatataaataaccctttgcatttatattattagtgatttaaaaactagtgatgtaaaatagactaaagaaaattccaaaattaattttaaaattacatttcggttggctacggctgataagccaatataacaaaatacagacattaacgttgatactccctcaatcttaaaatagagtaacatagtactagcatacgcacactttaggacaaaatataggaattcatggcaatagtaggttataggctgtatatgttactatattttactcttcccgttgtaaaacatagggattatgatgtgtcttcgttaattttggttaataacttaatatattttaggatggaggggtagaagttgtagaacggtgaaagtggttaagggtaagtactatgagcatccaagcacaatcttttagatgtcacataagctaaaatagtgaggtggaggagagaagagatgagagagataagcagccacctctcatgcaagaggcaaccactgtataaaattcaagacaaaaggagagaggggaagagtagactggacaaacaaacattggggctaatgtattaaaattagtatagatgtgatatattgtacatgttacctctacatttattagttgatgatgtggtcaagattagatacaacatccacctcttttataaaacttgccctaagattgatattttattttgaaggagggagtacacagtgggtctgttctgttattatttttcacggctgcggcacagccgacacgaacagagccgtactcagtgtgcgcagctgcaaccgcagccgcagccatggtagccgacctaccgaacgctcccgttgatggtcttaaggctgtgtttgggaggagccgacacgtaaaacgaagtacgtattattacatgattaactaaatattaattattttttaatttaaaaggattaatatgattttttaaaacaactttcgtgtagaaattttttataaaaacacacagtttagcagtttgaaaaatatgtgtgtgaaaaatgagggaggtgagttagaaaatctgggggaagaacacggcctaggcggtcagcagcgaattttggtgagcagtgttggtcggcagcgtgctctggattatggatgaaactggttcggatagtttccgtctgtccggaccatttttcggattcggatagtttcggtcggaattatccggaaattatcggattcggaaacgaattcggatatttttttctcggaaacgaaaacgaatacaataagggtactatccgtcggaatcagaaaacggtcggaaactatccagaatttttttcggatatccacaaacattgaacaaattttagaaaaaacacgtatatatacataactttttcatacgaaatcggatgaagataaactttatatcaatattgtagagctcgatgagatctacaactttattattgactattttattatttgaggtcatttaagggtctaaatattcattataatataccatattaattttacaaaatcttagatctacaattcaaacgacatctgatggagatgtgttccatatcaaaattgtagagcttaatgggatctaccactttgtagtttataacatttgtatttgaaggcatttaaagtataatacaaacattacaagttttgaagatgtgaagtaaaataaataacatctcttatttatacaatggtaagtaagtatatatctagtaaaaagtcttgggaatagaaaataataatcatatttgcatatggtcttagaggaaatcgattatcacatacgggtgtgggaccgtctacaaaattgacgatataaatgttggagatgttgaactaaaataataagtgatatctcttccttgatcaagaaactcaatttgaggggttttttatataccggtaaatattcgctaccgtattcgttccgtctcgtattcgctccgtatctgtattcgataatattcgatttcatttctaattaaaaaaaataataaaactagttttcgtccgttttcgatccgttttcatccctctgatgccgccggcacgagcggaaaggtccctgcacagcacagcactacacctccgctggtagggtagccacacgtccgtcttgccatcttggtgtgccttggtgcttctgacacgtaggccaccgagtgagcattttatattttctacttacctttcggcaacgatttctttttagtttatttattattatcactcctcacatgcacatgtcactcctgttgtttatgttactcctatataacatcatccattgtacagtactagtaccatgtggatttttttatttttttagacttttttattttaaattttattaatagacgtttctaaaaagtatttccaaatcagaatcccgtggccaaataactttgtcaagacagtgttgttagctagcgtgacattcaattttcagaaatactttttaaaaagatctattaataaaattaaaaaaataaaaaaattataccacatgtcaatgtgtgttcttccgataatgcttgctagtacagcaagcagcaaccttagcacggaagaaatgatgaattccacaggatggattatggtttcttcggtactagtagtaattcctgtttgaggatttttcacaaaattatgagtttctccggctctaatttaaagagcagaaaagttcaacaaaagcatatgatataccaacttgactacgcaatcagcaggcagcatctattccttgcaacaaaagaatgtaccagtactgttccatccagatccgggcatctcacattgtcattgtcagctcctccacaattaagcaacctagccttaatcatctgcgcttcccaacgcccaatttgttcggtagtgataaaaataaaaatacaggaaactattaaaacactactaattgagttttaatttttttttaaaaaataaatttatctaaatattttaaaataatttctatatataaagtttttgtacaaaatatatcagctgtttaagaaacatgttaagagacacccaaataaaataaatctgacgtgtgtctctctttcttcttgttgcttcttgcaagttaaaccaaaccaacccaaaccaaagcagcagcagccagcaggaacagcaaattaaatttgtccaattaatgccatgtttagtttcaagatttttctttaaactctaacttttccatccaaactttactacgtataaacttttaactttttactacacacaaacttccaatttttctatcacatcgtttcactttcaaccaaactatcaattttgggtgaactaaacacagctttttttttcctggtttctttctgcttctgtgttcttacccacctttttttttcctttccaatttccatttcgtagtttactttacttgtttgttcctcctcttcttccctgacacgacacgaacccgaccacacgagccttctccgctcgcgccgccgccgtccacgcccatcgctcgccgtcgccccccccgcaattctcgtcgccttcgaggcgcgcgctggtccgccgccacgccggctgtgtgggggtctcgcttgcccagatcgcttcggctcgcctcttcttccccgacatcgcgtctccgcctttcctccccgccgccgcccacaggtgagctcctcgtatgaattctgagccacagcaattattttgcaaatgtgccaaggtagaaagcatcctgtagtacagagcaacaagctttttttttttttgcatgtgtgttcttcccccatgaagagacaagtgaacaattgctgccagaacttttgtttttcgtatgtgtgttcctccttcctgaaggaagagataattgaacaattgtaggagtcttggtaccagaactttttttttttatgtgtgttctcttcccctgaagagttaagggaacaattgtaggaagacctagtactagaaccactgcagtaaaataggggctttactatacagctaatgaaataaatataccttgtaggataccatgctaatgtgtttaaattgtgttatcttctgcctgtgggagtagcaaacaatccacgcattttttttaggatccttccttttaagttgaattcagggcaatgcattgaataaattcgtttgatctgttaatttatgagcagcaaggcacattctagtttcgtgtgaaaaaagatggatttttcttgcgtccacttcatgtttctgtttatcttagtatgtttcatttttgtcttatgcctctgaatatcttttagaaatgatttctgatgttgacgtttgagttcactactcgcttgaatgagtttatacatcagcatttttttttatttatgcagctctgaccacaagtctggaacatttctccagtgaccaagtgctcacactttctgcttcggtttcaattatgaattctcagtgactcagggagccatatttctatgggaagagaaaagctgcgcaagcaacgttctggtcgtctgattgaaaccctcaaaatggagagggtcaggactatcctgactcatagatacccatacccacatgagcactcaagacatctcatgattgctgtatttgccatctggcttttcttcgtttcatcggataacttgcaaactcttataatgaagttggacaagaatttcaaatggtggtcgatgtatgcttgtttaattggtttcttctatttcttctcatcaccttttattcgaaagactatcaaaccgagctattcaaattttagtcgttggtaagcaacctcttgagtctgtgagaaggtaaattaagcaaaacatggtgtatttgttctctaaagccgttccctgctgcaggtatattgcttggatattcttggcagcattataccatctccccagttttcagtcaatggggttggatttacggatgaacctttctcttttcctcaccatttatatctcctctctaattttcttgatcgtatttcatgtcatctttcttggcctgtggtatttgggcctcgtttctcgtatggccgagaaaaaaccagagatgcttactataatccaaaattgtgcagtaagtttctttggatacagtaattatagaagtgttttttttattttcacctaatcttgtttagttaccacttatcagctgttccttatctatgtttttgcattttgtgctgtgttgcaggttataagtatagcttgctgcgtactttacagccactgtggtaacaaaactattacgagagataaatccattgaccgtagaactgctagctgggttgcgttctctctgtggaaaaaacatgatgacaattcactgatttcaaagctattgcgcatgcataagtttaaagagcagatttgctcatcctggtttgctccggttggctctgctagcgattaccctctcctatctaaatgggcaatttatgaagaagttagtattgcttcaccttctgtgtttctcttgatttttttttagtttattcttattttttttatgtttgctccagttagcttctaatggatccgggcattccaatgacatttcacctgtcactctttatgggctacattcattggtctttacataccaattatgtcgtggagcggtcaaccgggtatgtcaactatcttaagtatccacctgataactcacttgtgtactatggaaatttagaagacaaatatatggattctttcatcttgaaaaagcaacagttgatattggaaagggaactaacttcaccatttgttcatataacagagctgtatataatatgttaatgttcggttttttaactttcagctacatgaatatttagacatgttcacattttcacatgcttatgaaatctaggagataactaaaaagggaaaaaccatgttcacactgtgtaatggccgtgttttgggttttctaccacaaaccagatcatttgaaatataatgatctgagttctaattcttttttgtataatggccaaataataaagaaactaattgtttccttggttatttagtttttctcaactcactttcttatctttgtttcattcgagttgcttatagatgggctctaactcatcctttgacaatgtcggagtacgaaaaattgaagaaacaactgaaaccagattttgaggacatggttccttggtactctgggtatgctgatgacactctacctcttgctacctcgcttggtgtacacagtgactaaatattcgtcgatttgcttgctctgcaggacatcaactgatttatttaaaaccgtttttgacctcatggtatctgtgactcttttcgttggtcggtttgacatgcggatgatgcaggtatgtgacctgttgaagttgaaacttgttcctcacttcctctttttattttggttgttagttttcagcttttccttatctcgtgaagtcatgatcccctcttcactatttttttcccactatgtttcctgttaaatggatagcactagaatgatatatatatact

SEQ ID NO: 25851 - DNA, 687 bp, Oryza sativa
tcctgcagccctacactgtaccagtctgtccgcgatagctgactgccctgtatacactgcttcttcttctccttcctgctcatctacatctttaaaaccagcgatgtgtgctgtggaaccatcaactggctctccttgaaatatctctatcagaaaatctaagtactcaggggtgccatggcgaaatctcttggcgtcccccttctcctgggttgacactaaatgaatatcacggatgactctaaaatcatgtaaactagctatattattgacaactgcataccttaagtttttatgccaccaagcatatgatgcaattatttctccactagcacttctaccagttgcagtttgatgcttcatgccacacccaagcactgaaataattctttagatgggagaatctatgctttatgtgcttgacagaacgccttacgatagcccttaggacatatctggcgctaagattctggtaccctctatgtgcccatgctccattaggacaatgcccatgcattatttcctcacatgctatttcacacaatgagtaagttttttcttctgaccaatttgtcttgtgatacgtatcctaggaccgacaggcatgacttaactctacttgaacagtgaacaacatatgctgtcatacatatgcttagatcacggcattgatagcactatcaatat

SEQ ID NO: 25852 - DNA, 806 bp, Oryza sativa
ctgcagcccgacgactgtacatgcttgacatcaacctggcgcgcccggtctgtttggcggcacacgccgacgaagacgcgtggcgctggcatgctcgcctcggcacataaacttcagggcgctctgcaagatgggcaaggaggagctggtacgtggtctaccatgtttgtcgcaggttgatcaggtctgtgaggcctgtctcgccgggaaacaccggaggtcgccgttcccgcggcaggcactttgccggtctgacgagccgctggcactgctgcatggagatctctgtggaccgatcacgccggcgacacccagtggcaaccgctatttccttctactcgtcgacgactacagccggtacatgtgggtcgccctcctctacaccaaagatgcggcgccggctgccatcaagcgtattcaggcggcggcagaaaggaagagtggacgcaagctccgcgcgttgcggacggatcgcgtgggagaattcacgtctacacagttcgccgagtactgcgccgagcttggaatgcggcgcgagctcacggtgccctactctccgcaacagaacggcgttgtcgagcggcgaaaccaatccgtggtgggcacggcgcggagtatgctcaatgcgaatgggctgacaggtatgttatgtggagaggcgataaatactcgcgtgtatctgctcaacaggtcgtcgtccaaggtattcgcggaagaccccgacgcgctgtggactgcgttccgtcgccgtgcaccatctgccacgtttggtgtgtggacacgtgaagacgaccacccgaacctga

SEQ ID NO: 25853 - DNA, 2361 bp, Oryza sativa
  unsure (1)..(2361): unsure at all n locations
gctgttccntatgcttcagatcantacgtgcttacaagtgattcttcgagctttccatatatactgagnnaagccaagaangtttacgcaaggtttcttagtgaggtgcatcacgtcgatcgcgtgcgggacgtccaagaattcgcaatagagtaactcccaatatatgaagtttatgtccacatcgccgcgtgaccatcttcgcagtctataggctggctgccaggcccctttccaaacactactttaagatctttcaccatagcaaacactgttttcccgctgtgatgtttaggcttcgtacggtggtccgccttatgttcaaagtgcttgcctttcttccgtactaggtggtttgcagcaagaaatcgacgatgacccgtgtacacaaccttcctacagtgcttaagatacgtactttctgtttcatccatacagtcagtgcaagccttgtaacccttgtttgactgcccggataggttgctaagtgcaggccaatcgttgatggttacgaacagcagcgctcataggttaaacccctcttgtttgtcctcgtcccacacggggacaccttccttcttccacaacagtttaagatcttcgaccagtggtcttaggaacacatcgatgtcgttaccaggttgcttggggccttgaataataatcggcatcattatgtacttcctcttcatgcatagccaaagggggaggttgtagatacacatcgtaacgggccaagtgctatggccactggtcatctctccaaaaggattcatgccatccgtacttaaaccaaccatatgtttcgtgcgtgctttccaagtctttaaattttctgtcgatgtttcgccactacgaaccatctgcggggtgtctcagcatcccgtcctattgacgttcttcagcgtgccaacgcatcattctagcattccccttgttcctaaacaaacgccttagccgtggtattatagggaaataccacatcaccttagcaggaattctcttcttcgttagctgcccgtcaacctcacctagatcatctcgtctaatcttgtattatagtgctttacaaacagggcatgcttctaggttctcgtactcctcaccgcgatataggatacaatcattaggacatgcgtgaatcttctgaacttctagtcctagagggcagactatcttcttagcctcgtacgttgtctcgggcaatttgtttccctccggaagaatgttcttgacgagtttcaataaatcgccaaatgccttgtcactaacaccattttttgccttccattgcaagaactccagagtggtatccaactttttgtgcccctactcgcaacctgagtacaacgatgttctgtggtcctctaacatcttgtccaatttatgggccctcttttcactttcgcagtcctccttggtatcctgcaacatctgaccaagatcatccgcaatgtcgttataatcagcatctctatcctcctcgcccgtttgatttccttcaaatccagcgtactgagcaaagtctggaatattgtcgtcttccacttcatcttcttccatttcaaccccttgctctccgtgggatgtccaacaattatagcttggcatgaaccccgactcaaacaagtggaaatgaatagtcctggatgcagaatactccttctgattcttacacttattgcatggacaacaaataaaacccttctgcttgttagcttcggccactctcaaaaaataatgcacgccatcaataaactctttggaccgccggtcagcgtacatccattgccgatccatctacatgaaatgaaaaaaaaatcgtacacaaatattcattcgtacaataatgacagtcatacaataatgataaaataatcacaaactctttcaacagtcatacaataatgacatatcattattcatacaaaaattataaaatattccaccaaataattcttatttattattttttaagttttaaattcttttaattttcaatttagtttgttttcttttatttaggattaactttcactatattttcctactcaactattttataaaaccttttttagcaaataaacaaaatttctatatattctttcttttcccacacaaattttctctctcatcaacttacaacaaaattttggagacaaaaaaagtgtgcaaaacatagctccaaatgtaatatgaccaaaaaaaattggaggatgaagttgctaaccttttaggcacctccgatttgtatataatcaccaaagtaaattcactataaattttggcatgacctcccctcttttttgaagaaattttgnnnnnnnnnnnnnnnnnnnnnnnnnnnnnnnnnnnnnnnnn

SEQ ID NO: 25854 - DNA, 793 bp, Oryza sativa
  unsure (1)..(793): unsure at all n locations
cctgcgccccaccatattgcttcgtctaaataatcggatcaaacagctactcccaccggtagatttaacggaactgttacttgagatagatgcccagacaggatttacacatgagtttgcgcatgtcagtgaatctggtgctcgagcgcaagatttgcacatcagtttatgtgcggtattgatggctgaagcctgtaatatcggactggaaccgctgataaagcacaatataccagcactgacccgccatcggctcagttgggtgaaacagaattaccttcgtgcagaaacgctggtcagcgccaatgcccgcctggttgattttcagtccacactggagcttgctggtcgttggggaggtggagaagtggcatcagctgacggcatgcgctttgtcacaccagtgaagaccatcaactcaggatctaacagaaaatattttggttctggacgaggcatcacctggtataacttcgtatctgatcagtactctgggttccatggcattgtggtacccggtacattacgggattcgatttttgtactggaaggacttcttgagcagcagacagggctgaatccagttgaaatcatgacagacactgcgggtagcagcgatattattttcggtctgttctggctactgcngtatcagttttccccccggcttgccgatgcaggtgaggcggtgttctggcgggtgaataaatcggcaaactacggagtactggataagttggcccgaggatatgcagatctgtcaaaagcggagagtcagtgggatgagatgatg

SEQ ID NO: 25855 - DNA, 837 bp, Oryza sativa
  unsure (1)..(837): unsure at all n locations
tgcagccctgattgggaacgagcgtgtgtggcgaaagtagggcgtagcagagaaagagttagagctcaggcggcgaaggcaagaggaacaatggcgaaaggaagggagcaaatccttttctcgatgcttttatacccttgcaatcgctgggcctggctcctcgtttctcgcgcccanctacttcgcttccctcgtatactcgactatcatcgctccactcgtcttccgcgtgcccccacgctatccacttttaatcccaattcgcaccgcattaccggtcgcccatgaagntaggatatgcgnangttgtggacaaatcagcaaatggatctgtatacgtgccgcgccgtataattaccgcttctgccgtcccgannagcggcgttacccgtatacatccaggcgaagacaanantgctgctcaaacccagaanttcgcgcgcctgtctcnnaagtggtggttggcanngtctctgnnaatagaaccgcnctcattgatggaccaaaccnaaagttatcaaatnaaccaatnngtgcatggcattggagacccgnnttgggcatnntttgcccaaactacccggagaaaccggtcaccacncnntgtcaccnnaggcttgtagnngggtggctngtcacaacatttgacacgcttccactttgggaacagggaaattgcnntctggcataacgccgggggctaactgtcggtgatatgggaccgggagtatcatgaccagaggcttgaggcagacgcaatcgcccacgtggcctggcaccttcggtgacgtcgggcccgagggtgaggtgtccgccctcctcgtgaattcccctgag

SEQ ID NO: 25856 - DNA, 638 bp, Oryza sativa
tatccctagggtcttacttgagtctaatccatggtctgtctagcatcgccgtcttctccatgtgttgccgccggttcaccgtctgcatctatctccgatcgctttggttcggtgagacttctatccgcgtcccctcgggttagcggtcaatccctcaggccatgcatgccgccgctgctgctctaaccgtagcgcagccgctgccgcgtcacttgccggctgccctgtgcaccgtcactaccggttgtgccgttgttgcttgatgccgacgttgtgctagccgactagccaaaccaagtcgccctagtgccgccatgtggcagctgagtgccgctttaacctaaccgactgtctagccgatgctcggtagccaagttgtctagccagaggtgtatccctaaattcctaccggtctatcgttagtcgtaccggggctctaccgcgactcgtttatagccgaccggtttagttgcagccgtggctgtatcggtcgctcgctcgttcgaataaggtgattcccgagcttcgacagttcgtacgtgttgagtgcttctttagagcacagccgccggcttcgatcgccggcttaggttgatcattcgagtgatcccgtgtagcgaacaatcgactcgttgagt

SEQ ID NO: 25857 - DNA, 362 bp, Oryza sativa
acgcactggcgagcagcggagcagcaggattaactcgctcctgcaacgcattcacgatgaccggatgatcactgagacttgccctgacctccaggtcgccaccttgcagttccaacctgtcgcgttttctctccggcgagttgcaagtggcagtggacctcactggaactggggattggggatcggggtgtatggacggctgtgggagtggtggtgggaatcaaagtgtggtgaggcagtaacgaggtgaatcagatgcaggctaagtgcgacatgactaccagaccaaccagcggctctggctccgacggtgtccgctaggacaggcggtgagcggtgttggtgcaatcaacaggacgcgt

SEQ ID NO: 25858 - DNA, 854 bp, Oryza sativa
actcgagcggcacttgtcggtctcgcttaacatgcacctgttatacgaggccagccccagcaaccagtgctgctttcacaggagggcaggatctcacagccccagttgtctgtctactatggaccaagagattagtcaagtcgtgctgaggtcagatcctgctctcacaacggcgttacggacgggcagcagaaggctcgacttgaaccaatcatgacaggcgcgagttgggaactaggccgcatctatacggctcaactgagccgtctagctgctccaagaactactggctggcggtagcctgatgatcatcttcagcaactatgcgggattgttcatatagagccagggtgcgtacgggtgtacgcatgtcgccatggggaatcggtgcttaatgctcgcgtcaaggacaggccggcgttttcgcaatcgatcatatttaaactctcgcttgtacccgctaacagcgggcttgctacacgacacggatgatgacagtgcgcttggttcgactaacggagagcacggtctcacttttaaatgactggatcgaggctgccatgcgtactacagtcccaaacgaccacccggctctggtagttccagtggcgtcgattttgaggcgtcgcaccgatccaccgttggacaattacagagccgtagtccacagactacactagcattccttgcatactccctgaccatcggacgggtagtccttctgttactaaccttgtgcggatgtcactgttccacccccatactgccttgatctgcgcccggctgaccgcccgctcgtacctggggttcatgcacgggtccctaagccataaggttccctttgctcacgggct

SEQ ID NO: 25859 - DNA, 904 bp, Oryza sativa
  unsure (1)..(904): unsure at all n locations
ggcaatcctaattgctgcaattaccctccttgaattattgaacacttaaacctccttgttaacgggccttcgggtacgcgcatcggaacaccccccctcaaaatataaaatatccaaccatgggtaaaacttgggttttacaaaagacttggaaaacccgacacctgggtcggtgcttgcgaactaaatgaatttccaaaaaatcggggaccggggaacgtaccgggtgtacggtttcccgctcttgcacttaaggaccgtttccttggaatttcatccgaacataagacaagtgcgaccacatggttggaatgggacacccctggctgagtaactagctaatcgggggagccatgatgccaagagacatgtggattcaacggggtggtgtcggggagaacccccgggtttcctggcacagtatggtctgggacctaatctggtgttggtctgggacccctcttgttggcatatggtgaacctgtgtcggctttcgaaatgccttgtcatgaaagccttaaggtctctagtcgtggccgttctgcacgggctggatgatccaggttagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25860 - DNA, 10891 bp, Oryza sativa
  unsure (1)..(10891): unsure at all n locations
gcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccatccaatcaaaaacaaaaacaagatggatggtcatcttccttccatgcatgggagcatccaaattaatctaccaagaacaccctataatatatatgcatcgccatgatcgaagcgaggaagaagaagaagaagaagctgcagttgcagcagcagcagcagcaactagtaactaataaagtgatgacgatggatcgtcccaacgtcgccgtggccgcggtggggctgctagtggcggcggtggcggcgacgctgccggcgccgtcgtgggggcagcagcagccagccaacaagctcatcaccagcacctccggctccggcaaagggttgtccaagtggctggcgatgaaccaggaggagtacgtggagaagaaggcgctgcacaccatggccaccgcggaggagctcggcgggaagaagctggacgcgaacctgacggcggcggaggaggccaaggtgacgtgggtgatcgaccccaaggggacgccgggcgacaccaccttcaccaccatcacggcggcgctggagaaggtccccgaggggaacaagaagcgcgtcatcctcgacctcaagcccggcgccgagttccgggagaagatcttcctcaacctcagcaagcccttcatcaccttcaagtccgaccccaagaacccggcggtgatcgcctggagcgacacggcggcgaccaggggcaaggacggcaagcccgtcggcaccgtggggagcaccaccgtcgccatcgagtccgactacttcgtggcgcatggcgtcgtgttcaagaacgacgcgccgatggccaagcccggcgccgagggcggccaggcggtggcgctccgcctcttcggcaccaaggcggccatctacaactgcaccatcgacggcggccaggacacgctgtacgaccacaagggcctccactacatcaaggattgcctcatcatgggcagcgtcgacttcatcttcgggttcgggagatcgtactacgagggctgcaccatcgtctccgtcaccaaggaggtgtccgtgctgacggcgcagcagaggagcaagaccatcgagggcgccctcgagagcggcttctccttcaagaactgcagcatcaagggagaagggcagatctacctggggcgagcatggggggaatcgtcgcgggtggtgtacgcctacaccgacatgtccaaggaggtggtgcccgtgggttgggacggctggaacatcgccaagccggagagcagcgggatctactacggcgagttcaagtgcaccggccccggctccgacgccaagaagagggtgggttgggcgctcgacctcaccgaggagcaggccaagcccttcatcggcacgcactacatctacggcgactcctggctcatcccaccagagtaattaattactacttttgtttttacatcgattaattaattaacactctctctttttcatattatgaatcgctttgatttcttttgcatttttttcaagtttaaccaaattttattggaaaacatatcaacacaattttttaagaaaagaacaaacatattataaaaatatattcaactttacatttagttaaactattttttaaaaatgctgctaaattttttgaaaaaaaattgatcaaatataaataagtttgacaaaaaaaatcaaaacaaagttacattttatatgaaatggaaggtgtaatcaattaattatgctagtacaaattaatatattctaattgttggtgtaacatcaaatagcgggacatcaacgtcatctagctcagcttcaacgtcgagcaactcaaccgcggaagcaccgacggcgagtagtaactcaactgcatcggctaataaaaaggaaagcaattcaactgcagaagcgccgacggcgactagctactcaactgcgtcagcgacgacgagtaattccactgcgtcagcgaaggcgactaattactcgagttcaagtccaccggcaaaaggcaagtagttaatacaagtgcagcggcgacgacggcgccgacgcgatgaatcgcgttcattggggccaaccaattctgttttggaagcccgtttaattgttcattctttgtgtcaatttgggccggattaatcaatcggccggctacttagatgtttcacgtacgtgtaacagttgtattttcttcccatttcgtttgggtcttttatcagtgtacgcatcttcaaaactatagtgaattttacacatgttttccttttgaaaatgactcttgaagacttgtgctctatacttatgttgcaattaactttcgggaacgaaaacgatcaacagaataggcatcttaccgtgattaaaacgggggtaacaagtacatcccacttgttccatggctaataagtcgtgcaaaggtaaggagcttattaactggttagatttcttgtgatggaaccaatccacccgagttcaatgtcaatacaagtaccgaaaagaacgtgtttgcctattgcaatatcgtgtacgtggggataagattgctcactaggtaggcacacagttattctttgcacctctgtctcattaagtttctctagatttcagcattcaaactgtgatttaaacttttaagcacatttgctagaagcaacattgaagccttgatggtgtggtacgtacatttgtttgcagaagacgataatttcttatttgggggggtgtttggacgatccaggggctaaactttaatccctgtcatatcggatgaatttggaatattaaacaaagactacttataaaactaattacataaataagagctaattcacgtgataaatttttttaagcctaattaatccataattagcgtatgtttactgtagcatcacgtaggctaatcatggattaattagtctcaatagattcgtctcgcgaattagtccagggttatagaatgggttttatcaataatctacgtttaatatttataattagtgtccaaacatccaatgtgataaggattaaaaagttttagttctatccaaacagggcctaggctagcaacagcgcctgcgcataagttgagaacatgctagaagaagctcggttccagtttgcaatgggcaaaagaaaaaaaatattataatatatcataacaaaatattttttatcaaatatgtacttaattgtttgcttattttaagatctgttaccacttgtttaaataaaatgttggactattaattccataatattcgaaaataaaaagaagacaaattataaaaactgcaagagcaatagtgggtggcatattccccaccaaaggcttttaaagtagttagattgttttcctttcattcagttactgtattaattgtgtgtatatactccaatgtacgatagtataatttagtgatcagtagtacactacaagtacatagtttttttttctgaggattttatgttcataatatatagtactttctgtgtatgatatttatgcattttgacacgttccagaaaaggctggatcataatagctaattttagccccacaaatacactcttacttgctccatatttcagaatttaagatgttttggttttgtcagaaatcaaatttattcaagtttgatcaggtttataaaataatgtattccatattcatttctcgttggcatgttcgaaattacttcaatgagatgttttctttgtctaccttttatcaatgcagtaatattattctcaccagaaaaatataatgtttgctttaagaaaagttattaggatgtaataattagtgtagcaatataatttgccgcatattctattttagtgcatgtgagatttgttacagcaacaaagtagattgaaatgggaaacggatcgagtagtaacatatagaacgccaaattaattttattaaatctagctaccatgaaatgtatttttataataggttttcttttttacaaatattgctatgttttttattaaattaacttggttaaacatcttacattagggaatatagagtaccagcgaccaaaattgggcgcatcaaatgaactgcgacccaaaatgcaacctctaaatcctgcacaaaaggccttaaaatcgagccaagatatcatcgaagcaaattaaggtcgagagatcgccggtcaccaaattagcaagaagtgcttgctacctatccggccatccaagcacgaacattttccccaaaaatggatggccagccatgtcccttccatccatggaagttccaaattaatccgccaagatcgatcaccctatatacgcatcgcgccatgatgggcagggacagaacgaattagctgcatactgcagcaactaataaacgatggatcgtcccaacctcgccgtggccgtggtggggctactggcggtggtggcggcgacgctgccggcgccgtcatggcagttcttcgacctattcctccccgccggccccagccaccgctcctccggcggagggtttggcaagtgggtgctgatgaaccacgaggagtacgtcgagaagaagtcgctgtacgccatgaaggccgccggcgacatcggcgggaagaccatcgacgcgagcctctcggcggcggaggaggccaaggtgacgtgggtggttgaccccaaggggacgccgggcgacaccaccttcaccaccatcgcggcggcgctcgagaaggtccccgaggggaacaccaagcgcgtcatcctcgacctcaagcccggcgccgagttccgggagaagctcctcctcaacatcactaagccctacatcaccttcaagtccgaccctgccaacccggcggtgatcgcctggaacgacatggctgccaccaggggcaaggacggcaagcccgtcggcaccgtcgggagcaccaccgtcgccgtcgagtccgactacttcatggcctacggcgtcgtcttcaagaacgacgcgccgctggccaagccgggtgccgagggtggccaggcggtggcgctccgcctgttcggcaccaaggcagccatctacaactgcaccatcgacggcgggcaggacaccctatacgatcacaagggactccactacatcaaggatagcctcatcatgggcagcgtcgacttcatctttggattcgggagatcactctacgagggctgcaccatcgtctccgtcaccaaggaggtgtccgtgctgacggcgcagcagaggaccaagaccatcgagggcgccatagaaagtggcttctccttcaagaactgcagcatcaaaggacaagggcagatctacctcggccgggcatggggggattcgtcgcgggtggtgtactcctacacggacatgtccaaggaggtggtgccgatagggtgggatggctggaacatcgccaagccggagagcagcgggatctactacggcgagttcaagtgcaccggccccggctccgacgccaagaagagggtgggttgggcgcttgacctcaccgcggatcaggccaagcccttcatcggcacgcactacatctatggcgactcatggatcctcccgccaccagagtaattactcctctctccatttcaaaacatagggcgtattttgtgttgttaggagataagggtttaaccaatgattgcttctccaatatattatatttgtgccgcaaaagtataatacttttgaagacgaatctaaataatatttcttatgcttcacaaaagttatattataaaagagtaatggtctatagaaaacagagtagtggttggttaaaatcttgttctaacaaagtaaaataaaccctataacgtgaaacatagggagtactatttttacattaactttctttggtatttcgattttggggtaacatcgaatagcgggaaatcagcggcatctacctcgacggcgagtaaatcaaccgcatcggcgatacccaggaactcaactgcaccggcgacggcaacggaaagtaactcaactgcaccggcgacacccagcaactcaactgcaccggtgacggcaagtaattcaactgcaccggcgacggcgagtagttcaaacccacctgccacgaagagttactcgggtccaccggcgacgccaagtgcttcaagcacaccggcaaaggcgagtagataagtgcagcggcggcgcggtgagtcacaacttcatctacggcaattgaaggatcctcccgccaccaaagtgattcaaatatttcggagtaactattaccaatttaattgggcccaatcaattctgttttggaggcccgtttgttctttgtgttgtgttaattgggccggattggtcggccggccacatagatgtgtaacatttgtatttttttcccaattcatttttggtcttctatcagtgtacgcaccttcaaaatggtgaatttttacagaagtttttgaagaagacttgtgctctgtatgcgtggcaatttactttaacgatcgacacgacggcatctaattctgacgaaaacgagagataaccaatacatacacatagtattaggctatgttcggcaccctgggttgggaacccatgtcccacgcacaaaaaagatagcgatccattagcgtgtatttaattaagtattagctttttttttcaaaaatagatcaatatgatttttttaagcaactttcgtattgaaactttttataaaaaaaatatactatttagcagtttgaaagacgtgtgcgcgaaaaacgagagggggagttgggaacctggggcaaagaacaaagcctagtaaagctagcagttcgtacaagagtgtggtaattgtgaattatccagggtctgcataaaatcgagtttaattcttcgtgtggttctgataagttccttgctgtacagtgtataatttggtttttagagaacgacaaatggataaacagcgtgttctagaactgtacatagaacagtgactcaaattaaggatgagaaatgggtggatcagggacgacacatgctatacatctctccaaattgttatccatttcgtctgtgttcagcatcagttggcctaattaaaactgataatcaacaactttaaaaaataacttatggcttatatatatataatcctgagcgatttaatgccaatacgaaccccaaaaaatcaattgaaaaactaaaataaaagttccaattttaacaatggcttatatttaagcaatcggtgcttctcttgctacacatttataggagtagagtatggattttgcagtgacaattaaagccaaacacacaaaattcacgataaaattaagaaaaccacacaaaaaaaaagtgagccatgcatagcgagagccaagtggcaatcctctagtacactcgcagctgtggcccccgcaaaatctgccacgagccaccaaaccccgccacgtgtcgaggtgggccccaccaacgaccggactactcccgcctcctcatccggttcccgccactcctatttatttcccaaaaaaataataaaaacaaaattcgacgaagaaaaaaaaaataaaattcggcggtaaataagcggggcgaaggaagaagaaaatcacggaaatgccactaccggcgttcgtggcggcggcggcgaggctcgccgtcctcgtggccgcggcggcgacggcggccaatgccgcctcctacgcgcggtaccggcggcgccacctccgccgcatccccagccccatcgacgagtccgccgatcccctcgccgacttccgcgcctttccctcctccgacgctgacgactcaggttcgtctcactcactttcgtttccctctgtaaagccctagccatgtaagcgctaatcgttgaggtcaatggattattgcattggggttgggagattatgtatttgattagtctttgtggatgcccagttgggaggttttaggttttatcaatttttgagatggggaattgttggcataatcgatttgaatttaatcaattaatccttatattcaattagttttttgatcaattagtcaatgtcaatacgagagtactgaaaagaactttgtttgcccattgcaaatgtcctgttacatcatacatggggataagattactcactataggcacagttatgctttgcacctctctctcattaattttctctataaattcgagcattcaaactgtgttttaacatttaaggccatcactggctggaagcaacaattgtcaaggcaatatggaagccctgatggtgtggcatatttgtttgcagaggaggataatttcttctttgggctagcaacagcgcctgcgcatgttgaggacaggctagaagatgcttggctccagtttgcaactgaaacttcctgcgatgacaatggaaacgtgcgcgaccagaggccagtagatgcactgatggcatctgctgctggtgatggaggctcccagcaatcttggaggtcaacaggtggggaaaatattggtgatagagagcagaggaaaccacttagggtagccatggaggctatgctcagggggtttgaaattcttgctgagagtggagaatctgctggcggcgataactgcagccacaatgttgctgcttggcataatgttccatgcccgtaagtacatgagtatagaatctctaatgagctaatttatctcagttctgtactccaaagaacaaatctccttgcctgtaaagtcacctagagtcacttctcatcttaactatctctccaggaagagttgttgtctttcaatattgtagcttctttccaagtctagatatgacttcgatagtgctactatgtagtggtgggtcccaaggataaaaaacgaatgcatgcttttaaaaaaagtaattcaagattctagctttccttccaaatgtagatgtctttggatgttgtatgttagcaaactctgatcatttttttttcaggcaagaaaggcttagattttggtctgatcctgatgctgagttgaaacttgctaaggagaccggcatcagcgttttccgcatgggggtagattgggcaaggttaatgcctgaggaaccaaccgaagaattgaagagctcagtaagttcatagttatgcacgtgcctctttttacctttatattcatccttctttttccagcatgatgatctcagtaccggtgaaataagatagacatctctttctctaggttaattttgcagcacttgagcggtatagatggatcattcaaagggttcgcgaatatggaatgaaagtaatgcttactctgtttcatcactcacttccaccttgggctggaaaatatggcgggtggaagatggaaaaaactgtcacctatttcatggattttgtgaggtaccttttgagggcagtcaaattgacctgccaatacattctctccattgggaattgttcaataatttattagattttgatagttggggctgtgcaggcttgttgttgatcgtgtatccaatttagtggactactgggtgattttcaatgaacctcacgtttttgtgatgctaacttattgtgccggtgcttggcctggtggagaccctaatgcaattgaagtagcaacatctactctgccaactggtgtatacaatcaggctttgcattggatggctattgcacattctgaagcctatgactacatacattcgaaaaggttggttctacataatgtattatttgcagtgcccttattccagtgattacctggtattttttattcgataatcaaggagttggtttcctctggttttcttattatttatttcttgattaacagcaagaacgaaaggaagccaatagttggtgttgcacaccatgtatcgtttacaaggccatatgggctatttgatgttgctgctgtcgcgctagctaactcattgaccctttttccttacgtggatagcatatgtgataaattggacttcattggaatcaactactatggacaggtaagcaaattatttgctgcttaatgaatggctatgtaagtgaccgagttaattctcccatttccatgcaggaggttatatcaggacctggtctaaagcttgtggataatgatgagtatagtgaatctggtcgtggggtttatcctgatgggctgttccgcatcctgattcaattcaatgaacgatataagagattaaatataccttttgtcattactgaaaatggagtttctgatgagactgatctgatacggaaaccatatatactggaacacttgttagccacatacgctgccatcattatggtcctttcttaacctttaagcaaacatgttttagtctgtgctcatggagatggaacttccaacacttaaacaacataatgttttatagggtgtccgtgtacttggttatttgttttggacaacatcagataattgggaatgggcggatggctatggtcccaagtttgggcttgttgctgttgaccgtgctaataacctagcacggaaacctcggccttcatactttttattctccagggtaactttttcgttttagcaaatcatgaaaccatggtacattgtttacctattatctcagtctcttacgttgtctaactcctaggtgaatttttgtcttctgttgaaatattgaa

SEQ ID NO: 25861 - DNA, 2696 bp, Oryza sativa
caagacaggacagaatgtctgcttggaggaagctgcaacaagctgcagttcaaaagaaaacacgtccatttttcagggcagtggataagcatggtcggatgtatgcaggtatgtattgtttctttttgaatgattctgatgatctgatcagcaggtaaattggcaggatcaataagtagtggcttgttttactaaaaacaacttgattaggattagcaacagacattgacttcttatgtcaatagatactaccatcaatggagctccttagaattaagattagtgttgcttctcgttttgcttctttttattaataatttctgatttaatgcccatctcttctgagttaaggtattttttgaactaccacaaggccttagaaaactatatacaaaaatataagttcaataagatccatgttttcctgcttgtctaagcattggtgtctccttttgtcttacaggtggtctagatcggcctattcagaggcccttcatattgcgggattggagatttggtcactataaaatggaaggcttgcaggatcctttgagttgctttataagatgcatttttgcaccattttcacgccaaaagaagattcactacatagaagatgatgttatttcttattctattaactgatgccctgctactatagttgctactttaagttcagtttcttatgttgcaaccaaaaacacatccatgttttggtgagtcaagagcaacaatgcattttgcttttcgattctttgtgcatgttacctatttagaacatctagtttggaatcttttgtaggttattacttttttcttgatgaagtaaataaaaagagtcttggaaatggaaagttcaacttcttcaggtaattactacatgggtttactatttgtataatagtacacatttagattccatacacttattttattctcatctcctttttttggtttaagatgtgtttgatctaatgtcatgtagattgtattctaaatatcttctaagccaaaatatcttttgtggatctacttttgctggctcatagctatgtcctgcacttcttaattgaagatgcttcctgggaagtgtttgggtgaacagatgggcacctgcctaccttatttagatctctgaccctccaggctacatccagatctgtgcgtgtagacacgttcaagtagtgagttaatggttcctattgtttcctcatatagatttttttacttttctattgtaaaaaaaaacacttttcacccactgtatataggaaatgaataaattcttttcatttatagtgtaagattcagtcttaattcatggagctgaggcataagtagtagaaggaaatgaataagatttgcaaattgcagcagaggaattcaagggttttgttatcccataacttgtgtacgtgagttttcatattaaacagtggtactacatttttgacatgcaaagcctagctgcctaagccatcagatgcatttggagggatcattgcagatgtatcctcctgcatgacctcatggaatcatgcacgtttcacatttccaaatttcacacagccagattttattggaaaaattactggtttgttaactggccttccaaacctttttttatgggcatggcatgcattttatttactaggatgtggcatgtattctttagtggaactagccactaacttctttattcatgctgcattacaatctaaaaagaactaaactttatatgcacacagccctatattcataatctggaatgtggtattttttatccacaaccccgtaatcactaaccacacctctcctgtacagtttttctaatatatataattaaccataggggcctccctactgttcttcattcaaagaaactggtgtcatgatgtcggtcttttgactagggatcttaactagggcgaatatcaaaagaccatacatctttagtacaattgtcatgcaaatttattctcatgtggtgtcatttattttcagtgaaacaaaaacagggggaaaagaaagtatctcacaggagaaacaagggagcatataatcatatgattttttatattatggcgcatattgcgttacatgagctatttagtacagaacaggaagttgtttagttgccttacagggctattgatgccattgcaatcatacgtaagcagtatatatttaggaaagacttttgtgttatcgccttttgaagtacataagcaaatagtagatcatcagtgttcattatttcagtattataggattgcagagctggtaatgatctgtggaccaagggatggcagaatgatcaattgttcttgataacttgatgagctctctccattagtaccactggttttggtatggcacaggtaatcttctcctccttctctggtatctggaaagctgatgcagggaaggttttcgtaatcccagcaatgctcttgcagatgagtttcccagtcttttgttcatcaagggcaatctcctctactggtacccacaccatgagctccctagtcttgatccctttgactttcttgatcctccccttctctgcaaaagcagtgatctcagtgccataagataccaaccttcctaagctttggaagacatggtctatcctcttcttttgcttgagccacacaaatccagtttcctcaacatagccacactccattatgtcc

SEQ ID NO: 25862 - DNA, 17617 bp, Oryza sativa
  unsure (1)..(17617): unsure at all n locations
cggcccaccgagccctgccgccgtgcggccgctagccgccgccacgctggccggccctccgagccccgccgccctcgcgtctgcctggcagtagagaggagaaggagaggaatagagacaagaagaatagataaggttgaggagaggagttaaaaatgacgaggagataaggttgagtagaggaggagagaggagttaaaggagaggagatacctcgatccgatcgcgccacctctccgatctccgcgtcgatctttttttccggtcggttttaccaacgggactataaatgttaccaaccgggagtaaagtgtatggcgatctttttttccggttggtgttattaaccgggactataaataaatctttagtctcggttggtaacaccaaccggtactaaagattgaaaagtaccctgtagcttttaaaccgggactaaagatatttttaatcccggtttttaatgtaaaatctggtcgaccgaccaaagatggtttctccaccagtggatatatcttaagactggtattaagtatgtgtgcataatcatggtttgatctaaatgttctttttccaactgagaaaggtcatttcctcttttgcaaggctttagatcgaatcagctccttggcttagatttttggtggggcgagacaagtcaacagcgcatgattaattgagtattaattattataaacttaaaaatactatatttttatttgatttttttaagaaatttttatataaaaagttgtttttgcgtgaaacacatgtttaacaatttagaaaacatgttcacgaatcacgatgaacaagtagcctagcccaaaatccgtttaaaaagcaacctaagataacgcgtctaatgttagtagtacataacttaatagtgtcctctcatagatggggtcatttggcaaggcattattattgtcatcatggtctggatgtgcttggtctttttttccttgagtaacacagcatatatgtcctacattcatgtactagctactgtgcattttctcaggcacccatgctgcatcaagtgggaacttatatggctgcttgagctatgaactccataatgagtatacgcgcttactgtcttcctgcaccagttgcatatgccggcagctgaacaagggttccattattcatgttgcataccggtaggttatacaaattttcatcaattttagatatagattacttataagactgcaatttgaataaattgtatctcttcctcattgttggcgccttttttatgcgtcgtctctttaacaaagatactattatccttagttttggaactaaattttaaattttataataagtggttgtaacttctattgaagcaaagtctgaatttaatctattattaacttcttttttggttcgcagcacatccattctcacaggatcagatgcatgtgggaagaacataggctaagtacaccatccatgtgcctagataaatgctctttcatggagatgctgccctctctccagctctcatttatgtaactatacaactactatgaatttgaccgatgatttttatagctatatactccctccgtactcgtaaaggaaatcgtttaggacaatatttaagtcaaaccttgcgaatataaatcatgaataactcataaagttgtgagtttgaaaatgtaaaaattatatgaatagatgtgtcttgaaacatactttcataaagtatacatatatcacttttcaataaatattttatagaacaagaaatcaaagttgtgttttggagaccgtgtcgctgtccaaaccgacttactttacgagtacggagagagtatgcaagattatatcgaatatatatgccgactttccttaaaatatgcattgctgcatggaaacggctaaagagaggcacaattttcattcttgtataccttagatttgttcacacagcattgccacaaaataattactcctcattcgtcctaaaatgttgcaatctagattataatgagattagacccatcctattacaatcttaggttgcaacaatcttggacggaggaagtaataaaaatcagctcttattggtacatctaaggaatgtaaataatcagtattatatttgtgcatatattctttgtcggtgataatagcatgacaggatacacaaacttaggaaatgcgctgacactagtacagataatgtgtttgtctaggtggctaataacccattttcacgggcatttttctcgattcacctctagcctatggtatacagaaatcaagtttgtgctggcgcatgaaagaaccgcctgtaaaaatatatctacaaagacaaatatatcaagttttcgtctaaaaaatatgtttacacgagcagattattcggggtcaatcatttattttatatgtttggaactcattttgttcgttaagcagcttctttaaacgctaagtttgttagtgagttcggcatgaaaaatctatcgttcattgtgaccacgcttcccaaactactaaatggtgtgtttcattaaaagaaaattatatgtattttttaaagaagatcaaataaatcattcttttcaaatttatactaattaatacttggttaataatttattaatcgcatgaaaagaactaaagcaaacttgcccttcccacctcagcctagaatgaaatacaattttctttaacttgcatttattgtgtctgtcctaataaacttgagctaattaagcagatggctacaaatctgtcctctttttttagaactaaatttgtcttgaaatatgtatagtttgatggtactggtccacattgtttttatgtgctcctgtacgtagttgtagtacaagtgttctactttgtgtattttgtacatggccctttttttaagtagcaatcatgtgactcaaaaacacatagagcatatattagtagggaaaaaactacacatttctgtatcatgcgatccagtgtgtgtttgctatttatgttctgtaaacatgttatatttagtattaccattttaaggtacacggaggaatcatttaggactcagaataccgtacttgttagtgttgcactgatgtttctttttctccctcagtacgtatttgatgtttttgaatcatgaagcagatttttaagtttagaaatttgcaagattttagcattattcattcaaatgtgatttagtaatttttactggtgctcttgttaaggcagcactgtactcttgctgggcccaagaatctcagagcaggagagacttctttaacaccgtactcttgtccatgatttcacaatcatgtgtcaaactcacaatggatcaggactagatatgatttgtgactgagcgtgcgaatcttgggaaaactacgtttccgtccaaaacggcgatagcaactgaccagtggagaagcctgtttgagcatagtagtaactgtgagattaattcttcggttgtactgcaattgcatagttcatgtggtgatggaagaggattgctagtttggcatctactgataaatgcaaacaagaagggcagatcatgcattgtgggggttattaatacccatcatgtgtcatgttgaggactgacggtcatctgcccatgtttattcatacccacgactattctcagtacagttgtatcaacttgacgaattaactgagttcaattaaaactttcattagcttaaaaaaagctgcatattcagagggcattgtcttggtactgttgtgtaagtacattgcaaaattggttctgtggcataataaagtgagtgcttcttgcaaattgcataacttacgtgatatttgaactcgatcggctaacccattacattgtggtgtgtcacgcccggaatttctatccaaaattccaaacgcttacatgtgtgtgaaccctcgtccaggaatcagccgaggcacacaataacaaattgataatagagtacaattattactctaattaataggcgaataaaaggtcattacagaggtagatagttcctctcaatcaataaaaatctaagcagcggaaaataagataaacggtgcggatgactccactccataggtagcttgaccaaggctacacctaatcctccacaccagcagcatcattgtagaactcttcctctgatgaatgattgcaaggtgagtatatgacatactcagcaagtcacgcagcaaatatgcaagtgcacaaggataccaaaggatggcatagtagagttttcatttgcataaacagcatttaacaaacatttgagaatttaataaaacagttaagtattaaacaatattaatccaacgctacacaacataccctgttgtacaggcccaaccattctgaacaaccatcccggctgcacagttctatctccaaaccaggaatgtaccattccaaaccaggagcaaatcaaattattaccaattaaagcaccttttattaagatgagaagtgtgagactaatcacgaaagacattgttagacccgcccataactgcgggcacggctattcgaatagttttactctgatcagaggtgtaccactgtacccacaagacacaaccccacatcatgtcaccatgtgcctcaataccaccacggtacctcggaaaggagttgtgacaatactccttgcacaacacaatccattacagcgcaccttttctggatcataatcacccccttataaacaaggcatggactccccagcgaccccccgtgggcttatctccgccacttctcagtctggtgctctgcaatgaaccatgctatacaaaagataaagccgttgcccacgctggcttgtggctggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatagtgagtcataagttatcccaataatgtgctaatgtttctaagcagggctaagcaattatatctaatatctagttgaaccaatataaataaagctcaactagtcaaattataataacccaaggtatcaaggaataaagtaataaagaacaaaagggctataacaaagaataggttaattccacccaatgacattcgaaaataaatgcaatagttgaatagaaacaatagcttaaaatatgatcaacatgctcaaagggttgtttgggatctgtgtgacttgccttgctggccttggaactcttcaaactcttctgctgcgaaaacggactctccggaaacgacggaatctaaacagaaagaagcaaaatcaccaaacagcacataaacaagcatgaacagtacatgtggatatttttaacatgtagatctcaattttagaaaaatttagagacttgaaccaactaaatccgagctaagatgaattagttatgaattttcaagattaaatcggattaaaatacttatattgattttaattgaattatggcgcaataatgaattatttttgaaaaggaaaagaggattattgcgtcagcggctagggtttcggtagaccgggtgcacggcggcggttcacgcgaacggacggctgagatcgactttgtcggtgatatgggaccgggagtatcatgaccagaggcttgaggcagacgcaatcgcccacgtggcctggcaccttcggggacgtcgggcccgagggtgaggtgtccgccctcctcgtgatttcccctgagggggggtcgggnggcgcttgcncggccccgagggccggggcacccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaagggttaggtggcgactggcggtctgacgcacgcctcgccccatcccgtcaagacgaaagcctcaaggcaactcgtctcaagccggagctagcgtgttatctcttagagatggcacgttagccctggttagatttataccaggcttcatcctaatcattacaggcaaggtgttacacgaagaagggcaaacatgcacgttgttaaactgacgcgtggtggacaagaatgaccggtctgacactggtcgcatcagcaacgggcagccacgatctcacgttgcgcccgtctccgccgggagtggaggtaggtgtgagctgtcccatcgaagtgtcatttggacgacaaccataccaatctccgcccattaaagagaagaagaacagtccagtttggaaagggaagggtgcatgtggtatccccttgaagtataaaaggaggaccttgcccatagagaaagggttggtggattcttttccagatttagagcttagaacgggggagaagttggctgacactttgtagctcattcatacaccaatccacaaaaacacaggagtagggtattacgcttcccagcggcccgaacctgtatacatcgtccgtgtctcgtgtttcttcctggcacgcgatctttccacacacagcgagagcttgagatctcaccctaagcccccggccgaaccggcaaaggggggcctgcgcggtctcccggtgaggagccacgagctccgtcatctggcgcgccaggtaggggtctcagcgtgtgctttctgagctctcagactcttccgtgtgccccaagtttttcttgttcagcctaatggccgagcaaggaaaaacgcacgacatctcgccgagtgtgagcggcgacgacggggagccgaatccacgccgtcgagctcgtactcctccacctcctccgcgccaaagtcctaagcagggggaggcgcttgagagggtcgacaaatccgcggcgtcaccagccgcaggtgatgcaggagaacggcgagatggggagcgtcgcctcctcgtctacggcgacggcagcacgcctcagggcgcgcttcaggctgctggcgcgctcctacgacacccgcctgtcgtccatgacccggagtctccagcccaacgatggctggaagacgtggccaacttggtcatgacggctcagcagcgcttgggtgctggtggacggtccgccaccaccaagacctccggcgccgctaccaccggctccatgtcgtcaaggcggagggcgcggcgagcggcggcggctgcacgtcattcggctgctactccctcgtcgacgccttcgactcgggaggatcagcatggggagccggatgcccgcctcaacatcgagcgccggcgtaatagccggcgtaccccctgtgcaacggagggtgcctcctcgtccagagtgtcacctcgacatggacgtgaggaccagccctccgtgcctccggctggtggtgttggctgtagagcctttgtggcgagtcttcggaatgtccgttggcccccaaggttccggcccgccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgataatgagtcgcttcgctcgtacattcagcggttttgccaagtccgcaatactataccatgcatccctgcacacgcggtgatttacgcgttcagggggggtgtgcggcacaaccgcatgctcgaaaagattgcctccaaagagccccagactaccgcggaactttttcagctcgcggaccgagtggctcgtaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcactccgcgggccacccgaaaggggaggcctgcgagcgacaaaaagaaagaggctggtactcccagcagggagcgtcccgccggcaggtggtgctccgtccataacacctccctccacgatctcgcggactgtcgcgcagtcaaaaatttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaaacgagagcttctgaccatggcccctactcatgaggcgatgcgtcgagcgcggtggtcggaggtcgctctcactttcgaccagaccgaccacccaccgtgcattgcccggggagggcaggttgcgatggtggtttcccccaccatctgcaacgtgaagttgggacgtgtcctcatagatggaggagcggctctcaacattctttcccccgcggcctttgatgctatcaaggccccggggatggtgctccagccgtctcaaccgatcatcggtgtgacgccggggcacacgtggccattaggtcacatcgacctaccggtcacctttggtggacccgccaacttccgcacggagcgggtaagcttcgatgtggcggacctcagtctgccctacaacgcggtcctcgggaggcccgcgttggtgaagttcatggcggcggtccactatgcctacctccagatgaagatgccgggccctggtggccccatctctgtccgtggcgaccttaaagtcgcgcttgcttgcatggagcagcgcgcggaccacctcgctgccgcgaccaagcccgagggtggtgacgagaggcttggcacctctgcccccaccgccccgaggcagcggatcgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttatcatcagattcgcatggctagggaggatgaggaaaaaactgcgttcattacccccgtaggaacctattgttatacatcaatacccttcgggttaaagaatgcaggtcctacttttcagcgtactactcgaatttctttgggtagccaaataggacgtaatgttgaggcgtatgtcgatgacttggttgtaaaaacgcgcaaccaagaaactttactttcagaatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccctagcaaacttagggatgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatctcagctctcctccggttctagtcgccccggagccaaatgagtccctgctactttacttagcagcgaccccccaagtagttagtgcagcgttggttgtggagcgcgatgaggacaatcctcattctgcgcacccccactctgtgccgacttggcccgggagcaggcagggaggagaggcccccgagtcaaacggtggcctaaggcccctgacgaccggagacggccctctgcccgcttgtcaaacggtgctgggtgtccccgaccctcaggaaggccccgaggccactgcgggaaggccacacttaacgccctttgaccccgaggctaaccctgtgctgagccgacccgggaaagagcagggagaagaggcccccgagccgaacggaggccagaggcccctgacgaccggagttggccctttgcccgcttgtccgacgatgccaggagcccccgacccccaggacggccccgaggccactgtgggaaggccgctcctgtcgtcctccgaccccgaggtcatcggcacagaagacgagtgcgccccaaggggccacttggacgaagaacgccccgggggtacggcccctagcaaagaggatcggccccaccgaagggtgcagcggcctgtctactttgttagtgaggccctccgggacgccaagacccgatacccacaggcccagaagatgctttatgctattctgatggcctcgaggaaactgcgccattatttccaggcgcatcgggtcactgtggttacgtcttaccccctcggtcaaatcttgcataatcgagagggtacagggcgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcgcgaacccctcacagctgcctcatgccgcccactgggtgatgcaattcgacggttctctgtctcttcagggcgccggtgcaggggtcacgttgacctctccaaacggagacgtcctcagatacttggtccgtctcgactttcgagcgactaataatatggcagagtacgagggactccttgccgggctcagggtggcagccgggctggggatccgccgcctcctggtgttaggcgactctcagctggttgttaaccaagtctgtaaggagtaccggtgctccgacccgcagatggacgcctacgtgcgccaagtacggcgtatggagcgccattttgacgggatagagcttcggcatgtgcccagacgggataatgtgattgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgcagacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgaactcttcggcgactactgcgaaaacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccgtggaacattgaacaccttcgtcgcttctacccctgaaggggggggtcgggtgtcaggttttggctcgggctaaccccgcacccccctcgggtgtgccgggttagccgggggctaccacacatgcacatatattcctttttcctttatttcagcatttcaatagaagcagtttcaattttctaaaggttgtgtctgagccgttttttccttttgaggaatcttgacttgaaataatgtcactcgtgctcaaccccaccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactggccccgacccgagccattcgaggactgggacttgggcacgagcccttatttcaagctaaggcgcaaaaggaccatggcacagatcatcctcatcgcatatgtatagcaaaataaaactaacacaaaaattttttcatcatttcgtttctgattgcagattgagttaatttatacaaaaaagaggcatgaaggccttagaagaaagaaaaagaaaaaaagtaaagattggcgggggctcgggggctcattccgatgcgcccgggtagccggcctcgtcgccaccgtcatcctcaccgctggcgtcgccctcctcgtcggagctggagacgaacgcgagccgaggggccgacccctcgaagccgttgacgatgtggtcggcagcatccccgacccgcgcgcgcgcgtcgtcctcggtcccgggagggaactcctccagcgccatccagggagagaaatcggggtcccgggcctggtaactcgctagcacgagttcgaccgccccccgggcgaggtccctcgaggatgacttgatggtcttctcgagctcctcggggagtcgttcgaggacccaggccatcctgttgaggtgcggagcgaggccttccaggttgcaagggcgcgtcctcgtctggcctttccagaggcccgcttgccgaccggcgcgatccatgcgggagaccgagtcccaaagcatgtcgggccccatctcgcccaccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcgtgcgccgccagcgtcgtctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcaagaaccccttgggcggcgtcgagcttgttcttcagctccgcctcccagctcccgtgttgaaggcggagggagtcctgcgcctcaatcatcgcggtggtggcgacaagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcaacacgcgcccatgcggcctcgagctccgctcgttctgcgcgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaggatgcgctgggctcggggatgtcccccgggcccgtttgatcctgggcgtcgcccggtgaggtaggcccaggcgatgcgcccgcggcctcgtcgcgagccgcctcggaggatgtcgcctgagggccgcccgagggagtgggcccaagtgacgcgccagcagcggctgacgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggacttggggtggcgggaggaatgcgacgggacatcgctgaaacagaaaaaaaaagccagaagacgaacaaagtgagcaagaaaaaaaacttctttttggagaaagatggttgcaatgagagtgagacgaacctgcgagggggtcggttgaatgaccaccttggaggggaaatcaggtttccccggcacggttccgtctcccccgtcttgcggagccgcttcttcttgcgcaccccctcgggctgcgacgtcggcgcggccccctccgggcgccgactgctggcacgcgccgccccgccccctcggggaggagatgggggaggtgtacctcccagcttcctcttcccctgggcgtcggcagggcggctgctccccgagcccccgacgcggggcccagaagcacgaccccctcctggggcaggttgttccctccggcgtcgctcgcccgcgccgtcgtggcccttaggggctctctcctctgaggccccgacccccaacataatggttagaatggagacgcggtcgggatctatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgacgacggaggtaatcgccgaacaccatggccccggtgagcccctgggatcgcaggcccgccaggcggtcgaggacggcgtcgtactcctcccccagatctaccggcgcccgccagctggagacctgcgccgggggctggcttggaagtcggaggcgcgcttcgtcggcgaggggggtgtagaaccagtcgctcttccagtcgtcccacttcttgcggaggacgcaggggaggtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgcctcgggtagtctggtgccgggcgcccctcgcccagcatcactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgtgtgtggcgaaagtagggcgtagcagagaaagagttagagctcaggcggcgaaggcaagaggaacaatggcgaaaggaagggagcaaatccttttctcgatgcttttatacccttgcaatcgctgggcctggctcctcgtttctcgcgcccactacttcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgtccgaagcggcgttaccgtatctccaggcgagacaaatctgctcacccagattcgcgcgctgctcaagtggtgtggcagtcttgaatagaccgcccattatggacaaacaaagttatcaataccaatgtgcatggattgagaccgttgggcattttgcccaactacggagaccggtcccacctgtcaccaggctttaggggtggcgtcacacttgaccgcttcccttgggaaaggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcgtgatttcccctgagggggggaa

SEQ ID NO: 25863 - DNA, 7632 bp, Oryza sativa
atctcacggtgcggccgtctccgccgggagtgaaggtaggtgtaaactgtcccatcgcagtgtcatttgacgacaaccatcccatctccgcccattaaagagaagaagaacagtccagtttggaaagggaagggtgcatgtggtatccccttgaagtataaaaggaggaccttgcccatagagaaagggttggtggattcttttccagatttagagcttagaacgggggagaagttggctgacactttgtagctcattcatacaccaatccacaaaaacacaggagtagggtattacgcttcccagcggcccgaacctgtatacatcgtccgtgtctcgtgtttcttcctggcacgcgatctttccacacacagcgagagcttgagatctcaccctaagcccccggccgaaccggcaaaggggggcctgcgcggtctcccggtgaggagccacgagctccgtcagacttgatccaaaacggacggccgagatcgatcggtccacgaccggctcacgggagacggggacgatgacgtcagcgatgacgtcaccaccggcggcggcggctcggcggctcggacggcgcacgctcgccggcgaacggcgacgcttcggcacgaacggaggacaccaacgggtagagcgcgacgcggcgaactcaccggtgaccaaaagagcggcggaagaccaacggacggcgacggcgacgaggttaaaacggcggcggtcttcgggtcgacggcggcgatggtgctccggcgatcttcggcgacggcgaaggggcggacaaggacggcgacggcttggcgaccacgacggcggtcttcccgagcaacggcgacgtctggaatggcggcggcgctcggctggagcaacggcggcgacggcggctcgaggctacacggcgctagagcgtttccgacgacgagaggcgaaggcgagggaggcgactggtagagaagagctcgggggtccttttaaaggggctaagaggcggcggcgaaggcccacggcggccggcgacgagaaggaaaggtcgggctcggagagagaaaagccgatccgattcgacttcgaatccaacgatttccaaaccgatttagccgatgtttccaaaagagaaaaggtagaggagatcccgaagattgtttcccctctatcaattcggccggaaacggaaaggatcgatcgaatttggaagggaacggcggcggcgcgaaactagggtttcgggcggcggcggccggaggtagacgacgatctgacaggcgggccccacctgtcagcgacagcgagagagagaggagagcggcggctcgggcgcggactgggccgacttgggccggggagagagagaagggttttgggccgactttcggcccaaagccaaaagagactttttttaaaacctttttcaatttaaattatttatgaaatgcaattccatttattaaaaatacttccttagctcaaataaatcccagaaaaatctaggaattatagaattaagcaaagtatttaatgaaattttatctggccccattttatattggaatttattaattaaaactagatcttctcttcaaggcttttaaaattatttctaaaaattccaattaaacaacaatttatatatttatgattttcagggtgtgacatggtgctagctggaagaccccgttgccattctcataacaatggatatgagaggaggagctctcatattggaaattattaagaggagtgaggctcaaaacaggattagctagaccactactttcagtgctagctggaagaactccatgctaatatagccagaggataattaatgtactgaacaagaatattcggagataattaccattacagctgcatattcaccttgaagtttcagagataatatggttgggagtattctcagtacagttgtatcaacttgacgaactgagttcaattaaaactttcattagcttaaaaaaaactgcatattcacagggcattgtcttggtactgttgtgtaagtacattgcaaaattggttctgtagcataataaagtgagtgctcacgtacttcttgcaaattgtatgcatcatattgacaaaagtgagcaagcactatctcaatatagttctcaacctacatgagtacatccttatctgtgtaggatgaacagtaacatgagattgtatcattgtagcgatggattagtgcaaattaaataaaggcaacttccgaagagctggcgcgatgtcctgtctattattcagattggtgtctcaagatacagcaaccatgttgtcttgttgggttgatgatcgatgattattgctgtaccctgtacgcgtcgtcctgttcgtattcatggtccaccagggattatcgatacacaagtgacggcaactatgtttctctatacattatacaatcctgtgtcagaaagacaaatgacatattttcttcttttttttcaaaaaaaaaaagaagccgacagagttttcaatctttgtttgaatttctagtgcaatggtatgattgaagatgggctatctgggcagcggcagccgtctctcgccgccggtcacagtatcacgtggatcccactgttttttaagagtaaattttataaaattaccagtataaaactacagatttaatggtaaatttatcacaaaactatatattagcgataaattcatcctaaaattacatatttaaggccaaacattataaaactacatatttaatattgaggttgtcacaaaactacatattttaaattttaaatccctagcactaccactatgaagctataagcactggtggagaaaccctttgtagtcccggttcgtaacccccctttagtcccggtttccaaaccgggagtaccaatctgggactaaagatcgctatctttagtcccggttgaaataaccgggagtaaagatcgatctttagtcccggttggtaacaccaaccgggactaaagatcgagctgacctttttttttttcatggccctgttgctgcatggtttatatatatatatatatatatatatatatatatatatatatatatatatatatatatataaaccatgcatatatatgtttcaatacatatatatgcatacatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtactgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacacttgtatgtatttgaatcggagaaatataaatgtagagcatgtgtactaacaggaaatttgaacttccgcctaagtctttctctccatttgccacggaccaattgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtacaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgacggcgtccagctggtatagttcgtagatatgtgtgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacaatggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtgcagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcatgaggaggagatggcggagccggaggagatggtgcacgagacgccgcttgtcgaccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttctggaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggcttaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgtagggcgagtgtcagctcgtccctatctctgtctggtcggaacgtgccctgagaggaggcttccactgcatctgttagtcgtcgtgcagcctctcgtatctgatcgccgaagaccagtgagccatcagctgggttgagcgttccaccgtgagcatagtaccagaacttcgatcgttccggccaattggctgttgccgtttcgatacccctctcaatcaagctagcctccatctcctcccactttggcatcgcgacgctatagcctcctgaccccaagtggtgatggtacttcttcttggcggcattttctttgtttctttccatcatcgcctgcccttgttcacctgtcttataagcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggctgcttcggccggggcactaggacgtccatcttcttgcacttccgttatgatgtgccgaccctcaagcttcttcgctgcacctcgttgcccgcgtgccctcttctgtccaacggagggttgactatcactagcctcctcctcctggttcccctccacatccctttccacgtgcccctgctggttcccttccgcatccctctccacgtttccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgatacatttatgttttaacaatctaagtcatgtatgctaagtgtaaatgtcgtacattagaaccctacacaaccttacgtgctaagtctaattacaaatcgtgatataagctaagtcaaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgatacttgtcgcaccacttccgtagtcaataattacatactaagtgtaattacaaataaagtaatcttatattaaaactcaaataatattagaacactacacaatcttatatgataagtccaattacaggtctaataatcttaattaattgcattaccaatataacaatcatttatattattacgtcacttgcctgctccaattccttctagggctagctcttccactctggcttgacggacgactccgacaacacgt

SEQ ID NO: 25864 - DNA, 386 bp, Oryza sativa
cgaccatccatctcgttcatgtttatgattgcatggatacaagcttgttttcccggaggcccaatttagcctatagggggctacctagctcgaattcaccgtatagtgagttacatcacagttaactggcagacattcaacaacgtacatgcttgtgaaaaccctgcacatacccaactgaaccgctgtggaaaacatgaagaggcccgcaccgatcgcccttcccaagaggtccgcaccgatcagggtaaatgacacgcgcccatgatgaaagcataatgcgcgctgagtggggtgtttactctcacagtgatgtgctaaatttaacaccgcctatggcccactcttagtactatctgccctgattccctatacacgagccacgt

SEQ ID NO: 25865 - DNA, 697 bp, Oryza sativa
tcctgcagcccactccatgtatggcttggtatcggatgcgtcaattggtccgtggctataggagagaaggacttaggcggatgacataatcttttgatagtccacatgctctacatacatagatatcccatttaaaatcatacaagtgtatattatttaaatcactaaatgagtgtcatcaatgtgttaagagcgaagcacaatcatgtatataactagggcggatattacgagtgcatttaaagatgcatattagttatccaaaacctctcgactagacagctagatgtgcgtacacaccaatcaaaaacttcattacagagcgattgcttggttaatcactaatcaattgcatacattgatatagttgatgcgcatgagggataacctgaccacacacaaagaatagggggggatgggaactgaacacttatggggagatatatgcgaagagatcctagatccatattgtgaattgtacgacgagagtatcccaataaacaggtgcttaccgtctgagcttgctgcgcgagctcctgcttactgagagcaactagctaggacatatactggatcgtattaagacatgactacatatggacctatatgcatgtgtacacattttctatgatgacaagatattgtgggcatgtgtctatcaatatacatatgcatctgcataacatatatctgtata

SEQ ID NO: 25866 - DNA, 933 bp, Oryza sativa
  unsure (1)..(933): unsure at all n locations
ccgctatgtgatctccatcttgttactgacccaaaaatgacctgagtatggagacggacgacatcgcaaagacatctacagctgggggacctctagaaggggaatagctctcttaaaagcatgatggccatagctatcctcggcgcccaacagtacttcgctcacctatccacacaacatacaaaccggagcgaagctacaatagccagagacgcctactgtgcgtgctaagacacattaaatgagaagcgctcactggccactttacaggcaagaaaactggctcgccagctgacttaacgaatataacatcgctcattaagaagcgtatactgaagtactcactgttacgctacattattcaatgactcaatattctggctggttctattgccgccagcagaatctgctctctcaaaggcaattatacacctattcacaatatcatgcaagaacacactaaggaacatgctatgctatatgacaccaataggccagcaacctgttagacgctcaagatggttgcgagcctcatagacctacaccacatgacaagcatgactatactggactctgatgtcagacgtggccatagccatcagaactatgaagataccaagcctgtacccaagcatgctctatcgtgcccttacatgcgcacgctgtcgtttaccgcaacctagacagctttctcccttgcagacagcgtggccacaccaatagctcacgcatattgtctcgtcaatcggtgcttgcacgcagcgtcaagctgaactgtatgacacacctgcatgctagccttacggtgagcctatccagagatatcgcatagaatacaacccgtatgacacgaatattatcccgtgaggaccancgagacatgatagcggaccacagattctgcgagcctctagatctcatgggtgccgacaa

SEQ ID NO: 25867 - DNA, 1429 bp, Oryza sativa
  unsure (1)..(1429): unsure at all n locations
acgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggactctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttntcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatcatgtatatgctagttatatgtgatacttacaatttttaaaagttttaactcacacaggtggcaatttcatatgtatgttaattagagtttttaacatttaatttactagcattcatatgctaattataattgactagaggatttttaaaagttttaaatcacgcaagtggcaattttaaatgttaattagagttttttaacatttaatttactatcattcatatgctaattataattgactggagaatttttaaaagtattaaatttaatatatttttaaaactatcattcatatattagagtttttcacaatttaatttactatctttcatatgctacttatatatatgactattcgaatttttaaaaggtttaaatcatgcatgtagcatttacatatgttaattagagtttttatcatttaatataatataattcctacgctaagtatatatgatgattacaatttttattaattttaaatcatgcagtat

SEQ ID NO: 25868 - DNA, 663 bp, Oryza sativa
acgagttgccttgaagctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcgggggtggctcgaggcgaatcgagaaaaatacccgcgaaaatggcctattagtcaactagacatacgcgttatctgtcctaatgtcagggcatgtcctaagtgtgtgtgtcctgtcatgctattatcaccgacaaagaatatatgcacaaatataatactgattatctacattcctgagatgtaccaataagagctgacttttattactcccttcgcacaagattgttgcaacctaagattgtcctatgatgggtctagtctgattataccctacatcgcagcatgttatgacgaacgacgaatcattattttgtggcagtgctgcgtgaacaaatctaacgtatacacgaatgaaatttgtgcctgtctctagccgttgccatgcagcaatgcattgtttaaggaaagtcgcgttatatattc

SEQ ID NO: 25869 - DNA, 761 bp, Oryza sativa
  unsure (1)..(761): unsure at all n locations
gccaacctctatgtacggttgaaagagctggccgcgagggttcgcatcggtggtgcggctgtgggcgaaagcgacttagccgttcgcctcgtgtctgccgaactcactgtctctgacatgcattgtgcgctgtattcttccatcggggaggccgagtccctccgctttgtgggcgagatggtgcccgacatgctttgttactcggttctccgtatggatcgcgccggtcggcaagcgtgcctctggaaaggccagacgaggacgctctcttgcaatctggaaggcctcgctcctctcctcaacaggatggcctgngtcctcgaacgactccccgaggagctcgagatgaccatcaagtcatcctcgatggaccttgctcggggggctggncgaactcgtgctagcgagttaccaggcccgttaccccgatttctctccctggatgtgcgctggaggagttccctcccgggaccgaggtcgacgctcgctcgcgggtcggngatgctgccgaccacatcgttaatggcttcgaggggtctgccctctcgctcgcgttcgtctccagctccgacgaggagggcgacgtcatcggtgtggatgacggtggcgacgaggccggctacccttgctgcatcgnatgagcccccgagcccccgcccaatcttactttntttctttttctttcttctaaggccttcatgcctctttttggataaaataactcaatctgctatcagaaacgaaatgatgaaaaaattttg

SEQ ID NO: 25870 - DNA, 636 bp, Oryza sativa
gcgagttaaattgttactactacatagcccaccatatatattcacgttgagtcaggtaaattttaactgtgtgattcaccaactataatgaacatgacttagcatattgagttattcattaactaaaggaaacttttttttgctcatgccttaatttttttttgttattattattatcatcattattattattattattattattattattattattattattattattatcattattaatactattatcattattattattattattccgtcacataatggttttgcaaaattcaaacgcctacttattaaacggctcctgacatattgaccacacccacccactgcccaccacctgagacagcctgattttctgctcaaggatttataaatcatttaataaattatcaatagaattcatattaaaggtccattaattcacaatgcgaagttaactgcgggaaataaaagtcactatctatatagcaagcctggatccaatctctattaaattctccatgattagatctactctccggaatgttctcagattgttgacagctcaatcactaagtctaataatacaaagaacaatgtaccactcttctaacctataaatgtatcattaaatgatct

SEQ ID NO: 25871 - DNA, 1701 bp, Oryza sativa
agaggtagaggaggaagataatgaatggctgacggagaaaggaaatgagtgagcttctaatcttattcaggattcgtccctaagtgcatgtgcgaagtcctttctccttggttacgcattgacaagtagagagcatttccaccactcatatagacaatcaagctcttcattggatggggcaagttgctaataggtggtccaggttgtcactagcccctggattgttacgagtatctgtgagagaaatgaatgttctattaccacatagtggctagcgaataatgtaaattcttttagaatttttttaggagaacgacggtaggagatctgccgcaatttaaattagggaaaaggccgaaacccagcaaagagtttacagagtttacatggactataacagagaggaaatacagcttaagaagaaaataaaatcagggggggcttaaaagctattttgcaccaatccatatcgtgtttgataaggtatgctacttcatttactgacaggcaagaattttgaaaaataaatatgtatctttctagccaaatattcaccaaagtagttagtacgtgtgcctctgataccctgcatatgaactttgcgtaccacatggatggttccattccaccaagtttcaacatcatggggatggggtgtagttataggggttagattttggaaatggcagattagactccaagtttgtctggtaaaaatacattcaaattcttttagataatagtgatgaataatgtaattgaacagtctgtccaattactttgttacagtttcatggcggtggtgttccaatattattgtcgatgcgatagacacgaacaccacaacacggggccggctaaggccttgtttagttggggaaaaaatttaggttagttgtcacatcggatatacggacacacatttgaagtattaaacataatctgataacaaaacaaattacagattccgccagaaaaccgcgagattaatttattaagcatgattaacctgtcattagcaaatatttactgtagcaccacattgtcaaatcatggcgtaattaggcttaaaagattcatctcgcaatttcccggcaactgcgtaattggttttttatctatatttaatacttcatatatgtgtttaaatattcgatgtgacaatatgaaaaaatttgtttgggaactaaataggccctaagccaaattggccagatgtgatcgatcgttcaaatgggcaattatgtttgctaggcaaaccatgtggccggaggccatgcatgtagctatagagaagactctggacgaaagacttgtggagttaacggcacgtacggtgccgcacagggttatccttgacacttctgctttctatcactgctgctgctgatgatgataatgatatatatatacacaaacactccaacatatggacaatcttgcaatacagacttgagtacaccaccgagtcatttggcgcacgatcgatgataataattaatttaataggaggacttgaagacttgctctcatccctgcagctagcgagcgtgattacatatatagagacgaaaagagttgtgttctatggtaatttgccaatgaattcataatttttagcggtagacatttgccggtaattctgtgtcatggtgaagtgtactggtgccaattattctataaactggcacacatgatgat

SEQ ID NO: 25872 - DNA, 19730 bp, Oryza sativa
ttgtcacatgacctcgagcaagagaattgaacactatctgccatctatagcggataatgtgataccgtgaacactagatgcggcaataacagctgacgcctcttcgttcgtcagcctcatggtgaaaaatgcagggtgcttaggctcaggtagggtcatagtctcgttgcttagcattgcaacaacctctgacgtggaggcccgatcgaccgcattctcttgcacacaaagcaaagcaatgttaatacatctcattatctctattgtatgacaatcggtgggtaacaatgggtctacgagtggaagccatgtttgatctttccacatctgccatgcctgcaaggtgtatgatcgcaaaaaacatgacctcaatctacatgacattagtatttcttctatcgaaaaagtacaaaaaaagactttaattttatatactactgaaatcttttcgctttgcattttaggaagattagaaactcaagtcattattatatgatgaaaacttacatggccaagaagattaataaattcaccatatcgatgaaaacttgatgtctttttcccactgacaatctcaagaattagcacaccgaaactgaatacgtcggatttgattgaaaaaaggccctcagaagcatactcaggagccatataaccactgaaaagatgcacatacaaaacattgaagtgaggtaacagtattggcagttttgtgtacagctaatgaattttataataaaatcttactatgttccaacgatcctttttgtattcccttcattatcattcacgctaaatatttttgcaagcccaaaatctgcaattgtagggttcatttcacggtccaagagaatattgcctgctttgagatctctgtgtatgacacgcaaccgagaatgcttatgcaaatacagaagtccttgtgctatcccatctattatcgctaggcgtttatgccaatctatcaaagctcttcttgtttcatctgcaaatcaattcaacatagatataacaaagaatatacatttcgcagttagagttagtgaaccaaatcttttatttgcggtacggtacagcaagaagtaataccaaaaatgaagaaatccaagcttttatttggcaaatattcatatattagtattttctcctgtccctggtaacagcatcccaagagcctaacaagatttgtgtgctggagcttagctatgagttggatttcatttttgaactctgtcaagccttgccctgaatgagaagcaagtctcttaactgctatctccaccccatcaggaaatcggccctagagacaagtgcaaaagagatggatgagtgacacgagttaatttgcagtttcaattgacttttgacacttgacaaatattatgatcaagatataatcggccaaagcagagagtgaattgcataatactccatgtaaattaacgaataatatatgtgtataacttttgtcagatttttcgtcttatgtaccttgtatacaggaccaaagcctccttgcccaagtttattttcttctgagaaattatctgtggcctctaatacttgcgaaaagtcataaatagtgaattctgaacttcttccttgtagcccccaaattagtgcttcatcttcatccgcgttcgtcttacctgataaatgtagaattggtttgataatatcagttgatttagctctttatgcattcatgcatgtatgtaactttttttatgtagatatatatctgaccttttatgtgccttctcaatatgatggaagcgatgatacagagaaacaatgcaagtagtggagctaccaaagcagggaccaaaacttttgctacgggctctatagattcagagcaaatggttagtttgttttgttggaagcttggtaaggagataatgaaagtaatttttatctttaattactactactctcaaatatagcaaaattagaactgaatgtgacacaacctagtactacaacgattatgaatctggataaagggattgtccagattcaatgtaagtaataggatatatgtgtgtgtctcctatctaatactaaattgttatattttgtgatggaggtgcttaagtaaagatagtctctacgcaaagatgtcaaagaagggcgtgttttgcttactcttttgttttggccatgttggcagtaatggggcgggctgtggcgctggacttggaactagtgcattcgacgacgacccggagctccacgtcggctcaccggcgaagaacttatccgtgtcatacctcagattacaccggagagcaagaatacgtcccccttgccgaccggcgaagttggccgtcgccagatcgctgaaattctgaagacagttgtagcagatatcttcaaccaaatctggagcacactgtgccaagcagaagagcctccttggaagggtaacggtgttgcttgcatcggcatcatccatgtccacgcggattgcagcgtagtgcttcgtcgtggagagagcttgtgctactatgtaattcatcgtcttgatgaagaattgggtgaagttttttgtcccctggatgttggtgttccagccggataacatgggctccgacgtgatgttcatcaggacgagcggcgcgacgccaactgcggccgaggtgttgacacggccgaaggcgtccatgttgaggatgtcctcgtcggagaagcggagggcgcactcgtcgtagaagacggcggcgtccttgctgagcgggcagagccgcgccgtcgcggccgcgtacgcggcgtcgacgcagccgctgcaggcagaggcgttcgcgtcgccgcggcagagcgcgacggcgtagacggtgtccggggcggcgccgcgggagcccttggcgaatagggcgccgctgctggagtcgccgcttacgacaaggaatgatgaggagagaaggctgtcgaggttggattggtagatgctgttcgccgtgtatttgctgctgccgcagatcatccagggctgggcggcgaccataggcatcggcaagaagaagaagcagcagccaaggatgagcaggacggtgagaatcatggctagctatgctgcctcacgcgtaagcgtaaggtttctctgaatctcttgcattccaaagacagggtcgcatgttaagcagatcgaggcagcgacgacctgtgtggacaagtcactgctatcactttcatggagcgggtgcaatgtatagtacaaggccagactgaacgtaaatgcatgggcccacacgttgaaattaatttagaaggtggttgacatgttaaatcatgctttctaatgtcccattctgaacatgatatattttaataccataaatctaaatataattatttgaattcgtaatattagaatgtttcgtattcaatactatatatactacttttacgagatgacgaaggaagcaagtatataactccgtctccaccatcatggctgtgaccatagatagtttcaccataaccgtggaaccccgtgtgttttggtttcattttgcttttcttactccgaaagcctatacaatatgtgtccttttctggataaggtgttggattttttttccgctgttgttagtactcttttcaaaatattaaaacggtgtgtttcgtgtaaaaaaactttaaatatataagttgctttaaattatcaagtaaatccaaaattttaaatttagagcaattaaaacttgattagttatgtgctaataacgagctcgttttgtgtgcactaatttttaaccttcatctacagcccacaaggcactgaacatctctacagccttcatctacaaccttcaaacagggccaaggtatgaaaactatgctcccaaatctctacagcccacaaggtactgaacatcgaagtcaaattaaccgcccacaaaacatacaagtcatttattcgtgtgctgcacaaagtaatacactcagtgtttagggtggaaaataacgtctaagatctcgtttgtttagagatacatatatgtgcgggcgtgccagtgtacctaaatacacaatgtaaacaaaacatagagaacatgctctttattaatcttaaaagatcataaatacaaattcccaatgtaatatatatgtatgcgcgctccataatctgtcattggacagatctgacttgtgcgatgtggtctcctggttcctggggcctcgaaaagctcccagttaattacctccgcaagtctaggcctgcaagagaacctccgattaagctgcttgtggtcgtctcgtcgtcttcgcttcgcgttctccatgcatggttgggatgatgatgtagatgtgtgtgtgcgagcgccggcagcgatccacagcctcgtcggtccgtgcgccggtgttggtagcgtggccttcgtatcgacttcgcccgccctccgtcgtctagcctcgtcggtcttgaacaacatgcatggagttgcgtagctcgaacgacttgacgtcacagcagttgcgtcgagattagattaggaaagggagaaattattaaagatggttgatgtagacggtaaccggatttaatcaaagctcggcatctcatttgggacgaataagaaaaaccaataggacttcttcagcccacgcattggtttgtgcatggcactgtagcagtgatgacatgtcgtcctccgattggttggccacgttgccacaataattaacttaatcaacatgcattagctagcttgttgccatccaacagcactggctcgccgtcctcccgtcgtccttccttcgtactgcagccatacttgtctccatcgtcatccgctggtttcgacgccatgcgtgatacttgacctccggcatgggaatggatagaaatcttggcagtcggtggcagctccggcgatcctcggcgcgctccggcagggcggcttcccgatgacctcctccatggttagcccgctccagtgcggtgaagcttgcaaatcaaggacgtccggcatctcggcgaggtcgcagcttcgggtagatgcatcaccagcagcttgaattagcagcgtcgagtccagggacaagtagcacagcgtcagctcgaacagacgccggcatcgatgaggcttctgtgacgcgtagatgaatcggccaccgcgacttccccggcgacgacgatacgtgcagatggatccctatgcatggatgtgtgcgtgctgtagatgaaagaaaacgaaacaatcttgctagcttttaccttgactagccatcaagctcctctcctgcgcttgctaatgatcggatcaccgcgcgcgccctctcctgccagacgtcgggactccggccgaagtcgctcgccgccgccggtgcgtgtcttcgatggatggatcgccgatgagagttgatggatggatgtgttgatgctggatgggcagatgcgttgatgatgggtggcttgtggatactggatgcgttggtggatcaatttgtggataagttcgtcaatgccccaggctgccgaggggtcgacgccttatataggggcctaaggtcggtgctcgccgcgtccgcgcgccgtttcgtccgcgtcaagttcgttgcagataaggctcgatcgatcagtttgttatttgttcatatccttcttttattttatctcttagcctctcccggtgtcaaatatctgagctctgttaacttctggagcatcggggagatggaggcccagccgcccgcgcgtgcgcagctgggtggcgattccttcatcattatttctgtagataagaaacaatcaatagagataaacttgatttgtaatttgctttgtttctctgctgctgggccacagtccggtgataagcgcctcgccagcgctcgcgcgaagtaactaactcgatcaagtttgttacaaagatagaatcaattggtttgttggttatctcttaattcatctggttttatctcttccgcacgcgtgagcagaagttgttcagataaattgaaaccccagcttatctctctaatttgatcgataagtaaactcatctagccgataaatcaaaactgtggatatgtataatacgccgtgattgtgtcattcattgatatgggctaagcccaggggcaggcgcattaaatttcttaattaagcccattaatcacctcacccttaatcaagcaccatatatttgtgtactgccatgcatgcatgcatgcatgcatgtacgtagttgcttcaccggccgactgacatagctagcttgctcttgattcagtatacacacgcatatatatactaattaacaagtatagattgggcacagtgtgtatttctatatttgcatggcgcatgcacacatgaaatggagagctagctggcctcacatatacctaatgatcatggctatcaggttcatcgttctagccgctgcaaaaatgccatcaaacactcagtccggtctaagaggattaacaaagacaattaattagagtattggaactactgtttgatacacgtgccttctaagcacaaacttttatatataaaagatgaatgattttagaacaaaattttccagataaaagttttgtaatgaaaatttcagaaaaaaaatgcactggggacacactaaatatagcgatctctagaggctactactgacgtgcagtgtcactagtattttttgttcttcctaaacccaaacataatatgtgggttcctggtgatgacatcactgcaatgcagactctgttcacgcccatcaacagtactatgggccttaatgggccagctgttgggcctagcctccctaagcccataatagcttttggtcacctattgttcgaatagttctcgagatattgttgtattttttgtttcctgtgttctttcatctcatacataacaatatagcagatattttgtaaactatatatgcgtacttcctagttaaatgaatgagcagtgtcctgcttaatgtctaaagtctaaactcgaatacatggtgccacacggccgaaagtgatcccacgacctactcttcatcgttttctaaaaaatgattcaatatttcaaactgatcctcaaaagacaaatgaaagtatgataaattggtcttataaaacacgttaactacaaaatgacgtacccatatgcatgcatataaatttattagttcaaatggacctaatttaaatacaagaataaacacatattagtttaaatgaagcatctctcctttaaccgtggcaaccatactgtgctagcatcattgtagttgttgcgtctgtagatcatctatgcacctttgcgtatcatgtcgacgctgatcgacttgagcctctcaatcccatacctatgagccgcgacgagcagattctgagccatgaacgccgtgtctcccttgtcgatcttaggcagggtatcggtgtagatgaactgaagcatggcccgaaacaccctcaaatccatatcatcaatccgaataacgccattgccagttgccgcagcagcagccttcgcctccttctgatctttcccgccattattgccgaagagctccgccatgaacaccggcgaccgtgccgcgagcacgttcttgtgcgccgcgaacagcttgccgccgaccctgatgcgcacgtcggcccccaccccgctgccgaggagggcggcgaggtgccggtgcaggtccggcggtggcaccgccaccgccgtggtggccgcctcacagcggataatatccatggtgatattacatctgatatagaaactttgaccgtctagatgtagacacgaccacaatcgactgtccatcttcttcctcttgatgaatcttgtatgcccccaacttggccagtagccattggcgaaggagaatttcttggccgtgcagatcttctcttcgaccaccgcaccgtacgtcccgctgagtagactgagcgtgaatttcgcttcgacgacgtcgtcggccgcggcgccggcagctggccgggcgaggcagaggtagacggagacccagtcggagtactcctcgcggtcgccgtcggggtagtaggctatgtaccaggtgtggcctccggcgtggaacttgctggagttgatgctgttgccgacgccgatccccttggtttgagagtagccggcgatcctcatggtcatcgacccggttgctgtctcgctcacgacggccgccgccgctgccgccgccgaggtggttttgggtttgggcttaccgtcgccggcagacttggaagtggtttgacccatgggtacaacaagctgtacctgccacggaacctagacaaacagatcggaggaggacgacgacgatgagttatcgatatgatgcgtctcatccacggatagattaattttgtagattgatgggaattagaacgagttcgatacggaaggaatcactgaaatatagaacgtctcgatcggaaacgtatgcaggtaggaaactttggattttttttttcaatatagatccgcctctgtttcatctctcactggattttatgcacattcgctcttggtccgtttcaatatcgaagcgaatccgtattcaattccgcaaaacttgagataaaaacggacggggtagctcatcgccgggccatcattggcgacagttaaacagaaattaatttggtgaatttaagccaaattaaaaagaaaaatcatggggaaatgataagtgaggggtgaggaatcgatttttacaattgaaagaggaaacatatgaggagacagattgatgtggcggcggctctagaattatgtcaagagagaagaacaagcggcgaatcgagacgcgcgcggtgaaaaaggctaggatgagcgatggctgggccgagcccaaacacagccaggccgagggatggaggggggagcaagccaaggcggggaggaaaaggagatgactttcggccggaggaggaaagtccaagagaaagagagatgaaggcccaagagggagagaaaaagggagtgtgagaaaaaggccgaatgggctggctcagagacgatgacggacgaaaaaataagttgtggaagccttacgtattttttaactagacatataggtatagatgtatagaaaaatgacgtgtgttgcaacagataaagatgtttttcagtgatataatagctactatgagctaagtaataaattgaaacattgggatatcattatcattatacattataattgaaaaagtttatgaaaatgcttccttggattcgggccaaaagcccattaattgctttcttttcagccctagctcagaccgtaggttttgaccataattagatcaacgcatctcatccacaaatcgattaatttgtagatgtgaattagatcgagttcgagacgaaaggaatcattgaaaaacagaaagactcggaaatttttttttaataatggattaaatcggtctctacacccaaagaatatacacagcataagactcggaaacttatgcaggtaggagtcttacttttattgaatgcttaggatttttccaaatagtcacaccaggatttcgtccgtagctaaccttcgtgcttcttgcgtttcaatgtaaatttctttccttttgactagtgctatattgccatgcccgtgtgtttcaacgggatctgaagattcaatgacgaaatacaaaatttctttccttttgactagagtgccatactgccatgcgttaaaactgaatttgaagatttaacttcaggagttgagtctagagtagagttgtggagctgtctaaagccagcgtcacaactctagtttattttgtgagagagctccacccaactacacttccagtttgggtgaaactgaaactgtttggctgagctccagctccaggagaggtggagctggagctagagttgtaccaaacaggcccttaatgacaaaatatggacaaacggttttatgacagtttttcctacgtggtttttcagctggtgggtcgtgaatgaaaacattagtaattttttaaggggtaatttggaaccatgccattataattttgcaaagtttgagatatgccatcggtatctcaatgacatgtaggacccacatgagtcaatgacatgtgggttaggatggcatggttccaattttgcaaaattataatggcatggttccaattttctctttttttaagtgggtcttgcaaacacgtactatttcttgcatgaggtgttttttttttggtagtgattatttcacttttcacttttcttttcgtgaaaacacttgcttttttcatgggccgtgaaagcactagttttcatttggcttgtgaaaacatgtacatatgcttggatagacagtttttagacggttttttcttagaaaggtacgatgctcatggaggaggacaactctattttcagagtagaccagtagagagagatgagtcctatcaaactctgcagatctgttttgatgagtcagatcaaagtctatgattcacatgttcgcttccggctccctaacaaccgccaacctgtaccccaacgtcgaggccggccgccggcgacagcaacttactcccttcgtcctataaaaaagaatctaggaccggatatgatatttcatattcctataaatctggatgatgtgtatccggtactaggttggtttttttatgggatggaggaagtagctctcattgaccacgccggagcaagaggcagtggtggggatttgggtgcacgctaaatactactccgtagaagagaaggagcagagaagacagctgaaataatggtgaaagcagaggaaatctttcccgggctccgggtctgattggcattgatagatgacaagggtctatagaaggagaaacaagagagcgggagtgtaaaatgataaaggatcggaagcattctcccctctactttcttttactctagtattttttttatatcagaatttaaactatcatagatctgatttaaaattcatctatagtgttatattcattttgattaaattaataattcaacacccatattgatccctacatttttagtaggcaaaactttactttatatcgtcttctatccttttcatgcatcttgtaccatataagccaataacaatttggtcagaatctctaaacattgtgtacgttattaaccattagagatacctatgatatcaattactaacagtaaattcctaccagaaaagatattggcccccgtgtctttctgcttggggcaacaatggtggtgattcaggctgccacaacaccacccgcctccttgcctcctcctccctctctaccgcctgagcgggccattggaaatcgtgtggttgcaaggatggtagcggcagggtcttctccctctcttgttgggcaaccgacaagcagcgagctgcgggagccgacccggttgcgttggcttccccagtggtggcgaaggcagaggcagctgcgcaggagcccaggatggtggcggtgacagaggcgatgaggtgtggtggtggtgggacgccggttgcgctggcttccccagtggtggcgaaggcagaggcggctgcgcgggagcccaggatggtggcggtgacagaggcgatgaggtgtagtggtggtgggacgccaggcatagtggaaaaaaccggaccggtggtgggacccctgtcgccaggtcgcagccggatctaggcctccgcacctagccatgagatggtgtctgcaagaggccagacggtttggtgaccgcgagggcgtccacgacggtggtggaggcggctgcatcaaagtgtgacggtggtggaacaacatcggttgtgttacggacggatatgggcttccatgcatagatttgtccatgcatcggcggttgtttcgatgggagagcgagcatcgacgggacgcgatagttggggcgtgaccatctaggggccctgcaccttgatccccgttggggactacacaggccccatcctcggcaaggtaaatggtgcgatgtgagggagacgaggccaacgcacggtggacgcatgctgacaacaaccgtggccaagggcgagttcgcgtgcatggaatttggggatgtctgagagcagttgctggcgactactctccactctactcatgctcatccatcgatgatgggatgtggagggcagcttggcaatgggatggggcagtgtaatgatggccagctgcagcggtgtggacagtttttcccctacttgtgccttctggtgatgggatgggagcgggcatggcaactgttttgtcaaaggggcacatcaagaacataacaccgcccgttttcttgtcctatccatgtcaattgaccaccacctccttgacctcctctcccaccccacaacgccacctcggacccgccaacatgtgccacattgtctctgcagctcttagctagtacttcttgtttcataataatagtttacaaacataggaaaataatacttttatcaaactgtatttcaagatcattttcaaacatagaaaaataatactcatatcattttcaaatatcgatacccaatacataaacataacatgtaaccaaagtttgaaatgaattatcgacttaaggcaactccataaattccatttatttgtgacttggtagtacaaggattcttcattattgacatacatacccatgaaatataccatttacagtatggggagatctatagacgactcgatatgtgactttggctccatataataacatctagaaagtcttttattcagttttctcttatagaccaacaaagaatacatatgggagcaaacaactcgacatctcaacacacaccttggactccaacttcagaaagcttaaatcaagcaaaagcagctattgtatatattcttgaaaatatggacctgtgtaattaatccgccgctatataagaacgtcatatgagacattcgacactagatcagttttaagcatgttcagggccagacttgatagtaggattctatttggagccatcatgtttttcttcacctcctttcttccagaagaaaagaataacaacaaagcccaacacaggtaagagaagcaggatggcatccttgaatgtgcaccaattccgagtactgcctgccgcgtaggctcccaggagggcaagcatgtccagcaacatggctgtgtgcattggccaaagaggcaatttatgttcatcgcccttggtcatccttcgaagcagcaaaacaatgacagtgatggatgccatgaaggaagtggagttgctatagaaaaaagcattgtaccgacgcttgtcgatgtcgtagaggaccgggttgccagcagagtgcccattaccttcatccctccacaggccaccaggtggttttaggcccgtgaggtaggccacactcgcagccaatattcctgctagcattaagtacttggccatcatgtcggctttctttttcatgtcagcttcctgttgatcttgtgtttgtcttggtgtgtccatcatgccatcttccttgttggtttgttgattttgtgtttgttttgactgatgttgatttatgtttgcacgttgtccacgaccgatgattgccacatagactacagctgcaaaaactaccgtaaccaatattaagacaacgatggaggttcgcagatgcatcgaacttccagcagcataggcatcgatgaggccgaacatgcccgctaccatgcagacaaagagcgcatagcactttatgcccggcccgtacagatttcggttgagaaggagaatgatgagagccacggatgccatgaagcttgctgcattgcaataaaaaaatgccttgtaacggatagggaacttgtctagtaggacagggaagcctgcacggtgcccaaactcatcattttcccagaagccacccggtggggtcaagccggcttggtaagtgagtgttgcagccaagatttcaacaagcagcaacaactcacgcttcttctccaactgatgctcctttatcttgtcttcctcaccctgcttgtccgacttcttttctagtgtggagaagagaatgtgaatcaccacatagataaggacaccaccagccaaggcaactgtgtaaatggaagtgcttgtgtccctgcaacttccgacagcgtacgcgcctatgaggcaaaacaaatcaagtatcatggctgcctccagtacatggcttctaactagaaattcattctgcaacatcaccatgatgactagggatgccacaaaagccaccgagttaaaatagaagaagaccttgtaccgcctagggtgtgttgtcaggagtattgggtctccactgtggctagccccattgtctgcccagacgcctccaggtggatctattcctgcttggtaagcaacgatcgccgcaagaatggcaaggagctgaattaattcacaaggcttgtctagatcattgttgtattgtttacttcccctgtacaattaaatagatagttcaattgcagtctagaataattcttttggtactcgaaattgatgatgtggaattaagaatttctagcactcaaaaaatgtgtacaaaaatgcaagaaattctcaccgaatcaatccccccccggtcccccatgtcatcatgattgaaatgatagttaacaatgtgaaacaaattaatttttgttcggttagcccaatatgtggccttaaatggctccaatcagtaatcactacatctccctaggtcttgattgaggggcacgaaggtcttttccttcctcttaattgatatgtactcaaactattagaaatgctacagcccccctagtactggtcctttctatgcccatgccagcggcatggatgatcgtagagctatcttcatggaagtagaaagcatgaatagaaatattttttttcaatgatgataagcagcgatggagcaagctagaatttcctcatgcccgggtcgaggctaaaaacaagggaataaaattggcaggcgactgatagcattttaatgatgtggagcacaagtagttgggcattatgaacacatcaaggtgtgaagagcttgagctgatgagcagtccggattggaagcaaggtcattgggtgcagtggcatggactagcaggaaaaaaattataagattatagccctaagagactatgatcaggaaaaagaaaaaaaagcactccgctgcaagttggcgactccaacccatagactcgaggacaagactaacgctatgcgtgctcggttgctatcagcctttcgaagggagaacaaacatgtcgcctagatcaatggttctcgatgagcatgtgctttgtggatctatgatcatgttcaagcaaactggtacaataaagtatagatgttaatagtgaaatagttctagtgataggctcattttgtaaggctcatgtctacatacttttgggagcaagacaccattgagtccatggaccttttttttcttttaccgtaccagtttctttacctatcaatggttctcagtgagcatgtgctcgtttattatagttttacagttttcaaatatttctaagtaaaatcatttcctacaatacacaatataaatctatgatcgttttccatatatctttacataaggaaaaagttcaaatacccccctaaactttggatggaatccgtcaagcaccttgaactttaaaatcaaacacccattctcctaaactttgtaataccatgtatattactctctaaggtggttttggatggtgtttttgcatatttgaaggcttaaacgagtggttttgaataactaatatacatatttaaatatgattagttagtaggacatcaatttatattatatagtggtgccatattattattatgttgatactcattttgtaagtgagattgaataaagggtacaaattaaagaagggatatttaagtgaagatcttagcatgtatatctaatgtatatgtcacgtgatcaaactcattcaacttatatacaaattagattaaaaacatcttatcgggttatataaatagtactataaagttcagagagttgtatgtccgttttcgaagtttagggtgctagatagacttttactactagagaactcatcttttatccaatgccccaaacatacaaatacctcggatggattaagaagcgttactaaatctctttagtaccggttctaaaagcccaagtccctagaaacatttttagtaccggttggtgttatcaaccggtattaaaaatacatctgtagtaccggtgttagcaccaatcgagattaatgctgatggatctttagtcccgttgatattatcaaccggtactaaagatgtatttttagtactagtaggtaacaccaacccatattcaagatatttttactaaagatgcctcctgagttagttcaaaaggaaatcatctctattcaagtcaaatgtgtaaggtaggtgggatcgtaacacgcgtgagggctgaagtgagatatcttgagtttgattcccacatcccacatattttttttttgacttggtttgcatcgttagtaccggttctttagtcttgatttttttttgtcacggttgctaactggaattaatgggtatacatctttagtaccggttcagatcgagatctttagtctcgattttttgtcacggttgctataatcgggattaatggcggttttcaactgatattaaaggtgatttctctcctggtgtttcaatcaaagtttagggtgatatttggactctctcctgcatataaatgtactacatgaagcaaggaaaaatgtagggtatgtatgtttttgacctaatgtggttttatatatcctacactttgaccattgtattttatattatattgctcatgatcttgaaattgacatcattggaaaatgtttcgaaatatgaatctaatcataccataatgatttttattaaggacaaagaagttttgctttcagacttttgttaaattatttgaatgcaattcaggtttggagcgcgcggttgtgacttttttttaaaaaagtaacaagaaaagataaaaaaaattaaaaaaaggctaggcatggcattagaaatgcatgatgaagatgaatactgcgtacctggtaccaaaagggagactgatggcattagatcctacaagaaaccactggagaaagatgcagacaagaaccgggacaatcaggccaagaacatagccggtgtgcctgctgtccctgcagctcccggcggcgtaggcgccgccgagtcccaagatcgccgtgacggtgagcccgtacagcgggaacttgatgcgcttgaggtcaagcttctcgtagtacacgttgaacgtgatggcgagcagggacgcgatgaaggagatggcgttggagaagaagaagaacttgtaccggattggatggaggcccggcagcaccgggtcgccggcggcctcggtgctccgccagaagccgccgggtgggttgagcccagctacataggcgtcggtcgccacgaagatggcgatcaacatcaggatcccgacggcggcggcggtgtcgttttcgccgtgagggttgggacgatgaagacgatgacataggcggcggtggcggatacgagcgcggcggcgccgatggtggtgaacttgtcatggctggtcccggcggcgtaggcgcccatgagggcgagcaggtcgaccaccatcaccgcccgggtgagcgtgagcagcttggtcccctggtgctggtggtggccggcccttgtgcaggaggaggaagaggaggctgaccaccaccagcgacgccgcgaaggagatggcgttgaaccagtagaagacgatgtagcgccagtagttggtgtcctgtaggatggcgtcgccggccagctgccaccggccgccgccgccgccgtcctccagccacgagccacccggcgggttcagccccgccgcgtaggtcaccgtcgccaccagggtggccagcagcaccaggtacttcttcagctggcactccattggcgacgacgacgacggctgcttgtcgtcgctgctgccgctggaagaagtgaggttttgctggctacttccaccggccaccgccggagccgccattgatctgctactgttgatcgggtgatcgatcgaggtgaatctttgagcaataatacacacgatggcatggctctatgcatgcatttatatagagggctgatcgatcgatcgagcgtgtgtcacaatcatggcatatatgtattacttgatcgtctagtcatattttaggctttattcccttgtcatttttatgccctttgcatttcattcggtagtgtcatgcaagtgacattcattcgtgcacagtgacccttgcacgcacgccaggtttctattccttatgtgtgtcgcgcacatgctttgttttgagctgctgattaaggccgtgatctctcggcacacaaaacgaagcacgtattattgcatgattaattaagtattaactattttttaaaaaaatgattaatatttttttaaaacaactttcgtatagaattttttttaaaaaatatacaccgtttaccagtttgaaaagcgtgtgtgtggaaaacgaaagaggtgagttgggaaaactaggggaagaacacggtctaattatggacgtttttacacgaattatgcaccagttcattgcacaaatcgtgtgtttttccctttcttatgagtacaacgtaaataaagagcgtgtaattttgtatacactagttatagggctagcctaatgggcgggtgatcgccttgggcgatcagcacccccatccctcccctaacacgcacacgtctccccttttatcctcttcctaccacactatgaaatttcaaaccatttaaaaaatataaaagaaatctaatacacttgaaaacatattcatgtgaataaactttacacttataaattataaatatatagactttatgtatagaaatattctatataaaaatatatttgaatccaaattcaaattcgaatttgaagcgagtatataaacttttaccctataaactttgggtatatatgtgtaaactgggctgatagccgcgcgtgatcgatcacgcgttagctttctagctagttatgtcccctgcgttgcaacggttttttatccagtttagtagaaaaaattggaccgagtagaccatcggtttttataaagtgaccgggctttttttaattagaaattggttttttaggatggatgtttttttatgagaggtaagatatgtttaagtagaaatggaggatggattgatagaagaagacaactccctctttaagtagttgtgagatataggtttttattcggttaagagggcaactccctctttaagtagttggagtattttttttttataaaactagagtacttgaaattaaactatcaatgtagatatgttatgacgttttagtcaaattatataaatttatctaaagtaacaactttcataatttattgttatgtaataatgatacaatttaaaatgaactttcagtttcattggtatgtaattcatcaagggaacatttttttatggaacactaatactgtatgatttaaacataacacaatgtatgccaaactaagggccttcaaagttcaaaccaacctttccaccggaaatgcatttaatgtagtggacgaattccggcccatacgtatagatgggctgaggggtagtaggaccacgtgaagaaggaaaaagtccacttagac

SEQ ID NO: 25873 - DNA, 20100 bp, Oryza sativa
tccattcgcatgacggaggtcaagtatcacgcatggggtcggaatccagcggatgacaatggagacaagtatggttgcagagtgaagaaaggacggcgggaggacggagggggagagccgacggcctcccgtggggcaggagtttttgcgtatttggttgttctcatgttggtgtgctggtgctccttggtgtcaaattctactgcctccttgggttgccttggcgtcatgcagtagattcgtttgccgaagatatggtcggtaggtatgagatggagttgtgggattggtgcatacaaggagggtttttggatatgcttgctttgggggataatgtggtttgagtggggccggcagtattgatccgttacgccacgccaaggacttatgtttctggctgttcattagcttgtttggtcaaattgggtgttgagagtgatgagcattatgtagtttattatggaaaagagggtttggctgatcgacgaaagcaggaaagtaatgagtctttttgttggcccttttttttaattactctgaatgttttcctgtcaaataccatctgcactcagaatcagaaaattttaacatataaatagttaccgtcacacttcgctttctctgaaactaattgaataggcacgtgcaacttttggtatgttctataaatgtacatctatatttcctaattatacaaccatttaatgtaaccatcaaagttgcttgataaatgaaaggtatttcttcgtttgattgctcatattgtgcatttattgggagcatgtcgcaattcttccatgtttacctattttttccttccgccaagaactatatatatttattgtgtctctgtgtaatgtgaatgtccagggcgatacgcattcacgtgaagacggattatcaaaaccaagagataaagatagagaaagagaaaaagacaaggacagggaacgccacagggaccgtgacagagatcgaggaagagaccgagatcgggacaaggacaaggaaaaagacagagacaaagaaagggacagggatagggacagggacaaggatcgggatcgccaccataggcatcaccgtgaaagaagagaacacagagatcgctctgatgatcatgatcgccacagaagccgtgattctgaaaggtattctttgttaagggagttctgttttatatgcaccttatttcttacaaaccatgcatccttgcaatgaatgcattttatcaaatgtgttaaatgcttttagatttagagctattcaactgtcttatacatgcctacatgattagtcaaatgcccacaccaatcttgtggtttatatttaatacaggagaagagaccatgaacgggatgggcgtcgcaggcatcggtctcgctcacgctctcgttctaggggcagggatcgcagatctaggtctcgctctcgttcaaaaaggtatgtaaaggaagctccttgcatagtcttccatttgcatcttctttagctgccgtgcacatactatgttttccgtcatggttagttaaattgtttattccatatagtagcaattttggacatactttatatatgctttctctgcatggattattttcctgatattttctttgtgtattatcaaattcagacatgtacaattcgtatttgaatatgtatggcagtatggtttactggcttagtcttcttaatctggttctcattgatgaccggtttataacttgttaaatatgctaattttatgtgttattcagctttactttttaagttttattttatcactaaccactaatatctactaaactatttttctaaagcagcaagcgagttagtggatttgatatggcgcctccagctcaagctgtggttccacaatttcctgctattccaaccccaagtatgctctcatcaactaagttaaacggctcaatttcatttttcttttcctcgtcaatttgtggcactttttctgaataataattttagtgggacatttgaacaatggagttaagaaaaataattttgctgggctggatgattgatgtacatgagtattttttttagaatgaattatatcttcggccgctataattcttcatccttatcactgtataatgccacactatcttattgccgttgccataaactaccggtgaattactagtccattaaggtcgattattgccgtagcaggatgatgcttggtgttatacctagtaaattggtggatatgtctggatgttatacctagtagaactccaatacagttaatatttgcttagtatgatcggccttgagcattctacacataatagtaagaggacaggagaacaagcaaattgttattttatagtagtctacatgatgcatttggagagacattggtgctttaattaaaggataaaaaagaataccaaccagtgggctccgtaagcacccctcaggcacctatctgctgcagatgcacttcatgtgatagttactaatatgaataagtgaataacttgtaagtttccattttattattacttggtaactggaaactgagcaaaacttttttgcttgtgttcttttgttgtttgtctgttttgtgtatgtgtatggtaagaaggcaatcttgggttacttgcccccactgctgccaatggaatgagctgcctactgtagctttaatgtacaaggaggaatcagtgctctggtttgataccatcttattcgtcttcaactagcaagtattactggttgctagcattatgtctattatatttgtccttgcacatattttgttcattcttaggcttggatactgaacagctagatctattttagacccagactgatggtgagaactagtcagttctaatggtggaattttttccttgctaattgtttatgctctgtactagaaatttattgataaattgcaggtcagtttccgggcactgctattcctggaatgtttccaaacatgctcccgatgggtgttggacaggtaacctgtcagtattttaatgtattataagtgccaaaagaatcatttttttatttatgtttgtaaataatttttatttgcctgtaataataaattttgtttgaagcagttcaatccccttgttatacagccgcaagcaatgacgcaacaggtatgagttgttgtgacatctactgcatgtattattgataaggatgtcaacaaaataatgtgttaacacctttttctctcaggctactcgacacgcgagacgtgtttatgttggtggacttcctccaactgctaatgaacaggtctgtgtatttaatcactcattctttcttactgcccatttcccatacccaaaccaaaagccgtatgggagtgcacgagtgtgtacccgcatgcaacatattactgtggaattgttacattagtttcctttactgcagtcagttgcaatatactttaatcaagtcatggctgctattggaggaaatactgctggtccaggtgacgctgttcttaatgtctacataaaccatgacaagaaatttgcttttgtggaaatgaggtctgtggaggaagcaagcaatgcaatggcactggatggcattttgtttgaaggggctccagtgaaggttaggagaccaacagactataacccttctctggcagctgccttgggccccagccagccaagccccaatctgaatcttgctgcagttggcttaacacctggttcagctggagggctagaaggcccagatcgtattttcgtgggtggccttccatattacttcactgaggctcaagtccgggagttgcttgaatcctttgggcctcttcgaggatttgaccttgtgaaggatagggaaactggtaactcaaagggctatgcattctgtgtctaccaagatctcaatgtcactgacatagcctgtgctgctctgaatggcatcaagatgggagacaaaaccctaactgttagaagggcaaaccagggagcggctcagcctagaccagaacaggaaagtatcctgttgcaggcacagcaacaagtgcaattacaggtataggtctcaactatttttcatccagtatcagataattttactttcttatgccaactattttgtagctgtattgtgattcttgcattttgactctgtgcttcttaacagaaacttgtatatcaagttggagcactccctacaaaggttgtgtgcctgacccaggtggtttcggctgatgaattaaaagatgacgaggagtatgaagacattatggaggacatgagattggaagcaggcaaatatggtaatttccaacttctcacccgcaatttcctcccttgcctctaaactccggtttagtttgatcatctgctgggctaaaaccccatatgtatcttcttgcgttgagagtttatgcatgttttcggattccttttgcctcgattgatactttttgtttatttagttggtcttcctaggtgttttctcccttttgtttactcacaagtatcttccttaggtaatctgattaaggttgtcatccctcgccctgatcctagtggattaccagttgctggagttggaaaggtaagtcttgtgtattgcatcgcacaaacattgaagagcgtctgtaatctttctaatgtacgacctttccatccaggttttcttggagtatgcagatgtggacggcgccaccaaagcaaagacggcaatgcatggaaggaagttcggtggaaatccagttgttgcagtgttctaccctgagaacaagttttctagtgcggaatatgacgcgtagattatcccgctatgtaaaacactagtcttttgtttttcttttgcgccagtttgctaaattgtaacaacaatttctctttaagttgaaccttccaatagcttggatttatgcagagcgaccgattaattaatattaaaagatgtgatggatttcctaaagttaactgaagggcttggagtatgatctgattcttgtccgtttatcctgatagacctggattatttgttaactctgttaggcggtagctcttgtcaccggagacgaaggagaatggtgggggcgaggacacctcatcagtctgtccctctggcgtagacgcgagcgaagaacgcaagtggaaggaaattaaaggatgcgggcgaagaacgataggaagaggattatggaggtttggatgtgatctgagcagttggattgtgatctaatggtctaaaatttgcaagatttggacgcaggttttctggcaaattacatgtaggtaggcccctatgatctagtaattcttattcaaacgcgtgatagttcatgatagtagtagtaaattaacaggagaaatgagggcaatggcatggatgattcatctgcacacccgtgcggtacatgctagacgtgcaaaactatttgcaccaatggttttaaaacaacaacaataataaatacaggtacagatggaacttgaaacagaatgatagcttacaattacatgcagtggatgctatgtttagctaatctggacgtcgccacaaatgctgtgccgtatgcagtatatcaagatgattaatcaacggattatttgctgatcgatatgcttaatccttcgccaatttggatgtccaggggtcagacaggtgtccgcaagagaagggtggcaaccagagattacaatgctcttgagcgattggggaagcttgggcagtgtcatcatgttgggacactcctggacgatcaattccctgagtgttttcaggcggcacaatttgacaggcaaatagttccagctgcagtctgtaactgacagtgtatgcaggcaggtgaagaattcaccaatctttgggggatcactcgatcccttgcaactccagaacataagattctgcaatgccgggcgatcttgttcctgttccttgtcgcaaccgtctcctgtcaaccagcttgggtatatcacaccaccgtaatccctgatgcaaagtactgtaatccccgacggtggacggagcccctcaagaacctcctcctgaagttctggaggttgatgttgcttgatctctgttacaggtggaaagaacagcttcttgtatgactccaacgctttcttcgagcagcgttcgtcagtgccaccccaccgtagcgtcagctcagtgagatataccttgtcagatagcctggctcgaacagcttcctccttgctctgaacattctcgatgcagtcgatgaacagcttgccacgaaggttgttcaggtgctccagctgctgtatctcgtatcctttctccttcctcacgtagaagtgatacagagctcggagagatgtcagcttcccaacatcaggaatgttcaggccataccatgtcagcatgtacctcaggttgatcaggttggcgatcttcagctgggatggacaatgcaagcgagtgttaggattgacagagagctcctgaagatggtaaagcttggaaaattcagccggcagaatcaggctgtggggaggaggtgacatgatgccaagataacgaagatgtttcagtccaccgatgcatggtggcaccctgctcaaatgtctcaaatccaagtgcaccaccctcaactttgttagcttcttcagcacacgctcaaaatcatcttggttcattccctctactgaatagcacatgataagagttctcaagtttttaagctccaaaatcttctctgggaacaatatttcactgtgactcgatgcaaagatgtcgaacgtgtttagtgttagcagtaatcttgtgtgccacggttagttagttgattagttatctgcatgtttacgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcgtgcgttgtgttcgtctggtttcctgctagcgatcgctggggaaattcctaacaattggtatcagagcacggtttaggaagtggactcgtgaccgcgcattggaaggcgtcttcttgccgcgtcgtcgctcgtcgtcaccgatcgtgcacactcctcatgactccggcggccgcgccacgggcagcggcgggggtgaccgcgggctggtgatccaccgcgtggtgaaagaaggaggcggctcggtgaactacccgctgctgaccaagaccaactacaacgactgggcgctactgatgaagatcaagctgcaggctcgctgcctgtgggcggcgatcgagcccgacggcgtggacgtccctctgcatgaggaccggatggctcttgacgctatctgcagtgccgtgccgccggagatgattggcaccctggcgaccaaagcgtcggcccgggaagcctgggaatgcatcaagacaatgcgagtcggcaacgaccggattcgcaaggcgagtgcacagaaagtgcgcgctgagtatgaatcgcttgcgttccgcggtgatgagaccgtggaagatttcgctctacggctcacaaccatcgtcaaccagcttgcaaccctcggtgatcctgaacctgctgataaagtcgtcgaaaagtaccttcgggtagctcgtcccaggttcaatcaactcatcttgtctattgaaactcttctcgatatctctactctgtccatggaggaagttactggcagactgaaagccgctgaggattctgggcaatcctcgtcgcacaccgccggtgggaagctgtacctaactgaggaggagtgggctgaacgtcagaagaagaaggatcaagaggcaaagcggggtgactcgggcggctctggcggccgcggcaagcgccgtggcgggagagggcgcactggtggcggcgggactgcgagccccgagagcacgaactctggttcggcgcgcaagggagacaaatgccgaaattgcggcaaacttgggcactgggcgaaggactgcaggagcaagtccaagcgcgaagaacaggctcacgtcgcccaggaggatgaagaagagcacaccttgatgttgctcaccggcggttgcgttgacacggtcgacgcggcggcgccggagggcgacacgcccacaccgccccaccaagccgtggtggaactcgtggagatgaaagtatttgcagcgctcgacgacgcggctgaccatgatcccgggcgctggattatggattccggcgcgtcaaaccatatgacgggcagcaggatggcgttcgccgacctcgacacgaacatcacttggaacgtgcgactcggcgatggatccgtggtccggatcgcaggacggggcacaattctctttgcctgcaagaatggtgagcaccgcactctgtcgaacacctattttcttccccgtcttgctgccaatattatcagcattgggcaattggatgagaccggcttcaaagtgctggcggaggatggcatcatgcgggtctgggatgagcagcggcgtctgcttgcccggatccctcgcaccccagggcgactgtacatgcttgacatcaacctggcgcgcccggtctgtttggcggcacacgccgacgaagacgcgtggcgctggcatgctcgcctcgggcacataaacttcagggcgctctgcaagatgggcaaggaggagctggtacgtggtctaccatgtttgtcgcaggttgatcaggtctgtgaggcctgtctcgccgggaaacaccggaggtcgccgttcccgcggcaggcactttgccggtctgacgagccgctggcactgctgcatggagatctctgtggaccgatcacgccggcgacacccagtggcaaccgctatttccttctactcgtcgacgactacagccggtacatgtgggtcgccctcctctccaccaaagatgcggcgccggctgccatcaagcgtattcaggcggcggcagaaaggaagagtggacgcaagctccgcgcgttgcggacggatcgcgggggagaattcacgtctacacagttcgccgagtactgcgccgagctgggaatgcggcgcgagctcacggcgccctactctccgcaacagaacggcgttgtcgagcggcgaaaccaatccgtggtgggcacggcgcggagtatgctcaaggcgaaggggctgccaggtatgttttggggagaggcgataaataccgccgtgtatctgctcaacaggtcgtcgtccaagggtatcggcggcaagaccccgtacgcgctgtggaacggcgttccgccggccgtgcaccatctgcgcacgtttgggtgtgtggcacacgtgaagacgaccaccccgaacctgaagaaactggatgacaggagtcgtccaatgatctttgtcggctacgagccggggtccaaggcgtatcgcggctatgatccggctactcggcgtgttcacatctcccgtgacatcgtcttcgatgaagcggcccagtgggactgggatgctgaggcggccgctgatctcgacaccgacttcgtcgttgagtacaccacggtgtaccatcctggctcgctgtcaggaacacgccaagacgctggggagccgcctgctcgatcttcatcatcgccgcgaacgccatcagactcaccgacagccggccgaacaccttcggtgcatggcgatgcgccggcggttgaatttgtgtcgccaccaactggagcagctgctaatcttgatgcagaccacgacgacgcaccactccgtttccgcacgatggacaatgtgctggggctggccatgctgccaggtctcgctaatcgtgaggtccaggaagagctgatgatggtgagcggagaagaaccggcaacgttcgctcaagctgaacgcgacgaggattggcgtcgggcaatgctcgatgaaatctcttcgatagaggagaacaagacctggaggctcgtcgatctgccttcgggacatcggccaattgggctgaaatgggtgtataaactgaagaaagatgctcagggcgtcgtcgtcaaacacaaggcgagattggtggcaaagggctacgtgcagagggctggaattgactttgatgaggtattcgctcctgttgctcgtcttgattctgttcgtttgttgctcgctctcgctgcgcaggaaggttggatggtgcatcatatggacgttaaatcagcgttcctcaatggggaactgattgaggaggtgtatgttgttcagccaccggggtttgagatcgatggacaggagaacaaggtttacaggcttgataaggcgctgtatggacttcgccaagcacccagagcttggaacaccaagctagactgcacactgaagaaacttggcttcaagcagagcccgttggagcatgggctgtacgcgcgcggcgatggcagtgggcgactgctcgtcggtgtgtatgtggatgatctggtaattgtcgggggtgacagtggcatgatcaagggattcaaagagcagatgaaggctgaatttaagatgagtgatcttggtcctttgagtttttatcttgggatcgaggtacatcaagaagctggaatcatcactttaaagcaagcagcgtatgcgtcgcgtattgtggagaaggctgggctcaccggctgcaacccctgtgcaacaccgatggaaccacgtctaaagctgagcaaggaaagtgcaggatcgctagttgatgcgacagaatacagaagtctagtgggaagcttgcgctatctggtgaacacccgaccagaccttgcatattcggttggttatgtcagtcgtttcatggagaaacccacggacgaacacttggcggcagtgaagcgcatcataaggtatgttgctggtaccattcatcttgggtgccgctatgtgaaggaaggtgaaggaggactgcagggttacagtgacagtgatatggctggagacattgacactcgcaagagcaccacaggagtaattttctttctcggcaaaaatcctgttagctggcagtctcaaaaacagagagttgtagcactctcctcctgtgaatctgagtatattgcagctgcaacagctgcatgccagggcatttggcttgcccggctcctcggtgacctcaggaatgcagcaactgaagtcgtcgatctcagggtggacaaccaatccgctctggccctgatgaagaaccctgtttttcacgatcgaagtaagcacattcaaacaaaattacatttcattcgtgaagccgtggagaatggggaaatcacaccgagttacatcggcacagaagggcaacttgcagatatcctgacgaagccgctttctcgaatcaagtttcaggagctgtgggaacaaattggtatgtttcctgtataatcggcacatcaagcttagggagagttttgttagcagtaatcttgtgtgccacggttagttagttgattagttatctgcatgtttacgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcgtgtgttgtgttcgtctggtttcctgctagtgatcgctggggaaattcctaacatttaggaagatgttccgtgatgcttttctcgatcttgacgcagtcgcttcccgcgatcgtcttcgctaattcatggaacatgtcatgaactgtgaagtactcaccggtgctaatgtcagagggactgaccaacatcttctacgtcctcattgtttccatcattgtccttcacaaattcttgcgctatccacatacgaacaagattgtcacgttcaagctcataccttctggggaagatgctacagtactggaagcatctcctgacatccacaacaagttgattatagctccaccaaagagctcccttggtcttattcagcacatcgaggttcgcggttgtttgccaaaatctgatatctgggtttctccagagctgacctgccactgtcactgctgcaataggtgatctgttcagcttcttagcgattttcctcccaatcggtatgtattctcgatcatcgaaaattgtactgtcaagtgcataatgcatgaacattgagaagtattgctcctcttccagatcagatattggaataagcctattagagcctagagctgcctctttactctgggctgtcaccaggattctgcttcctgacttcccaacattgagtggagaaagcagcttctcatgattctcatcattgacccacagatcatccagtaccaacaagaaccgtttgcctctcaaattctccaccaattttgcttccaaacctctgcagtcactaatttcagaatgccggctttgcgtgatctcctcgagcatatcacgaaatatatcttccagtctgtaagtcttagaaacataaattagcatgactgtgtcaaagtatctatctttatcctccttttcatactcacaaacatactgtgccagtgtagtctttccagaccctggaatgccatatatgcaaattacagaataacatttcctgctactggagcttggtaaagaatcatcctcacgaagcatacttcttatcatatcacgctcccggtctctaccgaataccttgcgtgtactactcgatgtaatgcttctcctgttcatgttgacaatatcattccaggcaccactgcttgtctgtgttaaatagggagagttctccacgtttgtgacagtgttttctagtttctctattcttttcctcaatttccatctagcaatagcaggcatgaaagaatatactgctgtaccatcctccagctggaagaataaagaacaaaaaaaatgattagaatggaatggtggaggaatgtgcatactttccaagctcctaaatggtgcattttttgcgaacactttctatatacgaatttattaggaaactcttttaaatccatttccactttatagtatcaattcaattcgtatgtacacttgaataattatctttaatcattgagctattcaaccaatttagccattcagcacaaaagaacaggaccatgtgagctacatactgaacttccttaaaaaatatatatatactgaactagttctactctctgacgactgttgtcccctgattaataatagatgttgttttcttctaaattagtgcttctgtttagaacatggaaattttttcttgttacttcaaaaattgaactattagatgtagtaacattagtggtgtctcaaacactaagaccctttaacacattccagcaactattgatttccgaataaaattgaggagcgcgacataaattttaccaagatcatagcccgtgcattgtaactccttttgcatagtgtattagtgttgatgcaaaataggaacattcccctagattgagagaagatgcattgctagattggggtggggtgtgtgtgtgttagggggcagagaagtggtaaccaacctggtaacctgtggctgtgatgccagttgcatcataaaaccaatctcgataagagcgagcaacctcaaaccagttgactgaccagatgaacagggattggcagcatctgatgaaatcaaattgcctggacaagcaactaagccgctccagcaaggagtcagaagctgacccgcagcatctgctacaagaaatcggtagcagcgcagctgatctgctgcgtagcgatcgatacaaaccctgtgcccactccagtagagtggttatgcatctcccaatccagctcgtcttgcaagcgtggatggcatcgtcgatgtgcggatgccatttgctgctgcttccctgtggctcgtcatcgccgatgacatccttctcgatctggtgataagcaatgagatcgaggacgtcttctgcttcgtacaaggcagacttgaccagcttcgccagcgtgtcgagattttgcacggctgatctctccttcttcgctttcctgtgcatcctctcttcctctatctttcgcagcatctgctccagcttcgggacagtctgaatctccagctcttggatctttggcgaagcgtcgaagaggtaggagatgaacctgttcacgagcaagctgatgataggcgacagcaaccaacctagcacggttatgacagagcccatggctgcaatcctccatggatttgccatggaatgcaagcttttcgatctccttcacaaaggggacaaagttaaggagcagtgggaagaagaatggagctctactactgtcttggtagcaatctatctatcagcaaactatgcaaagcatctgtcttctagcgagctcagtacagtgcaaaacttaattaagcagaaatttcacccgaaatttcttgcgaatcatcatttttttttcctgcaagtgtcattactgaaaatgacttgaccacatagcatgtggctaaccgactaataacatagtcagacttgttttcgaactaatgcatatggttagtacattgcattacatagcttccccgagtttgcagctggctgtctgatatgatgtagtgtaacctgcacgtgagtccatgtgacatgacaatcacaacactatattatgactattattaacacaaggatcagtaatacgaagagtgacagcagtaattggccaatgattcctctctgggttgtcaaactaatgttggcctgattccactctcttcaatttgttgtaatgattcgttcaaaaaaaatgttgtagcaatgaataaagaagagccaggctcttgtttcgaattagagaaatatatataaaaaaacagctcgttaaggagtcacattagatcgttccttttggaatcaataataatcattgactattaaatcatagtcatgaggtacagaatattaatttagcctaaataagtactgttggatttgtctattggtaccaagttttttctggcagtctgcatctatttatttactagcaaaatacccgtgcttcgctacggtgtattaaaactaaaaatatttattttcatctaaagttattttcacactgttttggtactttcgctcactagaaaaggtctcaaataatagagagaaatataatagctcataataaattattattgcaacggaataattttaactaaaatcacaataaatattttaacatgttgaaaacaatatatttcttgtttaccagatttaacattaactaaggttttatagcaattaaaaaaaagactaactttctcttggtggctaatttttatttttagttttttttctatgaattagattggagagaaaaggaaaagggaaaagaacagtagatgataaccagaaaaaagaaagctaaccaaagtgatcaaggaatcggacccatgacctgtcggcacaggttttctaggctaaccaattgagaatcatggacgttttgacatgcactgcattatatagatattcacctgaacagcaaagaaaaatatcaccccacctcctctcgaaccttatctcttctctaggagaaattagacattctgccactcctaagagtgggtttcgccacaatgccattctgcggaatggcatcgtaaaataccactttcaaccgatgccaaaccgttgctttgccatattcgccatttcataagattttcaccttttttgcacttcaaccgaccaaaatacccctctctggtttctttctcttctccggtaaacatgtgggatgaggagaagaccacgacggcaggggtggcactaacctcaggctcggcgccgccaccgccggagctctcctcctcgtcgtccttatcttgctctacaaattcaagaacgcaatcttttagctcaaaccacacacaatccggagagctagcgagggcgagcgcgagggttccggctcacctcccgccgccttggtcgccagcgagggcttcggctcacctcccgccgccttggtcgccggctcgtcggtctccatccccgccgcagtcaccgtgccaaccaagcccgagacggcgacgcaggtctcgtcctgccatgagctcctcctggagctagccttcttgggccatggtggcgggcagcctgcgacgcgcggcggagacgacggcggaggagatggtggcgagcggcgcacggtggtcaacgggagaggagcagcgtggtgaccggcgggcgagacgatgcaggagattgtggctcatgacgcggtggccggcttagggtttccttctctttctccgatgtgctggcagcgggcttcgaccatgggggcgggacgtcgctggcggtgagcttgggcgtcggcggcgcgccggcggcacgaacgactcggttgtgacgaccggaggggtattttagtcagcctgggtggaaaaataggtggaaatggagagaattggcctaaatggcaaaacaaatgtttggcatctcttgtgagtggcattttaacgacgctattccggggaatggcattgtggcgaaacccactattggcagtggcataatgtccaatttctccatctctagaatcctccgccttcgcttctctctcgtcgctctctctgtctcccagtttctcctccccagcgacagcgacaaggcgcccgctccctccgtctcgcctccctggccccctcctctcccatctccccctcttcctcccgtctcctggcaaggcgcggcgacgggaaggggacccaccgccagcgccgtttccccacagctattccctccccttcctccaccctcatccctcccgcggcaggcagatctggcggtggcggtggcctcgcgacagctgcgggtggtggcagcagtggctccctccgcccccagcagccgcgggtggcgtcagcggcggctccctccgtcccctgttgcctcccccctcggttgaaatgacggcggtagcgggcgccggcggcgcagctcggcaagccactgccagcggccactcgcgggatgtggccataggaggaggcggcggcagcagcaaactccactcgatttttcattgatttggtttttttatctccgtttgctgttcttctattcttgtatttgggatctaacacggattaaaactttttgtgttatttgacgcggactcatgtgtatatgcttctatttgtgtgattgaattccgattaggattttttttggttgggggatgatagaattccgactgagattttgggtggggggttggatgaacgaaaaatttgggtaccgatgatgtgacgaacagaaaattacgaatttaagattttaccctcgttgccggagcgtgctaggcgaggcagccgccgccttcgtcttcgacgtcctctttagacgagtgatttggaatggccttcggcccagcccaactccctacgtaatgggcccttcttttatgaacgggattgggctgtgttttacaggccgagccaaatgcagtttggaataagttcatataaggtccgttaactttacaccgaatacgattttcgtccttaacctaaaacaagatacaaccggtccatgaactgttaaaaccggtgcaaacgaggttcctcggtggtttggaagacggttttggctgacgctgcgcctaagtgctgatctgactcggtcttcgtcccacgtggcattgacgtgacgcttacgtgactattttatcctagaaaaataataaaaacggtggtcccacatattagctacaccaatttttttaaaggtggagcccacatgggccccacataatcattcacaccccctcttcttcctcctctccccagctcccctttctagtttcttctctgtgtcctattcctccccagagccggcggcattcatcgtagcaccacggcaccctctctccctgctctacctcttcggcttctcctctccccgagattccctgacttggtgccaccgacgaccacatcgagccaccatctgagccccatgggagcactgcatcccaaggcgtcaacgacctgcataatcccgatctataccagcaaggatcctcggatccatacaagcagtgcctcatatttttatccatctctccttccaactattttttctctctatttttcttccgatctcttctcaagatttgttatatttcttctaatctgatctgacatgtgggtctcattattttttaatctgacatgtgggccaaaatattttgttttattttttaaaatattaaattttgcttcgtgtgtcacgttaatgccacgtcagatgaagaccgaatcaaattagccatgtaggcgccatgttagctaataccgccatctaaacggacctatattgcacagttgaaggaccagttgtatctgattttcggttgattgacgaaaatcggattcgttaataagttaaggaactcaaatgaacttattccaatggaatttctgcaagtcgtccgagggaaaagttcgataattttatgggccgatatagatcgacgtggaccaactttgtcaactttgtgggccgatatagatcgatatacatgggctagttagttagccgtggtaatgggctgggcttgggttatactaactgagaatcctttttatctcttaaatatctgtctcttctctacttatctctactattataaaaatttaaaatgctttaactggtactttagtgtgttattcgtgtatgagtcggtttttaagtttgttcgcttttataaatacagatccgtatttgagtcgggttttaagttcgttcgtttttagaaatatagaaggagacgtataagaaatcctttttaaaaaaaaaactcgcatgctaactttaaatgatcataatcctaattacagctcatgattttttagaaaaatatatatctaagtgaattatcatagtgaatttcactttaactaaaccatataataataataaaattaaaattagccttcaactgttgaaacgcacgggcatttttctagtattataaaaattaaagatgtttccgctgatattttggtacatcgttcgtatttaagttggtttttaagttctttcacttttaggaatgtataaggagttgtataagaaatccttttaaaaaacatgcatgttaacttaggacgagagtcggagtcctagttgcttcagaattcttaccaaactataagaaatcaacgtatatgatatgaccatcatcccaataaaaattccaaattagatatcaatactatcaaaataaatatcccatatactttttagaaaaagaaaatataacaacaatatgattaaaaatagtctttatccgttacaacacacgaatattttttctactaaacgaaaacaaagaaatctacgtaacgggagggatcccctcccgtgcaagtacgtatccatgttcccttgcttcccataggcaactgctccttctccctcttacttttagtggaagctactcccgctactaaccatgggtataaaaaataaagattaaataaagaattatcgtaaaattataggtttagtgtcaatttaatcacaaaactataacgcttcactggtggagtaaccatctttcgtcggtcggccgatttccacaatagtcccggttgcaataaaaaccggggctaaagatgatctttagtcccggttcaaaagggtaacgggcatatttgatctttagtcccggtttgtgttaccaaccgggactaaagatcatctttagtcccggttcgaatgctgtcagggcctgtcaggccccctgggatct

SEQ ID NO: 25874 - DNA, 4696 bp, Oryza sativa
aaagaagtaaaacacattaaaaatagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaataggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgctagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacaggatgctgagacaccccgccgatggttcgcagtggcgaaacatcgagagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtaccccacgcaatcgacgtgatgcacctcactaagaacctttgcgtaaaccttcttggcttcctaggtatatatggaaagtcgaaagatacactggaagcacgtaatgatctgaagcatatggaacagcgcagcgaccttcacccggaaccaaaggagaaaggcagccattacttaagtccagccagctacactcttagcaaggcagagaagtaaagtatgtttcaatgcttggagagcatcaaggtaccatctggatactccacgaatattaagccaataataagcacgaagaagaagaagttcacaaacctaaagtctcatgactgtcacgtgttgatgacacagcttctaccaattataataaggggtatcctcccagtcaatgtccgggcaacaataacaaagctatgttctttcatgaacgcaatttcgcagaaggtcatcgatccggataggttagaagcccttcagaatgatgtggtgcaatgtcttgtcagctatgagttgatatttccaccttcatttttcaatataataatgcatctgctttgtcacctagtgaaagagatcggtattctcgggcctgtgttcctacacaacatgtttcctttcgagaggtacatgggcgttctgaagaagtatgttcgtaaccgtactcgtccagaggcaagcatcgccaaggggtatggaacagaggaggtcattgaattctgcgtagaatttattgaagaccttcgcccaatcagggtacctgaatcacaccatgaagggagactatggagaaaggggactctcggaaggaaagcaataatgacggtagacaacaatttattccgtaaagcccatttcactgttttacaacaatcttcattggtggctccttacatcgaggagcacttggctctagttcgcgccagaaacatcggtaagtccgatgcatggattacacgacatcacattgatactttccccgcatggctgcgacaacatctcatgggtaacgagacgattaaccagcaactggccttcctggcgaggggtccatctggctcgatcgcgacattccagggatatgagatcaatgggtacacattctacacacgagcccaagacataaagagcacgaaccagaacagtgatgttcgtatcgatgccatgggacacgatggtacaactggcacatattacggtgccatcgaggagatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacgcaagttttttacgtgaaggacatgtctagcaaaggaaagaagggcaaagggcctgacgagccgaagcgccacgtggttctcccaggcaaaagaaaaattgtcggagtagaggacaagactgacgaggattacgatcagtttgatgggcaaccccctttcacggtgacgattgaccctagcatcctcctatcaaatgaagacaccccttactcacgtagcgatcacaaggaaggaacaatagtgaggagaaagtacgtgcggacaatcgtcaccgccgatgtattgccgtaattgttgtaaactattttggatgtattgaatatgctagttatatatgatgattaacaaatttaaatcatgcatatgctaggtatatataattattagaatttttaaaagttttaaatcatgcatgtgggatttacatatgttaattagaatttttaacaatttaatatcatgcatatgctaaataaatatgattattagaatttttaaaagttttaaatcatgcatgtgggatttacatatgttaattagaatttttaacaatttaatatcatgcatatgctaataatatatgcttattagaatttttattaattttaaatcatgcatgtggtatttacataggttaattagaatttttaacaatttaatatgcatatgctaattatatatgattattagaatttttaacaattttaaatcattcacgtgcttattatatattatccacttaatttactacagacaacaataatttttcgaaggttttgtcattaatttttcgactttaaataattttaatgcattatttactattttagaaacacatatgcaatgaaattcaatattcagtgctattatctttagtccggttcttaaccctaaccgggtttaaaaagaatttggaaatagcgggaaaatatctttactcccggttggtgagaacaaccgggagtaaagatatctttactcccggttcgtaacaacaactgggagtaaagatcatctttactcccggatgttgttaaagataagatctttactcgcggttgttgatacgaaccgggagtaaagataactctcaccaaccgggagtaaagatctgggggtatatatattcccagtgcgccctcgtcttctctaccaacattagacgtttttcctccgatcggcttctagctccttcgccgccactgcctaggcatccccgtaccgacaccgccgtcgtttttcgccatcgtctcgaggtcctcgccgcctccgccgccgacgccgccgccgccgcatctctcgggtgagagccgccgctgcctccctctcttttgatctcgatctcgatctctctctctctccaaaccgccaccgtctagctcgttgccgacgccgccgacgacgtagacgcgccgatgccgacccctactccgcctgccgccgatgccaaccccgacttccacgcaaccgtcaccgacgacgcc

SEQ ID NO: 25875 - DNA, 30927 bp, Oryza sativa
cgaacgaacgtgattgaaacgtgaacgaacgcgaacgaacatgaacgaaacgtgaacgaacgcgaacgaaacgtgaacgaacgcgaatgaacgcgaacgaacgtggctgaaacgtgaacgaacgagagtgttagtgaacgaacgcgaacgaacgtgaatgaaacgtgaacgaacatgattgaaatgtgaacgaacgtgaatgcacttgaactaaaagtgtgagaacgaacgcgagcgaaacatgtacgaacgagataaattaaactattgttgaacttagcatatatatatgattatatatacttgaaaacgtgaaatacattatatgttcctttgcgtttagactaatacatttttttgcatgttgcagagaagacgtcgtcgtcgtcgtccctcaagccgaagtggtagctagccctcaaaggaattcacgcagacaagtgatgtaaagatgtgattgttaaatatataatataagattgttagatttctaatataagattattagattattagagttagcatatgtgagtattagagattattagattattagacttagaatatttgagtgttagagatagttagagatttaatataagattattagaggtttaatatacaaaacttaattagacttagcatatgtgagtgttagagatttaatataagattattagagatgtaatattcgaaacatatttgattgttagaaatttgatataagattattagagatgtacaaatacacgacacttagacatagcatatatgattatttgagttttaatacaagattagtagagtgttaatattacgcttagcaaatatttcttctatgaacagatagctgatcgcgatgaggaacagatactgtacgaaacaatcgtagagggaagcagccagtactggaacgaaaaaaaggggaacgaggatccaaactagtacttgaatgaggaggagaacatggagagggatgaagaggggaacgaggaggggaacgtggagagggatgcggaggggaacgacgaggacgctagtggaagtcatccctccgctggacagaagagggcacgcggacaacaaggtgccgcgaagaagatagagggtcagcacatcataactgaggtggacgcagacggccgacctagtgccccggcaaaagcagcgaagaattttgtacgccacatcggttgggttgtgagggataacgtgcctgtcagcaaggtgtactggcgcagaacaagggcacgcggggataatgacagctttgtcccggaatcagagaaagagatgctatggaccacaatgctcgagacgttcacgctccctgcgggtacggagaacatagtgaaacagtggactcttaagaaaatggcagaagagttccagaccttcaagggagatctgtaccagaaatacatcctgaaggggcagacaccgaacttcgacgtattcccgaagctaagggatcactgggatgagtacattgcttacaagacaggtcaacaagggcaggcgatgatgaaaagaaacaaagaaaataccgccaagaagaagtaccatcaccacttgaggtcaggcggctatagcgtcgcgatgccgaagtgggaggagatggaggcaagcttgcttgagaggggtatcaaaccggccaccgctaaatggcctgatcgatcgaagttctggtactatgctcatggtggaacgctcaacccaattgatggctccttggtctttagcgatcagatacgcgaggctgcgaatcgactaacggacgcagtggaagcctcttctcagggcacattccgacccgacagagagaaggacgagctgtcactcgccctacagactcccgagcatccaagacgaacacgagggaaaggcgtgattccctggaagatgggattcaaggaggacatccacacgtacaggagtcggatgaggagcaagagagataccgaggcgaagattgcagatcttgagtacagggtatcgagctaagagctcagcatgcaagaggaggtggcccggaaggtggatgaacgcatggcagcacatcggtcacacgatccccagccgtacatacctcctccaatggtcagcccatcaggcaatcgtagcagctgcgcctcaacagggcaggtaggatcacatagcatggacgccatgcaaacccaggacgaaaccacctgccccgttgatgagatcacgcaacggacaccatgtgagctgcatattcccttcaagaacttatcaatcaaggtatgctcgatgtaatatatgatttttgactcgtacgttccgcaagttgctgcttaggttgattactaatagataacctctcgtcatgtgaaggtggtgtcaggaatggccatcccaacagacatttcagggacttaccactgtaggccgattccagcaggatactcgatggtcgaagttgagctggtggaagccgtgtacgaggacctcgagttggactacccaggaggagacggtgagacgcatctacgagacacaagccacgccattatactatggcgcaagcggtacatcatcctccctaggcgacaagcggcgtctcgtgcaccatctcctccggctctgccgtctcctcctgcaccatctcctccggttcctccgccacgtcctcctgcaccatctcctccggctcctccgccacctcctcctgcaccatctcctccggctcctctgcctcctccacctccaccgtgtccgcctgcacctcccaagacaaggtctcgccaagctccacctcctgccagcacaagggcaacgaagaaggccaaagttgacaccaccaaaaacaaggagccgccatacggttgcagtcaagaggagcttgacgcttatgtggcaggagaagtgaagaggcaactcaagcctcggagtcctgaaaagaagatagctattgacccgagtgtgaagaatttcttcaagggaatgtccaccacaaacaaggaggccttaaagctatcggattatgaccgaacacttaggaaagcctattacaagaagtccaaaccagttcctcagcttggagaacaaccacaccaagtgttcgagccgttggtgaccggcgaacactttggcataacggatttcatttcggacaccggtctaaccatggctcagttggttggaggcgcaccaatcccgaaggtggaagtggcatacaagtttgaactcggtaaaccgcttgtcaggcctaagcagctgcagtatatacatatatgtgtgtacatatatatgtgtatatatatatatatatatgtatatatatatacatatatatatatatatacacatatgtatatatatatatatgtatgtattctatatacatgcataatatatatattacaatgcatatatatgtattttgtgtgtgtgtgtgtgtgtgtatatatatatatatatatataatcaaccatgcagcaaacagggccatgcaaataaaaaaatggtacatagatctttagttcaggttggtaacaccaaccgggactaaagatggatcagccggccacgtggctgatcgatctttaatcccggttatttcacccgggactaaagatcgctatctttagtcccggattcgtagtttcggttggacaaccgggactaaagggggttacgaaccgggactacaaacgatttctccaccagtgaaagaggaggtcagtaccttgtcccgtgccttccatctagctatagtattttaacttgttaacatcacgattatttcagtagattaatcatgtgcatgcttgaatgtaacattttcctctagagtgcttcatagagatgcacttgatagtgcagtggcaagagatgtgtggttttaaccgtaaggttctgtgttcaatccctaacacactcacaatttcttcttaaaaactatttggaggtacgtctcttcctctatacagtggcgccaggaagcaaatagcgcgactctgagcattcatctctaaacaatgagtaaagaaattacttctatctctgccctaatttgtaaagggagtaaaaaaatcactctcgagtaaaatatttttcacatcacttttgatcagttaatggtcaaatatttttcacatcacatatagttaaaaattaactaacttgttcaatgtcagtcgaaaaaagaacatttgatttacaaaaaaattaaaaaatcatagacatttaatttttcaaaaacataatgaaacagaagaaaaataataataacaagaaaatactaaacgtttatcatagtaaataactcaatatgctaggtcacgtttattatagttgatgaatcacacatagttaaaatttaactgactaaacatgaatatatatggtgcgctatatagtagtaaaaatttaactcgtgaatcaaagtgggtggagtcgggaggggagtggggtggtgtcacgcccagaaattcactagtaatttctgaactaatttgtgcataaaaccctcgtccaggaatcagccgaggtacacaaactgacaatttaatatacaaatccatcaaaataataacgttacatacttacaaaagaaaagaaaactgtagcggaattacggtctagcgaagctccggctccactcccacaggcagctcaactggggtataagccaaatatcttctccttcgcaacttgtcttcaactgaggtttgattgattattgcaaggtgagcatatgacatactcagcaagccacacagcaaatatgcaagtgcacaaggatactaaagaatggcatagtatagggcttatttgcaaaagcagcatttagcaaacatttgagaattgtaaaacagtagagcaattaatcatcaatattaatcaacactgtacaacatacccatgctgcacaggcccaaccatcctgaacaaccatacccggctgcacagatctatctccaaaccaagaatataccattccaaaccaggagctaaattaattagcatcaattaccacattattattaatgaatagtgtgggactaatcacgaaagacattgtttgacccgcccataaccgcgggcacggctattcgaatagttttactctggccaaaggtgtaccactgtacccacaagacacagccccacgacatgtcaccatgtgcctcaataccaccacggtacctcggaaaggagctgtgacagtacccctcgcacaacacaatccaccacaacgcaccgttcctggatcataatcacccccttataaacaaggcatggactccccagcgacccccgtgggcttatctccgccacttctcagtctggtgctccgcaatgaaccatgctatacaaaaggtaaagccgttgcccatggtggcttgtggttggcacggttaatgtttcacaaccgaaactcgtgaaccggtccttaattgtcatgagcacgaccatcaaaaccatgtgctcataacccacctttatcaagttttagttggcatattaattaattaaccaatcacgattaaccatcgtgagcttccattaaatatccataagtgatagtgaagcatgatttatcccattagtgagctattgtttctaagcacggctaagcatctattataagcatctagctgaaccaaaccaatatataaggttctagctaatcaaattataacccataggtaaataaagtcatcttcggccataattaaatgggaaaggctcaccacccggtgacattcgaaaataaatgcacaattaaaataaatagagaatttaaatgtaggatcaacatgctcaaaggaattatgtttgggatctgtgacttgccttgcaataaagggtcttcaattaatcttcttgaatacttccgacgcactcacgaaccttcgaaacgacggaaacgacaagctaacatgcaaaacgaggaaaaagactaagaaactccaaataaacagtacatataaagtaaacaaacatgtagatcatgattttagatgaatttagagacttgaacgacctcattccgatttcatatgaattaattacaaattttacaagattaaattccaattaaacctattaaagaaaagactattccaaattaattaaacaatttacaaatgatttataattgagagaaaagattaaagcaacctccggaaaagattagattatattggtagatgacatatgataaaaagaaccaatatgccattggaaagagaggaaaggatttatatggctgagattaatcttgaccgagtcgaccaagatcggatggcttagattgatctggcaagcaggcctcacgggataccaactcaacgagtcaattctacgtgacacgggatcacccaaatgatcaaccgaaaccggcgaacggaaccggcggctctgaactaaaggacgactcaacacggacgaacgaacgaagcacggggaacaccttattcgaacgaacgagcgaacgattcaacaacggctgcaactaaaccggtcggctagaaacgattcacggtaaagccccggtacgacaaacgatagaccggtaggaatttagggatacacctacggctagacaacttggctaccgagcaacggctaaagcggcggctaggttaaagcggcacacagctgcgacatggcggcactagggcgacttggtttggctaggcggctagcacaacggcggcaacaagcaacaacggcacaaccggtagtgacggtgcacagggcagccggcaagtgacgcggcagcggctgcgctagggttagagcaacagcggcggcgacatgaccgagggattgaaacctaacccgaggggacacggatagaagtctcaccgaaccaaagcgatcggagatagatgacgacggtgaaccggcggcaacacatggagacgacgacgatgctagacagacaatggattagattgaattaagaccctagggataaagtacaccggtgaacgacataggagcggcggttgccgacgaaataatgcaaacggagggcaccgggagaaagaggagatcaaagtgaccctagccaccacttatgcgacgacgaacggcaacggaagatggccggcgacgagctttgaagggcggcgaggtactggccacggaggcgacgactttccggcgatgtgcggcgacaacggaggggtggccgggcttcacttcgcagctgcgaatccaatggaggcagcggcgaagcttggcgatgacgggaggagcagcagggcttcgccggagatcaaaacgcgacggcgaacttcgggttgacggcgacgatggagctccggtggattttggtggcgacgaaggggcggacggggtgcagctccttcttgcgaacctgacggaggcaacggcgagcagcagcggcgaccacagcgacggcgcggggcggctggagacacggcggcgacggcggcgctccggttcacgacgacgggctacctccgattggatttggcgcaaaacaacagcggccggggtagggctcgacgttgcggagccgagggaggaggcggcgctgaccggcgacggccggggcgacggcgaatggcggctggagtggcggccggaggtggagagagagggagctcgcggggagagcgtttccggcgacggcggcggacgggacttgaggggatgaggagaggacgactagggggtcctttatataggcacgggagctcgggtccgggcccaaatcgacgagaaaaaaaatcgggaaagtctagggttttcgccggtaaaaggaaggatttgatctgcgaaattggaaagaatttccatagaaaattttggggatttcttggggaaaaggaagaggagattgaggggattccattcccgcaactaatttggaaagaggagcaacggggaggtcggattggtgggaggaggcggcggcactgtgcacgagcacggctggctcggctctgtctagaggtagaagaaggagcactgtagccacagggaggaaaaacagacttctatgtgggctgagaggaagggagagagaaggggaggcaatgggctggattcggcccaagctgatgaggaggacttttatttacttttccaaataaattaaccaatgagatgatctttcaattgttaaaaatacttccaatgctcaaataattccaagaaaaatcttgaacatacttggacactcaaagtatttaatataataatatccagatcatttaatgataaatttattatttaaataattgctaaactgttctttgtattattaaaattaggaattgagctctgaaaaatctgagaaaattccagagagtataactaatcatggagaatttaataaaaattaaatccatccatgctttatatttaggaaattttatttcccacatttaacttcacttgtaaattaatgaacatttaatataaattctattaataatttattaaatgatttataaatccttaaacgaaaatcaggctgccacaggtggtgggcagtgggtgggtctggtcactatgtcaggtgccgtttaatacgtagacgtttaaattttgcaaaaacattatgaaacagaataataataataataataataataatattaataataataataataataataataataataataataataataataataataataataataataataataataacaaaaaaaaattaaggcatgagcaaaaaaaagtttcctttagttaataaataactcaatatgctaagtcatgttcattatagttgctgaatcacacagttaaaatttaactgactcaacgtgaatatatatggtgggctatgtagtagtaaaaatttaactcgcaaatcaaagtgggtggagttaggaggggagtggggtggtgggcagtgggtgggtctggtcactatatcaggtgccgtttaatccatggcacgccacccagccccacccgctgtgcaaccataatccacagttaaaatttaactcacgacgccccacacatgcgccactcctccacacccataatctgactaaaattttaagttgatattcccaacttttagcatatatatacatgtgttgtcccccaccctgcaaccaaccacatactgatcctatttttccagacatgagagaggcgactgagggcgcgacgtcggcgggagggagacgcggcggctccacctccactgccgagcgacggcgggcacggcatcggcggatccagcatggcatggcacggctacaggcgtggcggcgacgggcgatggcgtgagggaggtgaggaggcggcgtatccgccaccgctccgtgccccacgcatgtggatccggccgcggtcgggcgaatccgccgctgatctggcactgggaggctagcgtagcgtcggcggatccggcacggcacggctgcgggcgaggcggtgacgggcaacgatgagcgggaggcgaggatgcggtgcgacggcggatccggcactgatcctgcacggggagacgcggcggctccacctccaccaccgagctgcggctggcgcggtgtcagcagatccggcgcggcatggctgcgggcgaggctgtgatgggcgacggcgagcgggaggcgaggatgcggcgcatctggccgctgctccacaccccacgcgcgcggatccagccgcggtggggcatagccggcgcggctgtgacgggcgactggggcgggaggcgaggcggtgatggatccggcctccacgccgcctccatgcgcacggcggcgacctccgtggtggcgagctcggactccgatggataggcaagaccagtggtgccacctccacgacacgccgccgtcgatgtccggagcaagtgtaaacaaaattttaacttttgctcataaattgtgaggatgtatatgttgagtaaaacttttattgtcataccaagttaattttttacttagtaaggataccaagttaattttttacttagcccgccctccaatgtttttaaccttattcagctgcatcccgtgtaaaatacggttttgtaatgaatacgtgaaaacttatacgtgttgggatgtattttttgataacaacaaattacaaaacaatgcgaacaatcctctgaattaaagaaaaatgtcaactctacaacgatatcatcgcaccctaccacacaactgtatctcggttaaattttaactccgcgagacgggttggttgtctcggtcatggggtgtcacgagttaatttttaactcagcagtgaccaggttcaatcacatatcgttcaaaattcaacaacaactaaatttttaactccaaaaccatgtcatcgtatcgcaccacccaactgtgtttaagttaaattttaactcaaaccaactgaattaatgcataatattaactcctcaacgatgtcatcgccccccaccactcaactctatctaagttatattttaactacacgggtggtttggatgcctcggtggtggggggtttgtcgctgtgtgtcgcaccatggagttttcctggcgcacagcgcctatgtgtcgtgccgtgtagcgcgaccgtgtctataaatatatatatatatatatatatatatatatatatatatatatatatatatatatatatatatatatatatatatatatatatatatatatatatatatgtatatatatgtatatatgtatatatatatatatatcagggttatggataccacatatctaatagtagttgattgaatcttgacaggacccaccacttgatgaaaccatgagcacttgagcaggagcatgaagtcacatggaatttcttctttaaaaatgcatggagggacacctctccctccaaatctccttttttttcctagagtgcttcatatatgctatatatatacatcacttgatgaaatgatgagcacttgagcgggagcttgaagtcacatggtttgtctttttttttccgcacttgtgacagcatgaacctaagcttaatctatgtttttttaatgtactgatgtacaagcacaaaagattacagatgggaggcttgtgggtcagctgctgaacctgaacaatggccccaagctcctgaaccaactgaaactcaacagatgcagcccattgggatctattcctcaacaaagcgagctgttcactgatcttcgttcgctcgtgatttggtgttgcagctgggactccttaccagataacatggagcgtctcaagtcactcgagaaactagagctatttctttgccctcaaatcttgctgcttccagtgctacccctgtctcttaagacgtttcgactttatcgctgcagcgacgtgctcacgagttcgtgccaaacaattggttatgaaaactggcaaaagatcaagcacattccaaacaagcatttataagcatccatacatgttcaatgtaaagtccatgtgtgctcctccatttcttttttttttatttgaaaagttatgctctacggtgattatactgttactcatgttgattctgttttgttgatcaggaagtaattaagcctgtcaaatatactaaatgctgggggcggatcatggtgtgcacatgcacgccaatgcacggcatttggaacacagccagagaagaggacgttaagcatggtggctgagatcagtaagccaaaataaaactggcatggccagattgtgaatttgtgatctttggattatttcttgctaatttcagtataataccgtacattctgtgtttattcattcatttacctgtttcatgtttctcttattattccttgtgttggtcaagcgcatggccgggcttgtcggtgcagcgccctttgtgtttgtggtgttcctcatgcgtgggatgcatggcccgcgtcgcggaggatcatgttgcatttccacagatttcctgttcttgcttgctgttaaataagagaagaaaaactaagaaaagctgcacagttctggtagcacaaaacattttgttcaagtgtttgtctaagtgcttgcttaagtacaggagcgtctcccgtcagattgataattactacctccatattttaatatataacaccgttgactttttatccaacgtttgaccattcgtcttattcaaaaaatttatgtaattatcatttattttattgtgatttgattcatcatcaaatgttctttaagcatgacataaatattttcatgtttgcaaaaaaaattgaataaaatgaatgatcaaacgttggttaaaaagataacggcgtaatatattaaaatacggagggagtatattttctctttacatgtgacttaaaaatatgtgcagtaaaaacgcgtacgaaacgtacaatattttcacattaccaagaacacatgcgtgttttctccctaacatatttaattacatgaaattattggaagcacaccggatgcgttcaaatggtcgatagatatttcttcattcattcatgagggcgtcgggccgtcgcctcgcggagccatgcggagactccggacaaaagacttgtggagtcattggtcaacggcacgtcctgttgatctgttgatcgtgccgttgaccaatatgttttgtgatcgttatttttgacgcatcattttttgtcgctgttgatgatatatagaggactatatacaaaatatatataaagactcgaatatcctcgacgcatcgctgttgatgataaagaaaatctcaaatatagacgacaaagacttgactacttgagtacgtaggtactcagtcatcggcacaatcgagatgcatggataaaaatttaaaagcgcgagtcaaaacttgttctgagtctctcactccctgcagtatgatatatttttcaatgtcttcacgcgggcccttggtacaattttatcgttggtattagatcttcgatagaggaccgtaaaatcgatcataactgaagcgtgtggagttgtgggtgcgtaagtattccataacacacgcgtacatattccctgaattcccgtatgttcgtttctaacccatgctcacatagacggttcatgtttgccgtcatcaccataatttttgaaagcatgtccatgtgtgtctaatatttatgcacactaaaaaaatagcccgcgcattcgtggtggacatgcgtattagtttgtttcgaaaatagttctaacaaaacaaattatttaaggtaaggtatttttgatttttttaattgagtgttcattatatcttttttccttgaataaatctcgacaaacttttattgtttttgttggtaagaaatgtattttttaccaccctactaattatatctttaattgcttcacatatatgcaaattcgttatgcatgtgaaccaataaagatagaaaagttctttaaaaaatatttattgtattttgaatttagtgattgagtgattctaatttcgaatttatattcaaatcaaattattgttttattctaaattgtatttttaggaatttgaaattgtacttaatctcgtaacgtgttgtatttggactcttctaattttaatacttattttattattccaaatttaagatatttataacttatacttttatatagactcttgatattttatattctacatagtatcttgttatgttttttagttttaatttttattttatttttaatgcgtttttaatcaaattgcttgttttaatttttttctgaatttaattacaaactccttgtagtaatccagctgtcaccatcggcctcgcggatcatcttgtcggccttctcattagtgagcctctcttgatgtattggacatgatgtggcaaggctcggcggtagagatggaaccattttctagtctttgtcaaagacgtggaacgtctccctctgcctctcctctcagtccttgcccttcacctaatcatctagtacgctgttagacctaggaactcgtggaagtcattgatgtcactgtcgtcggtgtccatctctccatcagtttcaagcccaaggcatgcatcatggttccaagctccttggtggtgattgaacatggattttagactcacatatttcatcgctttcgaagtgctattatgctcaaatatttgttgtcagaatgaccgcactatctaacttctatatagcaaaatatgggtaatatggatcttggattatgtatttacttataaataacacaacaaatcaaataattgagaaaagtacatttaacttgagagtcatgattatttagctattcttttatatattatgtgttagctaatagtatcctagaggtgagtaggagagtggagggagtacgtacgtacgtgcgtgcatgctcacataggtatttgctcagacttttaaaaaacacacacacatatacaatatctactcagggtgcggtataattaaaacacatctaatgttagtaatcattttattgagagtggaatcatcataaatcttcatattaaatctaacagttttactatcaaatatttaagaacatataacgtgtagtaaaacatttcttttcttttggactaagcatttcataaattattagaatactggaaatttaaaagttaggccaatgttatccaatatactataaacaacttcaagggtcgtttatatttttttcattgcaatggaaaacctatatgcacatatacatgtgcgtaattttacacacttcttggagcatttacttttaaatcaacaataatatagatataatgtttaaccccctaactatattttggttgtcattttttttggcctgtcagccttgagtaaacaggcacgtaatatgttagaatcaaatgagctagacccaatttaatcctaataaattttatagacctacaattaatgttaacaagattaataccatcttgaaaaccaacgagaaagaacctcaacttaaatatgctgctatatgagagcacttgttgagcgattgaggtggtggtgagacttccacacacgcgctgggctagtccatgagcgagggtgaggcgtgaccagcgggcgtatggggacttgcctgcctccctaatgctaccttttgttttgatgaacaaaggcataaccgacgggtgacattacttgaagtattggacgataacttaatgcgcacacaacgttatctccgacgggtgacattacttcaagtattggacgagacctcaatgcgcacgcaacgttatctcccctactagcatgtacaaaaacctctcttgattctaagcactttgagcacacgagtgttcaggacaaggttatcttccccattgggaaagacataaacctctctcggttctaagcacttgcgcgcacaagtatttgggacgagcaggcttccagaactccattcgcttgagtacgtacacaggttagacgagcgatcaagtttttgaggagcacgttcttcacacggctgctctcggcactgcatctccttccactacatcaacatgtcgcccgtaacctgaatggcagcaacggaggtggaggcgagaatgacaatgacaacggcaatgaaggcaacaacaccaaccatgcctcatccagtaccagaacatacactctctgggtatatcactctattcaccttagtattaaacatgttgctagatgatgctattactgttattagcacgttcatgtttacatacaactgaatcatcctattatatacatgttttgcttattatgtttttttgattaaaatataccgaatcgtaactatatttccaatgtatagtaacatactggtatatatttcacactaccaaacaatgaaacacgcatgggtgttttctctgaacataaccaattaatcattgaaacaccggatgcgctaagaaaaccagccgcccacagctaagccaaaatgctggagatgtcattgttccaaattgacaattttgcctactaagcacgtgggccctgcaaagactctggacagaagactttagatcaagtcaatcaacggtgatggattcatgtctccggtctccctagagggatttactcaagtagtctaaaaagttataaaaattaaaaaaaaaagtagtaatagaaaattagtaagatcacgacgagactacggatcatgcaccctattctttttttttctaaaaaaccgggcgcccatctctagctagtaaacctgcacttcactccctgtcaactgtccacttgtacgcattccattccctgggatggctgagcactactttttttttatctgacacgcatgcaaaccgtatactcccttcgtcctatagagaaccaatctattattggatttaatattttctactacaatgaatttggacaggagctaaacaaatctggacttgttcctgtccagattcgttgcactagaaaatatctcatctaatattaggctggtttttttgaactgaggaagcatatgtgtctttttagtcgcatgcaataacattcaaaatgattgttattttaaactattcatccaatctaaagatctaattcaaccattgtatttatcgcaagtaaatttttataacaatatctcgcatgactattttctgataaaaatattattttatatttttagcaaaggttctgttttttatgttgcacatcatattctttatatatttcgatacgtacttcctgatgtttcactaggacgtttgcagttgttgcatgtgatgttctaggtgttttatagtaagcattttgtgatatttcctacaattaaattttccaataaatttaagtatttgaatacatataatatgttccttatgaattctttttaagtttcattagttgggattcaatgttaatttcctgcggtgctttttgtggttgttgcagtatgacgtcatgaggcatttttcacccttctctgttggttgtaggagcgagaggctttggcaaccggccgcaatatgcctatttcaccgggtgccaatcccatctatgtcttggatgagatcacctaagatttcataattggaagtaaaacaggccaagagcatgcggtaggcgccggtagggggtttggtggcgatccaacacatgtacttttttttactagaaaaaatgtccgtgcatatttaacaacaggtgaagattattttatttgtattgttgttatacggtctagttaagatgaaattcacttagatatatatttttttagaaaatcataagctgcaattagaagtccgatcgtcttagcatgcaagtctttttaaaaagaattcttatatgactctttctatattttcaaaagcgaacgaacttaaaaaccgacttaaatacggatatgtatttctaaaaacgatcgaacttaaaaaccgactcatacacgaatgacttattaaagtaccggcaaaaatatttttaatttttataacagtagagatagaaatagagatggagatagagatagagacacgtaacagtacgtaaaaattagagattaggtgggatatgatttggcttttttaatctaatccaattagaggatttgccggttatacctttttttgacatgcaatacgtacatatgcgaattacgtacttacgtgttagagataggagggtgtgattagccgggatgaccatgaggagtgattagtaggattttttaaattctaatccaatggtcatctattgatttactgaaaaatccagggatatgtactttttttgtcaaaatttttagaatttctaggctttgtatttttagaaaagatagatctaatggtctaatacatatttaagtgaaaatcgatgaacaaataattttattaaaaattacgtgaaaaaaaaggtaggtcaatatttgtacattcgttcctacttaacagaaggaaagatgagactatgtaaggaaggagtttggttcggttttttttgagaaatctaatctaatatagtttataatattagacccataaatttaagtgaaaatcgaggggtatatgttttgtttttttctcagagtttctatatatgtttttctttaatttattagagtgccaagtgatggcttgagattgttttgagaaagtttgatagactttataatagatagactaagatgcatgggtgttaccgcactctacacacacagtattgccccgtttttaaatatacgcactagttgagtctatgtacttttaaccattcatcctaattaaaatttataatacaaatataaaaaagtagaagttgtgcttaaagaacctttaaagataaaataagtcataataaaatatattgtatttatactaaatttctgaataacatgattgatcaaacgtatgtctaaaagttagctgtattactctctccgtttcaaaatgtttgacaccgttaatttttcagtacgtgtttgaccattcgtcttattaaaaaaattaagtaattatttattcttttcatattatttgattcattgttaaatatacttttatgtacacatatagttttacatatttaacaaattttttttaaataagacgaacggtcaaacatgtgctaaaaagtcaacggtgtgaaatattttgaaacggagggagtaaaagttacaagcactttaacacatacatagaagatacactgcactttaacacaatagagaactatagagcataaagcttggcaccggatgtacgtagtaaaggctattggtgctcatacgttttgagctggaccagtgggtcgctccaagatgccaccatgtgcaagcaaagcccagagatgtgtgatgaactctcctccccttggcagggtttccaggtgcgctttggcatcattcgaaggtgcaatgtacagcatcatctctgcccagaaatcacacagcaccttccatctgtcccccgggtgttcgatctcgatgagattgtttgcgagccgaccgcccacaacgaggagacggttgtcgccatggtcctggcttcttagcgcttccttccgctgctgcattgttttcttacccttcagcaattcgcgggcttcctcgaccagggcgtcaaatatggattcggagacgaagctatgatccggtaacaattccggagcaaaggctactaggtaggcacagtaccttgacaagctacaagctacgtgctgattagtagtagtagtagtactgtctattccatgttgatcttcgtcttccacctcgcaaagagtagtggcgatgtgccaagccattatgatatgtgttgtagttgggagtgtggtgcatgaccatgaaagttggtagtatacctcgttagcgtgcagagatatgacacagtttcccagttggccaaggcctctattcttcttcagggtttctataacggttttctttacatccatggataatctgacacgcttatcttccttgcggcccttcttggtcttattgaccaaggagaaggtagcatggtacagtatgttcatcgatttgtagtcaaaacttttgagcagtgtgtactgaccgagtttatcttcccagctccggaagtacctgaggctcgtgatgcatccaatcaacttggagaacaatacgctactgttccatgaatctgtggtaacatatttcgatatcatggctactttgctccaggccgaggccaggtatatgtacacctgtaaaccctcaagcagagcgattgcgatcgctgtcacggaggtgaagagagcgtcgtagttcctgtggttagcattgacgaggaatttgagctcatcttcatcgggtacccggaggaaatgctggaacagcttgtaggcaagccaaccgcaggtcgggaccatggcaaaagacaacgtgacgaacagatggtgactgctatagataaggaagtacttggtgtagaagtagtcgtgcacaaaggctaattctacctcgatgaccctgaaggttcgttcgacgcacctgtcgccatggagcaggccaccgaagaggaagtcgcgggtcttgtggagatttgattcggcgagcacctgaaagccggcaaacctgcggttcagcatcttggacaaggccatggagaggcacacgtccttgagcctgccgccattgccaccggagagcagactcccattgcagttccagatatcttgaacggtaacgagctttgcccggtcatcgtcgttgtacctaagatggtactcgggaggctccaccctaggattctgctcgtcctctcctgcaaccacatagtggtacccttgcatgtcgacggcgtctcgtcgttggaccccgtcgccggcaggtcgcaggtgctcgtagctcatgtagtctgccacccatttggtactcttggagagcatggagcttctactggctagcttgaacgacgcgacccgtgtgccggatttcaatatgactatgcagtatatgacccatagaatgtactggaaatccgagccaccagaggaaaccaccagccaacccacccagaaagactcgatgagctgcttcaagtagaacctcttccagtcgtcgttgtctagtaggctataagcagagaaagaatcggcgctgccgaggaagatgaagaggatgatggcccagacggagaagaggctgttcttgtaaggggacgactgcatcagccccagggtgtagctcaccatggggatggaagcagcgtacgccacccagatggtcattttgacagcttcacagctggaccgccggcggtaggagccgaggatgaggagcacaaacagcccgacgacgcccaggaacacgagaacctcgatgcggatcaatcgcaactttgggctgttgagcccgtgaaccatatcgacgagtgccatatatacgtaaatatgctatctaggcctaggtgttggtgtactggttaatatataggcagcagttgcacgaaggatgatagccctaccagctgctgctaggtagctagctaggtcatcgataattatacactttatccaaccatcccccctgccttgtccagaccatctgacggtcggacccacttacacataacaactccacttacaatttcatttttattttcattctcgtttcgtacaaaagggttaatatagttgaagggacaagctcttataagttgattccacttttactaaactagcaatgtggtatgaaacatacatacacagcttacatgcatgtaccacacatttctaattcaaattgggccgtgatgtcacactgtcctaatcgatctcttaacttttgcccgatgttataattaggaactgaagacttgacgaagtcacgcgaggatcatttccgaccttgcacactgaccctcgtttgtacctcagttctattaattaaggggcaaaacgtacagtatagtgctagggtataagtttcgcctcgttctttttaatcactagctctattagatttttatggacacgcttccattttctgaacacggtacgtaccgttgaatccaacttcttaactagttaattaaaaaatttgcaactttccgttcgtcacatcaattattttttatttgtaagtgcgaccgagcgatggcctccattcccacacacgtaagtaacacatcgcgtaaagcggatacaacacaaattcaatagatacaaaatctaattggacaattcatatgatatttcacactattgataatatattataaaaaataatgatcaaattataaagtttgtttaaaacttagacaaagtataatattggagactatgcagacacatattgtcacgccccgaactagccccgagcggaactagcccgtgacgctccaaattaacctgttaatcgataccagtcccaggaaacagtgctggtatcacaggaagacagaatatcacagcaacagatgtctctttattatagagtaggagtatagtcatgttgggctgcggacagatcccgagctcacaactgcattacaaaagggaagcagaagccaagacttggaccaaacatcacaggcgcgacttgggaactaggccgaaaccctaaaactcatcgtagccgacttgctcctagaagaactcctcgtcagcgggatccgcttcatcttcttcagcaactagggaggattatttatatagagcaagggtgagtacgggagtactcagcaagccatggggattaagtgtttaatgcaggcttcaaggaaaggctgttgtttttgcaattgattttatttaaactcttttctgaaacaactaagtgagtgcttctcaaacgacacggatgagacagtgcgtctcgtccggtcggagtatgtgcaaggtatcagttttttatgaattgatcaaggttggcatccggccaacagctttcaaacggccacccgggcctggctgatcccattagccgcaaattttccaaacatcgaacccaaaccacctcagcaaatttcacaaagcagtagtcaaacaaaactacactaggaatcacctcacattcgcccatgaccatgggcacggctattcgaacagtttaataacctctgcagagggggtacactttacccacacgacattactaacctggatcatccagcccgtgcagaacggccacgactagagaccttaaggctttcatgacaaggcatttcgaaagccgacacaggttcaccatatgccaacaagaggggtcccagaccaacaccagattaggtcccagaccatactgtgccaggaaacccgggggttctccccgacaccaccccgttgaatccacatgtctcttggcatcatggctcccccgattagctagttactcagccaggggtgtcccattccaaccatgtggtcgcacttgtcttatgttcggatgaaattccaaggaaacggtccttaagtgcaagagcgggaaaccgtacacccggtacgttccccggtccccgattttttggaaattcatttagttcgcaagcaccgacccaggtgtcgggttttccaagtcttttgtaaaacccaagttttacccatggttggatattttatattttgagggggggtgttccgatgcgcgtacccgaaggcccgttaacaaggaggtttaagtgttcaataattcaaggagggtaattgcagcaattaggattggggccggcaggccgtctcgcaagccgcggccgaattacttgtgtaaatcctattcatgcaatatttgcagaaaagaaatacttagatttaaattataggtgcaagatgatcaaaggtgacttgccttgctcgagatcttgaacttgatcttcgaaatcctcgcactgcgggtcttcgggctccgaaactacacgcgaaatgggacaactcaacaaacggcgaaaataaagccatattattgacctctaggcgtgtcattagatagatctcgagatttgaggagttttggaagttgaacggagtcaaacggacttacggttgggaagattttgaatttctaagtttattcgatttttggtctaaaggaaaaggatttatttaaatcctttttgagagaagaaaagaaaagaaaagaaagagggaggggaaatagacttccctcgggcggctagggcgcggcccgagagaaaggggcggcttggccaagcttaatgggctggccggtccaagaaggcggcccaaggcgcgcgcgcgggcggggaggagagagagagagccggtgggccgggtccaccttgcgtggtcccgggtaggacccgcttgtcagcggctcggcttaccatgtggagggagtacgcggcgcggcgctagggtgtggagcggggcgcggtgcatgcgcgtggctcgcgggggtgcggatgcagcgggcccacgcgcagcctcacggctcgcggtggaccgcgcgcgcgagcggggcggagggaagcggcggaccggggtcagcttgacccggtcgcggccgaggtggcgccgacgtggcgcctacgtggctgccacgcgggccggcgggaggtagatgacgacgtcggccggaacggacggcggacggcggcagcgagcggcggagcgaaccacggcgatacaggcaaaagcgagcacaccgggaggttgcacgggacgaggggagacgagccaatgactcggattcgccgggggttgctcgactgcggtggattgcggcggcggcaaccggcggcgagagaaggggggaaacggcgacggcgcgacgggagaccaattcgggcaagctagagcatctacgcgactccgggaatccgttgctagcgtcggattgggcggagctacgccgagcgaggccggcgacgagcggcgctacggagcataggcggcgacggcggcgagcacacagcgagcggcggcgagcacacagcgagtctaaggggaggagatggaacgaggagggaaaacagagggaggcgagcacacaacggtcggggcggcgccagctagctacggggaggctactcgtgctactacccgagtctaaggggaggagatggaacgaggagggagaacggagggaggcactaccgtgcggggtgatggggagcagtgacgaggggccgatggcacgggagtgatctctccggcctcgggccggggaagaggaagaagacgagcacccggagtccccttccgcgtcctagcgcgcaccggctcctccggcacacgcgacggcggcggtcggcgagagagacagagggacggcaatggcgcgggcgaaaaacggggaagattgggagggaaaaagggaagggagggcgcctgggtttatagggcggcaatgtcggtttggaaaccgaccttgggcggtcaaggcgcgagctggcgctcggcgctcgcggccaaaacggcgacagaggcggatgacgccgacggggaagagggagagagggagagagggaaaaaggaagggagaaaggggcttgccccttgcctctttgggaaaagaatgagggagagagggcgatgaggaggagccctgcctcctttccttggaagcacgcgcggggagaggcggggccgagtcgatgacgacggcgatgacggcgggggcggtttggaacggagcggcgacacgggcggcaggcgcgggctcaggcgcggcaggcgctgacggcggcggcgtctggccggtcggccaccatggcgcgcgcgcgcgggaagcaacgggcggcgccgcgatttcgcgggcggggagctcgcggggatggaggcggggagagggagagcgagggggaggcgctcggcgcggctcacgggcagagcggggagagagggagagagagagagagagagagatgaagagagatgggccgagaggaattcggcccatcgaacctgagggaggcaaaacagacttttgcggagggatttgatttgggacggatcgagattcgggatttgaatttgacgatagaacggggatttgagatccggactgactgcaagcgaagaaacaattttcgcaattagggtttttagaatttaattttcccgcaatgcgccacgacggaatgggcgctacacatatataatatgccaatatatttttcaaagtgaggttgtatcctctcttactataaagttataactcactaacttttaaagcttaacatgcaaaaaatactacatcatcatacactaacaagatgctatatcattatcatccactaacaaccattaaatttaaacatcatgcaaacatgctatattatctataaacttatatttaacatgtgatcatcatttcatataattcacataatatttcaatgtagattttcattatttttttataatatgctatgtacctgttgacagagtagatcacaactaggttatttgcagaatatggagatcgttgttgctacgatatacgcgagattgggggtaaagatacagagacaaggatgtttatacaggtttgggccccttaactgacaggtaatagacctactcatattggtcgaagccagtattgctcttcttcatcagaatcaaacaagtacaatatttgggataacatatctagtcatcattgacttgacggcatggaacaccacacgtagtcgacgacggaatagtcttcctgctcgaatacaaactcgatgacataagagatggcatttgagtctgtctaggcttgtctccgatgtctatgtctggtgatgtgtattggtatctattctcactgagcgtgtttattatggttaggcttggcttgatctcccccctctcctcctagggggcttgtatttataccacagatgtcccttgtccaaatagaaataggaagacaaaaatggatacgatccgagtagtccttgtagtttccatgtagaactctgcttctccttctgtataaggaatattttccatatatgaggcatgattccatataaaacttggtatatggtgggccccgctaagctcaacctaaggctattgggtttgccttatccataacactggcagtacctacatagttcatcctcacgtagttaatatttttttctcttgtttcattaagccatatcacatcaattgtttttagtgcttaaatgattaatctatggtccaaattatctctctcattttcttctctcattagtccatattacctcaattatctttaccctttagatgattaatctatggtccaaactatctcaatacttttcttctttcataaagtcatatcaccttacttttacatttgaatcatcattctatttactatttaaatttaatttatcataaacctcattaacttacgtaattgttaacggaattttgcatctgattcggagaaggaagaagatcgatcggcgaagaagatggcgaagccggcgtgcacgctgatggcgagggaggccgagaacggcatccatgatccaatgaaaggtaggcatcgtaccttctgttgtttttctgttcgcttttcctttagatcaaaagcgatgggtttccttctttcacttcgcgatgtacttcgcgagagcgaaagtgctcataacgtgttgaaagtggataagattgattgagcgagagaaagaattgaatacaatagagcgaaaaacaatcgttaattaatttatattaattaagttagatgaccagataaaaaaagaaaagtgtgtgcatgcatagagggtatcgaactttggagttcgatagcgtgtcaaacaaccgtagagttcgattgggttgtttattagataaaataattcgaagtgcatacatgcatttgcatgcaggtcctatcgaccaatgtctgtcgataggtcctgcacacccacatgcaacaacaggccatttactggtctatgcgcatgcattgtacttttaatattttttcaccataccaatccctatcgaacatacatattgaacagtgtttgtttgatatgtacctaatagaacatcagtagcaaaagtgggaccagcggaggggcctgtcaggtgatgaaagggagccattgtaggtggggccgatggagaagtaaagaaagagagataagaggaagagagagaatgacatgtgggcctcacaggatgactcagcgggatagaataggtcaaagcgttacgtaagtgaaatcgtgttttacatggctactgtgtgtaattctttttcttgcaaaagattcgcctatgcaggtgtccaatcggatgttacatgtatataacgtgattttttttctaaaaagaaaaagaaagagtccttatctacttcaaattctcatattttttattttattttatttcaattaatatgagaatttatagaccttgagagctacagtggagacttttttttctattactttattaagttaattaattaataggtttatgcatctcataggaagacatgagccatcgagcccattagccttctgttttccgcaacgattgatacttctcgcaagtttcttcttgaagatgacgtcatgacggcgaatatattccagcgataatcagctgcggttaatttgttctggcaggtcggcaccttggccttcagtagttcagtgtccgagggagattccaaaaccaagttgatcacggtggaattacggacgatgatgagctactagctcttgattgttttctgctttgtattagtggatacttttgctgatatactacgcgaaagctgtcaactttgacgccggatttctcaagtagcttagcatggaactggacaacgttttgtctcaaggtgctgagatactaaacatctggacagaaaaataaatgactactagtgacatgaacatttaaaaattgcaacttcccattcacaaggcaacatgccaattgtaaattgatgtttgacaattggtttgctaaagaattcgagttggcgatggcacttcaagttgggacaactctgtccttataaaactgatcatcgagactgtaccgttatatgaacaagtatgttttttcccccattgactacaactcatttgagtctgcaagtcaaatactgctgtgagcaatcaagaatctgcattctaccctcctgttatgaacttttttagattgtaaagactctttcctgcccaaaaacgattccattagttgagatgctcttacactcatatattaaattccttacccttccataactaattttgaactattcaacaatatcctcttcatacattggtgctccccagccattcattgccccttcacagtacactgatggtccctcgagtcatcaatctgaatgtaagtatcctcctcctcacggccaccgaagagctccgccataaaaatcgacgatcgtgcggcgagcacgtccgctggcgaggaggtcgcggagatgccggtgcaagtccggtggtggcaccaccacggacgacgatgacgccgcctcgcgacggcggtggagggcactcagtaaccacggcgatgtcacacctgataccatagccctaacgttatttgtagccatggacaattaaaggagaaaggtcaccggcgacgatgggggaattttcatgcggaccatgtggccgctcccgtcgggtatactgaacacgtattctgcggtgacgacgtcggcggcgtcggccggtcgaggtagaggaagacagatacccagtcggcgaactcccggcgatcgccgtcgggtagtaggcgacgtatatatataccaggtgtccaggtgtcacccctccgtcgtggaacttacaggagttgatgctcttgccgacgccgatccctttggttctactgtagccggcgacctggatggtgactgacccggtttccattgctctcttgctgtcgatggccgacgacgacgtggttttgccgccgtcgccggtggcagacttggaagttgtgagacccattagattttcaatcaactttgctatacgtccgacgcatgtgtccgacgcttgtacgactgaaacagtggaaaaacgagcaatgacggcgtcagatatgactacgggtcgctgggcctcgttgttgtttgcttgcgtactgggctttctgtacactggggccagtctggctgagaacatgtatcagcttaggttgctattaaaatgattcactccagatgttagattagtttagacctttaggatgtgaaaccaatatattctcacagccataacatgcaagtcctctaaaaaaagccataacatacaagtaaaaaatgattgaccagacctgtgaaaagcaacgcaccacggcttcaatttccatattcatggccaaaatcagttcattaaacagaatacaggtagagtgacattcaaaatacaggtagagtgacatccaaaatcacaagcatactgtctaacattgaataataataaactagcaaatgttgtttagttcgtcgattgagatcacaagtaatgcaagcaaaaaatcattctctctttcatccattcatatgctgggatagaagctccgtcaaatcaccatttccctgcaaaagtaaaaggaacagagcaacaagttaggggaaagtactatgcactgatatatactagaaggcaacaatgaaaattagcacctgaagaagatccatgtaagaactaatgtgagatggtggtgccgggtgatttgattggagtccctgtacaacaatattgtcaaatcaattacagcaatgcaaaattatgtatggcaaatcagtcacacaaattacctgaaactcatttgcagcaaactctgcactgcctgcctcatatgctccaccatagcaatgatcaaaatttacctaataatgaagtgcatatattcagaaacgatagagagatgaaatatttcaagtacttaatactactgaatagaatatgctgtacacattttaataaatatattacctccatttgtctagagttctgaatattgataagctgtttatcttttgatataacatttttggtccttgtctttctccttcttcgactttgtacttcaattgtagattcttgttgcttcttcattctcaatctccttaccacttgatccaattttgattgttttctcagtgaaggaggacgacctcttctacgaactgatattgggcttagcaccatttttccttgtttcagcaccatatctttattcttcccattttgctgatattcctgaatttccttgctgccatggtgtgcatcaatctttatttgcaattcatttaggccatccatcactaaattgcacaatgcatctgaaactgaaccattctctgccacttcattaaaacgcttgcacaacgtatcaaaacgcctaacaattggcgtgtcaagctgatcatcataggagcatttaataaatgtgtgcttgcgcttgaaatcctttctccatcgttgtagtatatatttggaagggactttttctatatcaacaagagggagtattgaaaggatatgtctacacaagatccctcggaattcgaaatgccgacattcacaatg

SEQ ID NO: 25876 - DNA, 1995 bp, Oryza sativa
ggaatgatttacaatcagacttgttttctttctctactttgtctcttagtgcattgtcatattgctccacaaattgcttaagtgtggttctagcattaacataaccatcaaagaaggcattcacactctcactccttcgcgacgaagacattccagcccaaaatgtgtctttcacataagccggcacccataattccctgttatcatataacccagcaagccattcattatcctgtaagctaaattcatcaatcattttcatccatcccttatcaaaatcatctctgtttaatgaatcatacaccacattagacaatgtagagctaataacttcatattctaagtacccaccaagtttttcaggaatcttcttcatgatatgccacgaacaccatctgtgtcgagcttcaggaaatacttccataatagcattttgcattgctctgcactgatcggtaattatggcgtttggtgctttatttgacatacatgataaccatgatctgaataaccaaacaaaagtctcagtttcttcatttgatagcagagcacatcctaatagaactgattccccgtgatgatttacaccgacaaaaggagcaaatggcatatggtacttgttagtcaagtacgtagtgtcaaatgtcacaacatctgaaaaagattcataggtagccctacttcttgcatccacccataaaacattttttagtcgagagtcctcatccacgtccatgacatagaaaaagtttggatctttggacgtcatacgcaggaaatactgataaactgcatgtgcatctccagcaccaagcttaagctttcgtacatcttgcaaataatttctgcactccttttcaccaaattgaagattctcatagcctccagcttgcataactagagaactaaaattcttgtttatacgaattcttgcttggtcattcaactctagccttctcttagcttgcaaatcaagtttcttgtgacatctgagatgtcttgctttgctaggacttacaacatgattatggtcaagagtaagcgtactaatgcagaatttctcatcatgaagataaaagttaactttagctgggcactgctgccttgtggaggggttaggcttgaatttatttgttgatgtgtactgtgccttaccttgtctgctacaagcaagtgtgaaatatctcaccttgccatcctcagttttcttagatcctctttttatcacaccgaatcctaactttcgagcataacttaatgtaaaagcaagtggcactatcctcactatcaaatagcatacctttggttgctccaacagttaggttttatctgctaccagagcatttgaatcactctcaacctcctcaattgcaaagccatcttcatctgatatgatatgatcttcttgctcatcatcagaacatagattggtgtccattaccttaatttggcacggaaaattaaatcgattttaaaagcaaatcaaatatggtcatgtatgtgtttgcaagcatggaaaaacaagagatgttgaaaaacgaattgagaaaattaatagaattgctcatcgggcctagaaaaccagagcctaaaatgtcaggcaaaaataaatcaacaactttctcatacctttctgttagcttcaacgtggatactctgttgcggttgccgcaaaaaaattttccgattaatcttaactgattgttatggataggagacaaaggggattagaatgagggtttacggtgagaaagaaaatgcagaagatgaaaagtcacgactgtgtatagagtaatatcgagaagaggaatcgacgccggaatacggagcttcggctggagttgggcttttaaaaggcccaacaatcacagcccactaagtaaacagctcacgctcacagatgacgctgtcgactagtcgtacgatagtcgcacaaattcgtcgtgtgtatagcattttcgattttcaatagcacatatttgcacggattatatg

SEQ ID NO: 25877 - DNA, 662 bp, Oryza sativa
ttctattttataaacacatatgtaagcgaaaatcatatgcagtgctataatccttagtcccggttgttctcaacaaccgagagtaaagatcttttctttactcccggttgttctaaacaaccgggactaaagatatctttagtcccggttgttgagaacaaccgggagtaaagatccggggtatatatattctcggtgcgccctcgtcttcttcaccagcacttagacgttttcggccgatcgatctatctcggcctctctccttcgccgccacgagacgctcaatttcatcatcaatatcacagcccaatcacagaaattcaaagaagctcatatacatctcaagttgatgaaatacatcacagatgtttcaatgttacaaattacaagcactcatggttcaattgacaagttaaaccaaatacaattcacatgaaaaattgaaccattcattacattcctttcaaataccacaatccatcggcaatccagtcccgaaattggttcatgacacgcgagtccaattcatttgttgattcgctagatggagaagaggttccacccaatggatcataattttcatcatgggcacaattggcgaactctgtatcagacatttgactgtctctaatgaaattatgaagagctatgcatgcatggat

SEQ ID NO: 25878 - DNA, 2740 bp, Oryza sativa
tcctgcagcccccgcgccctcgccgccgtcctgcgttagcccccaccgcagctacgcgctagctagtcctctgcccgccgcttggttcgccggtgtcgtgcaagccgacgccgctcgcgcaagcctcacgaatcgcgcatcagcaatggcgggtggaaatcctcacgatttcttctcccagtcgttaaatgaagctccaacgggccacatggacggctccgactacggcttctcgcaggggtcttcaggatatggtggatatggcaccggcatccattttgggggagggggatcggggggcctcgatctgaactcccaggccgacgccttccccgatttcgcctcctaccaacagatccttgaaccgggtagccttgtgttacctccgattcgggcagggagcagatccacagtccccccgtcacgtcctcctccagcggcgggagggggacgtggcagcagtcgtggagggagaggaggaggacgaggccgtggcaggtcgttgaccaatggcgctggatctggcaggggaatgcgaggatttgttcctcctggctcatcgtctggtcaaggaggcgtccgaggtcatggggcatccatgtcgcacagcgggccacccgccttcaactttggagtcttcggaggaggacggcgagccggtgcctcgtcgtcccaagggacaaatgtgtccgaggacgacggcaacgaagaagacgaagaggactttggtcctgatggtcagcacatggtaaaccccccatggttactttctgttatgtctcttttgtgctattgcgaaatatgccaattgttgctcatgatattgatactgctatggatgccgtgatctaagcatttgtattacagtatatgttgttcattgtttaatttagggttaaatcatgtttgtctttcctagaatacgtatgacaaggcaaattgtgcagaagaaacaactcactcattgtgtgtaatagcatgtgagcaaataatggatgggcattgtcgtaatggagcatggacaactagagggtaccagaatttgtaggtcatatatttccaaagggctaacctaaggcattcaaccaaacagataaagtatagattcacccatctaaagaattattacagtgcttgggtgtggctgaaccaacaaactggagctggtagaagtgctagtggagaaataattgcatcaaatgcttggtgggaaaaaaaattaaggtatgcagttgtcaaaaatatagctagtttacatgattttagagttttctgtgatattgatttagtgtcaatacaggagaagggggacgccaagaaatttcgccatggcaaccctgagtacttagattttcttatagagatatttcaaggagttgcagttgatggttccacagcatacatccctggttttgaagatgaagatgaagaggaaggagaagaagaagcaggggatgcaggggaggcagctagaggggaaagagctgtaggggatggttatgagaacagccccatgagcaataacagcaggaagagagggagtagcagctgtgatgtgtccacagcttctagtcctgggaaaaaaagcaagagcccagtggtgcagctcatgaaggggctgctcaattctttcaactctgattgtgataagtcaaataccctaattactgaacttgttaacagcaagaagttaaaggagcagaagaaagaatcaattgctgagtcattgacaaactgtcagaggttggcagtagagtgtggtgcagcagaagacagtgtggaatacttttgtgccacacagttgtttgcttccaaacataacagagttatgtttaagaacattagcactaaagaagcaagatttatgtggctgaggagatggtgccagcagaagaatttgtattagatgatccctttctttagctgcatatcatgggtctggtctgcattagttgtgtcttagctgcattagttatgatctacttttgtgttgaactatcaacttgtttgatgtgatgtgacgtaatgaacatgtgatgtgtggacctatttaaaccttcccttcttttcttcttgaagtttgttcatattatatttatgatgtgctttctttctatgcatatgtcacacctgcaggatggtgaaggcagtggtgatgaagatatctctgatgaagatagcagtgatgatgagattgatcttatcatttatattttgaagaaaagagaaatggacaggagaagagcatgtatgcttgccgccatgattggtacgtattacttggaactttactctaataaggctccaagaagggtagcacctgagtctggacatgattgggttatgagaacattagctaatagaactgcttgttacaacatgtttaggatgcacaggccagtttttgagaggttacattctgtgcttgtggaatcatatgagttgaagtccacaaacaacatggattccatggagtgtttgggtctttttttatggatagtaggtgctccccaatcagttaggcaagcccaagacagatttgttaggtctcttaaaacagtacatagtaagttcaaagcagttttgaccgctctactgaaacttgcacaagatatcattaggccaaaagatcccttattcacaacattccataagaaattgctttctcctcagtacacaccatatttggataattgcattggagcaatagatggtactcacatccaagttgtggtgccaa

SEQ ID NO: 25879 - DNA, 625 bp, Oryza sativa
atgttaagatttcatttgcaaactctttgtcctttctgcaatggccataaatttgctttttcatgttcatagaaaaagaagtcatatctgtgttgattgatttataaaacataattcaaaacagcgtgatctacatgctaaatgtatagttacggccttcttccaaatacaagacattttgttgctcgagttggtaatttgcattctgttgttccctgccgagcaagctctcaatctcctctgcattgtcttcagcttcagcccatgggtgctgctggtatctccttaacatctccagcctctcagcaacctctttcatcgttggccgttcttctccattcatgcttatgcatcgcatcaggaggtatgtgatctcttctagcatttcagcgctcatctcattccttacttggctatctagtagctcttgatggcgaccaactttcattgctgtggtgaagcatgacaccaggctcctgttttcctctggcccgtccaagtacaatgctttcttccttgtcagaagctctagcatgacgacaccaaaactgtaaacatcgctcttatcagtcaactggcatgtcataaggtattcgaggtccaagtacccgcaagctccctgcac

SEQ ID NO: 25880 - DNA, 757 bp, Oryza sativa
acgagatcgagcgcatcaacaggctttctagtacaatcaagggacgaatggaccaaaagacttgagatggatttcctatttcttatttttactttttttatctgtcatttaaaacaacaaccggtaattactccctcggtccctcaacatttgacgttgttgactttttaaaatttgtttgaccattcatcttatttaaaaattttgtgaaatatataaaactatatgtatacataaaagtatatttaacaatgaatcaaatgatatgaaaagaattaataattacttaaattttttgaataagacgaacggtcaaacatatttaaaaaagttaacgacgtcaaatggaacggaacggagggagtacatttttccaattatatataagtgaaatattgacaactaatggtaccgaagtgcttgtttttgacaaataaattacaatatcaattcgggatgccaactccaaataccattaattatttcaattacactcctatttttagcaccgttgtcttttgatccacgtttgaactatatattcacataatacaaggtcatattacagtttattggatgatatttttgcatcactgcaaaagtactctcagccagaggaccctacagcttttatatgagcatgatatattgccatccttaactgacaatggcaagatggaaaatcctatgcatgttaaggcacaatttgacaaggcatttcctatataaaggtagccaagtttcactatgaacaaca

SEQ ID NO: 25881 - DNA, 615 bp, Oryza sativa
ctgcagccccactagccatcttgtcaatcactgagattagacctgagatggtatctttatctttatttccgagggcctcaattgccttctcaagtgcttcttttaggtatttcatttcctctttcttctgcgagtttttagcgaagatataaggcactaatgcgccaagtatagcccccgcagaccctgagaacaattgagactgactgataaaattcatgatagtatcaagagaaaaacaattggccctagcttcggtagcgtaaattttaacctcttgagttgaggtgcttcgcgagtacttttgggttaatgcgaaggttccagctgtagctaatatcttcgaaaatccctttagcgattcaccgagcgaagaaagttcaatctcatgcttttcagcatccaaaccgtcatatctaagtgaaaaattaacatcgtgtaagccagtgttttccatcaacagtccttatatgctttcaccaaaacgtctcatcaggccaccataagcacgatcgcaacaaccgagagcaaagtaaccacgcctactatcagatattctctcatcacccaaacgtctcttcaggccactaaaattatcggcgatatcgcaatacc

SEQ ID NO: 25882 - DNA, 17625 bp, Oryza sativa
  unsure (1)..(17625): unsure at all n locations
nnnnnnnnnnnnnnnnnnnnnnnnnnnnnnnnnnctcattctttccctgctgatcagccacactgatgtcgagcgctgcggggcagttgttccattgacaggttcaacataaaggcacctatttttcaaatctctttaggaacaccaatagtgcatgacaagaacattcttctcactcatttccccttttgatagaattacagatttctgctattattaggttcgaaagttataaaattaaattagttaaggtgaaagtttgaaagtttatttccaggtaaaagtttcagagttaaggtgaaagtttgaaatttttaggtttcacgtttccacagtgttgcagagattgtcctgattttcttacttcaaattttcattctagccttcaaagatgcttagaattcctgatattgagttaaaacctccaaattactcaaattgagttgaaagtttccaaatggatatagaaagctgctggtttctcgagttgaaagtttttcaaggtgaagtcgaaagctcatgttttcttgagctaaaaggttttggaatcaagctgaaagctcatgattttcttgagatgaaaaatttcaaatcgtaaggtcgtgatttcttgttttttttgtaagattatatcatagagctaaaaataaaaagcctgcaaacagcatatctctaaaaatgtttcttgtatacattattactttttcatttcttctggcagaagactttctcatcggttggcacaagacaacaaaagatccttgtttgcaggcaagggaaggttaggtgcagccacacagatgctattatattgaaaaagtggtgtcggctgcaacccttgttggaaaggaaacacaaagatccagcaccgcatgcatgcaaattaggtaacccctttatttattctacctggttcaaatgcatactagtatcagctatatcagcctatcacataagcttaggagctcactgcctaagtaaagaaataaggtggaataacctacttttgcaggcggcttcaagtgaatcaggagataaatttgcatcaagcattagtagaggtgcagtggagatatgaagacggaactgacatatccagctaggagagagaaatttttcctgcccaaaaagaaatggagataagtacagtgattacttgtcaacattagcgttgatacagatcgaacactacacaatgtgctgcaaaattcttacaactgccccaacacttgcaacgccagcaattaattcaccgctcccatcaaacacatttgatactattggggttgttacgtcatcaatctgcagtattcctatgtaattattagcaacagtgttagctaacagaaggaaaactatgtactccctccggtcataatatttgatatttaggaaaagatttggccaaacttctaaaattttgaccatcaatcttatattaaaatattataaattctaaaaagtttttgacattatgatagtaattttcaaggacaagctgtgcttaccattttccatttttgccatttgagaaattattgatggtcaaagtttcaaaagtttgactgaatcttaacctaaacataaaaatttatgaccaaagtgagtatatatttataagaaataagttcattttatctgaaccccttgaataccaaacagaactacaaaagcaatagtggggtggcagattcactgccaccaccactagaggcttttaaaggagtacatattttgtagagaacaaaaaaataccctttaaatatgttgctgttgtaatttcagcattggttgttgcatcaaaagtaggcccatatctatagatattcaaccagtaacgcaatgcaaataaaataaataatgagcctattatctcactacacatgaaaaactacagcctttcctaacaaacataacaaggattagactgtaatttcaaggatgtatacaacaatatgaatatcttcacacttaccatctgtacatagtccagccgacctccagtatttcaaaaggaaatcccctgcagtagaaaaaatggaaagtattgaagcaaataactacccagagagcagaaaaggacagagtaattcaaaatgagtaaaccaatttagaaaaaaactatatcttcacaaatagataaaagaaatacctgccatatcatttccaacaacactaatcatgaatggtcgagtctcaagcttacaaatgcactcggcaatatttcttgctactcccccactgacgtacttaacctaggaaattcaaatgcattattacttgattttttaatttttttaactttttgaatttttaattttaaaagtagaccctcccaaaacttttttccatctgaagcttttggccacgccagcccgcctggcatgacaaaacaacactaacacaccacccgtagcaggcgtgacagtattgttttgccacgccagcctggttggcatggccaaaaggttcagatcttgaaaataagttttggaagggtttatttttacaattaaaaattaaaaaggtttaaaaaaaacatcctacttcaacttctcataaatgattgaaatggaagaagttaaagctcacaagatttatggcctaaacctctgtatgaataagatgcatacagtaccaagcttatggatatcacaacccaaacatcatcctgcagaaccttcttcctcatataatgaattcaacactagtttacattgaatagtattattggtcatgctgatccattcaatcacacacatatgccatccttcttgcataccagcaaataagcagtttgctcaagctaagaagttaataaagagctggatgggtggtttaccatcccaggcacagtcgttccaggatgcggctgcatggatggcttggcatggatgtccagcaccatccccccaataatcactggagatgactccagcctgatggcacctaacggattctgtgcagaaaacaacataaaaattagaacacaagaaaactgaagcccaagaaacactagttagaaaggtactcgatgggactgcaggctatagagaggataagttgcagtagttcctcttaaggtagccgtacctggtaaaggataggcggtgatgctgggaggaggtggcggcagacagactccatcctccgcaggggagaggaggtggtggtggccccagccatggagaaggacaggttcagggggccaaagattgcaaagccacctatcaagatctgccagtttgggcagtggcacacgagtgaggcctacgagaaagaggatttcatttagtttatgccacagatgcagcatccatacccagaacatcagcaattgaaagatggaaataagctaaaaatctaagtgtttgtttcttctcaaccattgctagccttgccaattttttgctatagcaagatttggtaagccaaaaattttggtagagttggttgtttggattgctaccaaacttaaccaatccaaaataattggcattgccaaatttgtggctacaaaccaaataagggacataatttttggcaacgcaccaaacagcccctaaatgcttaacatcatcctgacatattcctgatacgagattaacaccacctccttatcacgcgtaatagttaatttcatgccactaaaacatgataccaactttcgcattcttcagttgcaataactgaataccaatgatagaaaaccatgtgatagtattattctagttttagctttgtcacatggagtatttttttctctatttctagtgaggcagtatagtacttagcagtagcagtagcaacattaccaatggattagcacaagagggcaggcaatgccctttttgctaagttcttgctattggtttgttctcagaatttagaggcagagcagctcatcgcagcgcaattgcctctctcaatgaagttaataatatttacaggcttgaacctatcgtcaatttacatgttatcagtgaagttattaagatgaaattggaagtctcataatgctcatacttgagacttattgagaaaagcatggcaagaataaagctggttgggctcaaagctgacatacaaacaagcaactacatatttactttgctaaagacagacagaatgcctatgttccccttcatatttgattgattcaagttaatctaaatcataaaaccaggccatctttgaactcattgatttcatatttcacatttcaatcaaataccaatcatccaggaaaagaaaaaacagagatcagagaaagaaaaatattgtaaaaagatgaaaaactacctgttcagttactagctgacttgcactagacttttgtttctggtcctggttggcgttgatccaatgcccatatgtgcctgagtgctgagtgctaactcactttcaatttatgatacttcaaaatggtgttcctagtatatcaacatttccaccaacagagtcatggtaggcattgcataatgccaaagacctaggaacgatgcacaaggcatggtggccagtggcagcggctgagtggcataatgctgaggagctgggacactcgctctttctagttattatgttgctctttgcatgatgcaaaagttcaataaccaggttgacatgttatagttaaaacccatatgacttgaacaatatgtcaagaacttttattgtgtgttgagcaggcgctcacgagtgcagattttacatcatcttctactaaagtgagcaacacaaaccaaacaaattgctctgcaagctcagttttgaagatgctgtctgactaaatcatgagacattataaatgttttaacaacaaaggacccaaaccatgggacttctatttagagtaatggagtgcactgagagttactagccagtgctaccatcagtgatgtaccctttttttttataacgggatttaccccaggttctattggaaacggaataaaggtttgatgaagtacagaaggctgggaattccagcttaacaagggagccagctactaccgagaacagcaaaacaacatatagccttcctatcttgtcaaagcatctacagacccaaaagaacataaatcacatattgtcccactcctgacgatgcttccagtctttaatcaacgatgggaggcacttggttcagttgttgtctgaggtaaagcgaggggagcacagccatagcttcaccatcgacagctaggaggtcatcactgtcactcgtgaagcacttggttccgaatttgacactgtcagaaagaagatgattcactccaaacaatctagtcttgatgactaggaaatgaaaagatgaattgagcatacatgtgttttgtggaggccctgatgtgcagcgcctgaacctgcacaagaaccttgtcgccgacatacaccggtgccgcaaacttgagcgactgcctcgcatacacggctccaggctgcattagcatcagcatcagatactagaagggccaggccagcacgtcatgccgatgcagtgctcgacgaaatgccggtgcaccatctggcaggcatgagagcgagcgagagagagagagacgagaggggcggcgtacgaagtgggcggcgatgagggcggggaagagtgaggcgacaagcatgccgtgcacgacgcggccgcggccgaaccctcccacctggcgggcgaaggcgtcgtcgaggtgcaccgggttgcggtcgccgctcaccgcggcgtacgcttccacctccccatccgtgaagcgccgccgctcgcgcagcgtgtcgccgaccttgaggacgagggaggacggcgccgccgcggtcgtcgccgtcgcattgcagcgcgcgagagggatgatggccgccagatttcgcgcgaacgctcgcatcgatccacccaccgattcctttcccttccttcccccactaaaaaatgttgtgctagccaagcccaggggcggatctaaaatggggggaatccgcaaacttttactatattttttaacaaacaaactgttgtttgcggcaaatttctagaacagaagctagggtttacgcaaattcgagaagaataagaagtaaagtgcgtggttctagagatgagaaagaggatgggctgggcgctcaccaggatgcctgcgcccttgcttgctcgcgggatggatggggatcggcggcggcggcggcggcggtggcggcggccgaactcgcgagtcgacgacgagcggacgccgcacgacgatttcctttttcgtcttcttttatttatttttttttcttctttcttgagaggatccactttcttctgggactgtagtacctacgtactccctccgaaaaaaaaaaaagacaaactctggtctaatgtttgaccgtccattttatttaaaaaaataaaaagaaaagtcacacataaaatgttaatcatgttttatcatctaacaacaatgaaaatataaattataaaaaaattttatataagacggacagtcaaagttgtacacggaaacccatggtttgtttttctttgggacggaaggagtaggcggcggcgtgagtgatgatgctccaagatgcaaaccaatttcacaatccacaacggctttttttagcccctttgaaattgaggattagcaaatgaattttagagaatttattttctataaagccctttgattcataagaagaggatagaaaatttttcataggattgcatttctaccgtcaatttcataggaaaataagcaagcggttagacctcttgtgaaacttttctttgttgagtgtctcttgtggtgtaatcaaagagtttttctctctgtttaccatattttcaatttctataatctactttaatttctacgtttttcccgttcctttttatagaggacctaaaagagagagttggtgaaggaattggttatgggagtttcatttttatcttttgttcggtaataaagatgagtatcatgtaaagaatgggtgggaattgaattttaagtcatgatataggactaagatttatctcaaaaggtaagcgtttgctcttaaacccctcttcccaatctatcctagaacttccatgccctccaaccaaacaatagatttaataactctcgttccccataacaattcccccaaccaaacgcgttgcaagtgctctagaccctgtttgattccgcttaagattattaggagtaagctgaaacaaataatagcttattatgatatattattacaatctacaagccagatttctataatctagtaatccactttaaaggtgctttttagattattgggtggctaacaactaacaaacatctaataatactgagaaacaagcagcttatagcttattctatgccggcttattataatccagtttatagtaatctaactcaatattttattttagattacaataatcttaagctgagctgaaacaaacagggcctaagttagtgggttgatgtgaagcaaactacaaagaacttccaacagttcttatgtaaagcgcgattttggtcggttaaagaatatgagaacattatatgtaagtccaatcgctttgactacaactgataagtcgtaatgccaactcaaaataatttgttatttatgagtaaaaattttatacgtgtgctatagagcttaaaaactggtgttgaaaaactatttatgacgaaataacaatcaaaattaactctaaaataagttttaaaatttaagctttggtcgtggctaaaaagcaaaggatggagctgccacaaaatcaagggaaaattgcagaaaacaaaaggacaacaaaaaaaacacacatcagaagtcacttgaaatttaacatttcaccgcataaatcattttgttgcaaatatcaacctccctatcagttttgttgtaaaaaaacactttaatgcactcatgcttaattgaatcgatcccttatagctgaatagcgaatctcaacgcgataacatttaagctctcatcaccatttctatttgtggaatctccgaaaaagtatccagattatactttaaaagtatttaatttggtaaacaccacattgatggcttataatttatgaaaacatgttgattcagttaaacacatacgcactaaggtggattttacaacggaactgagtagaggtgggcaattacaacaaaataacttatgggatggaatatcaactttaagtgacttatggatggtttttaaaaaattttcctccaaatcaatattgctaagccatccgcaacatacaataatataatatagtaaaggcaaactgattctacagcatcgtaattttgcgattttagttttgtaccacaaacaaaatccagtttactttactggcaccagaagttcccatcactcgatcggtgatctgtaccacctaacagtcaaacttagatgatctctcaaggtcagtgttcacaattccagtttcacgaaatccgtgtttggaaacgataggaaaataaacgataaaaaataatagatcaatcacagaagacactggattttggaaaactctcctaaaacagaagaaaaaactacggcgccagccagcaaaatatcttcactatatcgaggtgaggttagaacgtcgaacggcgtcttacaagagatatatatgaaggtgaaaccctaaaaggataatgatccggcccaagcctccgcttcattttggcataagctagcctttattatgtgcaaatgaatttaaatcacaactcaactatccggactttctagatcagtcaaaaatgtaaaatcaaaggtatttttaattgttattctgtgatgaacaattggcattggagattattggttttgttatttggaatttatttgcgaagtggttttggagatgattggatttcacatgtgagtactgctgtttgttggaccggtcagaccgggcatgtgctgccggtcagaccggtgcagcccgcggtctgaccggccgactctatgtcggtttcggtttcgggttatttgtttggatatccgtgattgtttcatgattatggcttctagatggatactatgcgtatgtaatactgtcgttagctactaatgagtcaagttggggatagtttggtctcggaatatggtttctttgtttgttctatgtgtaggtgactcgggatgccgggagagtatttgcggtgatggaccgggagtcagcttggggataagacgacgtccgtggtggtcagagatcatgcgggatactaagactagagttcaatacacgtggttggtgaagattccatatggtatacgatggaggtattgtgtgcgtatgggatgcggagtcgaatttggaaggagtccaaatttggtatgattggttatgtaaagtttatttcttctactagagggtttcctagggtgattaggatttctagtatgattttggttcgtggctttaggttgcttgcctcgggtataaatagagggggagcgtaaggcttcccagtatcgcttttgaaagcaattgagttgatagttgaataagggtttcgtgtttagtcgagatttttgtaaggagtgctgttggtgcactttgtaaacacagagagaatcaataaagtcgtcatccactttaagagttcttcgatctgtgtttcatcgggtttcggcggcataccggcggttagaccggcggcaagcaccggtcagacctgcgggcgcaaggcggtcagaccggcgacgtcgacaggcatggcaggcgatctcagggtggtcggaccgatcgatctacaccggtcagaccgacggcacaggcgcggtcagaccagcaggacaacttcggtcagactgatctccgtcgaatttgagggtaacttttatttccgttaaaagtttcggtttttgagcataccaaccattcacccctctctggttggcttagttcttgtagttcgatccaaaaaaacacaattcacttggtttttcggtcaaacaaaaagtattcaaactgaattttaaattttgacacaatttattcggattacatcagtttttcagcttttcgatggatttcacagtatcatcaattttcgatggatttcacagtatctgatgatactgctcatgagcggatttcgattcagggtcgcgattgtgaaccctgctggagggagtcttttacccctatgccattaagaaagttggaggttacgcgtgtgccacaaaaaagttttgagtctactgtatgccatgacacaaactttcgtttacccgtgtgccattccatctaccttctgttagcgaatgagctctgacatgtggaacccacgtatgaaaatgactaaattgcccctgaagcattttcatctctactaatcctctcccgtgcaatttctccagtgtgcctcggaccctagcctagccgccgccgcctcgcctcgcctatccggcgacgcgcctcgtctatccgccgccacctctctagccgccgccgccgccgcctcgcctcgtctatccgccgccgccgggcgtcgccgccgccgccgccgatttctcttctaaatgttccatccaaagtggctgaaatagagcaagggcaaaatagatctttcaaacctccgttagtctccgttagtgctgattccatccaaagtgacgcacgggtaaacgaaagtttatgtcatggcatacaggagactcaaaacttttttatggcatacacgtaaccttcaactttcttaatggcataggggtaaaagactctgctggaggcacgacttacacgcaaaatgcgcaattattctctgaaagaggatgaaccacgtgattaacacaaccagccactaataacaaaacacgccttcatcaattcgtaggccgtagccagctcgagcatgctggcaaattctcgcacggtctgacgaaatcacatgaaagatacgtcaaacgcccacagcaacaatccacgtctcatccacccatcaattccaccctcctcccaacggcagcaattcctcaaaaaactgagctgaaatggacatggccaagtaaacaacaacactggtcagagttaataacctataatcaattgtcgaagcagcaagaaagggatggaagagagagagagagagagagagagagaggagtccatgtccaacactccaattgtccatccagttaagaaaagcagcagcacaagctgcacgagtagagagcactatcttggctagagaacaaagccagattccttggagttgtcctgctttctgaccaagaacaggccaagacagaaaggaaacaagctcaaacagaaataggagagagagtttgagagagattggagggttcttgctagctttggggtgctttctttcctgcttttttgcttttcttggcgttttcgatggccgtgagctgaatccggagccttgcctgacacccccaattttagctgctgcttaggcagcctaatttggggattttgtctcaggcagtacaaatcccaaaaccaaattcagagactttgttggctaggctgggttaatctcctccccggtctggtcgattcgaagccatggagatatagcctgcaagcttcatggggctggagcgagctcgtatttcttgatgcaagtttcagcccctccaagaacaggttcaggttcttggccataatcttcttgcagtcaaaaagaaagtctcaatttcttgctcaaatgtttggattttttttattatcttttttttttggtgatcaaggtaggagagattatttgtgttccttccattgctggttggttgctgcagtctgcatgtggtggattcttgggaagaaggtggtggtgaggtgaggtgaagagggagatgcccaaggtggccggagatggcggcggcggtggccggaggagcgaggacttgcgcgttgttttcctcagggtcggcgccgccgtcgcgctctccgtcgccgggctgctcctctcgcggcggcggccacggcagcaactccggttacctcctcctcctcctcgctcaggtatcaacagcagaggcgtcttgttcaacgtttttttttcatttcgggaagaaattccagattttcagatggaaaacaaaatgaaatttcaacgaaaaattggaatatgaacaatattttggctcaatttcaaataaatttgattcgttttgggccggaggaacattcggacccaccggtcaatctgaatttttgggaatttcgttccggaattgtgaacccgttgtttgttgctgattgctactcctagttagaaaattttggtgatgaatcgtttcttgatgtttttttgcagattcggatggaatgaagggtggtggagggctcaaggatgagctgaggatcctcaagaatgtaagaatcttgtttgcacataattattataaattgtatatattaatgtacttttcatacttccatttatatttagaatggttcagttttggatgtatggtcttgaactgttcataatccagctatattttcctcattatattataaattctctaagtctgtccatatcacatgcatttggggtgtggactttgcttttgttttttaatttcaaccttttttcttctctatttttttagtctcatactgcttgtttctattccagcagtttgacaaaatacaacttgtcctcaaatgttaccattgtattccatttttcttctccttatgttgaccctcttttgttttgattgtgaaggaggataccaaggccaaaatcatcaatggaaactctgtccacactaccactaccactacaacgatgaccaccaccgcgttagtaccactgcccccaaaatgtagaactcttgatgatgatgaagaattcctcctcccagaattcaacgaaatagttctcaaagaattcggccgagacatgggcaacattgcaacctcacctgcaccaagggtaagcgaagaagatgcaacgaagaccccggaaatttttgagcttagagaaatggtcagatcacttcaagaaagggagaagaccctggagctacagcttctagagagctatggtttgcaggagcaagatgtcgcggtgcgggagctcgagaatcagctgaagatcaacaccgtcgaatcgaagctatacacgctgaagatcgaatccttgcagtctgaaaatgagaggctgcaggctcagttaactgaaagctcaaagctggcttcagagcttgaggcagctagaatgaaatgcaagctgttgaagaagaagctgagacaggatgcagaacaagcaaaggagagaattgcctcacttcaggaaatggccgattcttggcagtgtaaggagattattactgaggggaaattcagtgctgaggttgaggaaaaattgagtaagctagaggagttggaaaatgaggcaagagagcttagggttgtcaattcaaggctgcagcaggagaatgcacatcttgccaggcgattggagctcacacgcctgccccctgtacccaagcccatcaataacatggaggtgaatatttactgttcttgaactgtattgtagctggcacttactaatcaatcttaatcttcagatagaggttgttactcgtcagaaggaaacgctgttcttgatatttggtttgaaagagcaatcaattgtttctcataagcgctactgatttttcaaactcatttttcagtgtttacttcagcttgtgttgctctgtcaggaactgaacaagtaaaattggttgcaggtaaaagcattgcaggaagctgatcatttgaggcaagaaaatgacaagctggcaaaagaggttgaacagctcaagactgacaggttttcagatgttgaggaattggtatatctgaaatggatcaacgcttgcctgcgttacgagctcaggaaccaggatgctccatcagggaaaaatgttgcaagggatcttagcaagacactaagcccccaatctgaagagaaggccaagcaactgataatggagtacgcaaatgctggtccggatgagaaaaactttgatcatatagagttctgttcagagtactcttcctcaagagcatcatcattaggcgaacccgacgacgcgtcgatcgatgtctcactgatgaacaagcacaagaaccctaagaagaaaaagttcttttcgaagcttcggaaattggtactgggaaaagaaaaggagaacaaaaccattcctactctggagaggaggatatcgatttcgagctgttcatttgacgagttcaatggaagagagtcaattgatagctattcttcattcatgacagaacctggtaattctggcaatcaacagcatgataatcacggctcccgttggcattctatggacagccaaagtgctcgacatctcagcaaggaaatcgcagatgcaagaaacctccatcttggggtcaagagtgtgtcttttggggaggggagagtgagtaattttgggcatagttctcaccttggcaatggtgaagccacggttcctgaagatgccaagaagattcacaaatttgcagaggcactgaagacatctagaccaggttctaggtcatcaaggaaggaccactgataaacaaatagcataggaacaatctgctgcagagtgcagtaggcccatcttcctggatgtatatatttctccagttcttgatgggagattacttatagaagatgctactggaataaagcacacatgctttattctgtgtaaaatgtacaatacagtatatagtagtgtagtgtactaacctttaatcccagcccttaaactattcatttggggttggcttgtacttattcagtgtattgttcatgtattgctctatgcatacttcactccagctacaaacatacagctctttgacaagttatttatgtgtgcaaagttatgtattttacaatctttatagcctagattagttaagaccatttgtatatttgagtatccaccttactagtatgtcctgctcttcccctgtacagtgatagctttccagggggagggagaggagctagcgatggaggccctcgtggtttgcctaaaatttggattttaaaagttaattttgaaaaaaaaatcatctaagtttattttcaacatctattatatactaaaagtccattaaacatcctacaaacgctttcaagccgtcacaaaaaaattcctacaaacactcctaagctgccatatggcactctaataaattagatttttttttctttaaatatggtggacctattattttttaccataaaaaataaaaaaattgaaaggcccacgttcctctccttccgacctgtacgtgtagtacgcacgccatgctaccgtacgtacgtacgtagatgtattggcccctccttcctttctgttcctctctctctcttatttttgatgacccttctgttcctatctctcctattttgatgatgtggtagagtgaaaacatattatatgactatacgatctaaaatcatatattttttatgcactgcacgtacgtttgttgcataattcaagacccaaattaactatatttaacaagtcaaagaaatatgttactttggactagctattggacactcgagacacattttttagggaaatcatatagagtttaaaacacttgattaatagcacgtagcttatattagaacaacatgaaacacagagaattaattaataagatttaaataataagtagtagaagaaatatatcattttggttcacgaagattatatttatgtttaaatatagataactcaaaacggtaaatccattaattggacctatctcaatctatccgtagccttatatcccatataatttatctgttaataaacaatgatagtctatatcaatcttactgcttgaagataaaagattattggatttatttctaaaaaatgacacataaggtgtaacactatcactatttatcacatgtctatataagtttttatagtgttacatttgtacaaaataaaatagaaaatagaaaaatctccataaaatacaaattgaaccaatctatctattatatactaaaagcccattaaacatactacaaacattctcaagccaccacgtgacattctacaaacgctctaaactcgccatgtgtcatgtcctaaaaatcagaaataatcttataaattctgaacaaaatgaaagctatcatcatcagttttaagttccattatttataaaagttagaaaaataaatcgcatgcacctcctctcctactcatatgcacataccactacctgtcccctccctatttttagctattaaacaataaatatataatcaataatttatataatagaaaaaccataatatttaagatgcacgtctgattttttctctatttataattaaaccaagaatttaagatccatatgcttatattttcttatatacaaagtatgccattcgcccatattcaacccacatgccttgtacatcatacaaataaaattgaaataccttaaacaaattggttgcatatattacgtcattatacaccagtctgcaaacaagctaaattaaatcaatagtataactataaaactatttttttagggtgaacacccctgcccttttacatgtcattggaattgccgtaaaagaattatgaaataatccaacaccacatgttgcatcatcatatgttgtttttgcaaacttgcatagctaaattagatagacactatataagtaaatagaactaactaaaatatgaatagtccaagctaccaatgcatagcaaatccaatgcccatagttagagaaaacaaactccaattatttcgtgaattttttaaatgtgctgaaataatgcgagcaagctaaatgatctttcgtgtatttgctttaaactatgttaccatcaaattaacattagatggttcttaatgcaaatttggtatattcatagatatatatacatatatatatatatatgcatatatatgcatatatatatatatacatatatacatatatatatatatacatatatacatatatatatatatacatatacatatacatatatacatatatatatacatatacatatatacatatatacatatatatatacatatacatatatacatatatacatatacacatatacatatacatatatacatatatacatatacatatatacatatatacatatatacatatacatatatacatatatacatatacacatatatacatatatatatatatacatatatatatatacacatatatacatatatatatatacatatatatacatatatatatatatatatatacatatatgtatacatatatgtatatatgtatatgtacatgtatgtatgcatatatgtatgtacatatgtacatgtatgtatgcatatatgtatgtacatatgtacatgtatgtatgcatatatgtatgtatatgtacatgtatgtatgcatatatgtatatatatgtatgtatgtatgtatgtatatgtatatgtatgtatgtatgtatgtatgtatgtatatgtatatgtatgtatgtatgtatgtatgtatgtatatgtatatgcatgtctgtatgtatgtatgtatacgcatgtat

SEQ ID NO: 25883 - DNA, 15699 bp, Oryza sativa
  unsure (1)..(15699): unsure at all n locations
ctttctacaccttcccggtaactctatttattttctttgtgcatagaccagtcaaaaggtgaatcaactatatgagcattaatcgtctatgaatatacacttgaagcattaactttggagtccatttagattttaggctataccaaaaacatggaaagtggactaactaagcttgacaaaaatgagatcaccactacgatgaatcacgatgaatcacaaggaaaccttcataggtgcaacgaccacatctcagttgtaggacacaatgactaggagctgtgagaaaaccgtatggtaggggaaaaggaacaatgagtttagctaggtcttacattttcaccaaccccccaaaactaatgaaaataaaaaccaccttgattttaatatgcacttaatttgttaaacatgttctaaacaaactaagtctactattttttatataatgataaagattatagatatttggttatactgatgaattaaatattatatagtatataacttagagaaattatcaaagtgatgttgatgaagaatatttgtcgaggaaacgtacttccgaaagatggcagaggctatctgattaatatgatccgttctcaacgcagcccacgatacatgcccacgcgaatccgcgggctacctttctagttggctttaaaatcgctacccacaaattatcattgttttgctaatacaccatacggcttattagtccttgattcaaccgtgcagggtcggcaccacttaagtctagggcagctgccatctgataactgttgttgaccaccttccttagctcaattagatgatctgaaagatagttcaaaccgaaattgaccacatcaaggtttaatagtttctccctccttaacaataataactcatatgtctgctcaagttgattccaccaaagcataagctcagatttacatggcaattgatgaagttctatctaaatcccatccatcaactcatatgtctgctcaagttgattccaccaaagcataagctcagatttacatggcaattgatgaagttctatctaaatcccatccatcaatgattgaattcctaaaaaaacctgagcatcttttgtccatgagaaaacaccattgactaaccttatcatccatcagtcctaatatcatgcatgtattgcacccattatatattgagatctcaagtattgccgtgggccaaaaatccccaatttgtaactgaaaaatatagcattaataaatcctcctcggtatcatgctcatcaattaaaattattccactaactctagcaaatagatagcaatgtgaaaaccaaatcacactgaattccttttctccactacacgatgccttgctgcacttgcgataacccatggtttcatgattttgttggaatgagcacaacaaagagcagttaagtgaatctatactgttggatgctccagcaacttagcaaaaggcagtgtagcagagcacctttttacaccaaaatgtacgctgtacgcaatctgaacaattcagcaactgaccataatacaatttcttggttgggttttataacttatgctttgagcggaactcatagtaggaattgcaactcggaaccccaagcttttggagctttgggctcatgaggtggtctaaatatgagatttttagggctcaacttttgtgtagtgcagatgtgcatctggcttatccaaaaaacttcatgttctttttccttaagttctctgagtattgatttgaggagacattttttggtggctagattgatgaaattttaactgctgtctcaaaaaagataccgcattgccaaaatgtatatggaggatcagaattattcagaaccacctctgcattgcgaaaatagctgagacatgttttccattaatatgcaatgtttgcttaaggtacatataagtagtactagaaacttgcacggcaacatcgagtatgtattgttactatttttcctttttcaagaatatatgttttgtgcattgtttgtctcatcttgtcaagttaccactatggatgttgtcctgttgattgaaaaaaatgagaatgaaccctagtatttcttaatataaaaatctagtgcattggttgcaaactctgtaatccaaatgatggtttcattaacagaatcagggtaaaaccttattcttcaaatcaaaatgcatcaaaatgaaaagcaaaatgtcttgtttcatgaggttcagttgttgtaataggttgcagccttgcagcaggttggcatcacactggaccctggtttcagtccagtggaagacaagtgatgttgcctctaggttcggagagataacagtaacagaagttgagtaaaagtgacaactgacaactgctctatttatccccctctattttttatatgctgtagaggtgtgaacttatcaaatgttaggactgtgggaaaatgtttggtttgttacttcaccaaatttttgaacagatggcgggtttgtttcgtacgttaccaaattttggtaaggtagggatactcgaacatatttggttcgttatcttaccaaaatttgtgatggcttgaaatggtagcaaacaaaacatgcttcagggtttagggttcttaaagccattgcgtagcagggtttacacttccagtttgggccaaaattgtagtatatttcgggcgagatagttgcttacccttgtgggcggggggagcagctcacaacaaacttgcagacgaaacaacaaaaaatgacagaattttaacatacaattaccaccaagctgaccagttgaactggtttgttgtccagctttaaaggaatatgttttgcagatcatcaaaacaatttcttgtgtcaaaactcaagcgcataacagagtcaacagacaaaacaacaaaaaaggggcagatttctgacccgatctgatggactggtttattagttgattcttaagaactgcttcccagatcatcacaacaaattcgaagcatgtcaaaaggtgcttgaattcagggacacagctagaaaagaaaaaaaaaagagatactgcatcttccctggtttctagcaagaacatgaaagtttggtgattgtatctgtacttatgttctgcttcagctggtaatgcataaaaaatgactctaagcagcaccattcatatatattacaaggaaagaaatcataggcatctacattatgtagaatgagaccatgtaatgtactgtaattaatttcaagaaacagtgtttggtacagactagacaaaaggtaagctcaaggtaaaccataattcaaggggggaaattcagacaacctattccaggatgtcatcgtcgatgtcgatcggggtgacctcgccgtcgtcgaactggtccttcctcggaggcgcaggcggcgcgaacagccgtgcagggccagttcccttcttcttgttgcgcggcctcgcctgagatgagcaaacagcagtcagcagatggcaagtctgaagaattgcagcaaacagcagcacaggaagcaataagcatatgatttttttattaattttatttttgtgctagagactcacatttccgtacgagtggttgaacctttttcccctcttggtcttcttgtcccctctcccgcagtaaactggtcacaccaaatggagtaatttgagttggaatcgtaattggttcaaactgcgaggtttttgtttcaatctatgttttggtgctgtatcaattgaattcgtgcaatacgatttgaaaagcagtttcatataagatcatcgagccaatttcacaccagactaatccgaattgacgaacaaaacagagacagggaggttaggtaggcatgtcagttaccttcaagaactggagtgagcggggccgagagggtggcggcggcggcggcggcgacgcgagagcgggagcgggagaatgcggcggcggcggggagcgcgcagtaggaggagacggcggcgtggtggtgggaggaggggaaggtggccggggacgcggccatggcgtggacggcgaggagcgccatggaagcgagagaggagtgagagcttgaggaatggatggaatcggataagctgtgcgtgcatcggagtagataaaacggagggaaagggaagcccaggcccatggattgggctttgtctcttgggcctatggaccaagcccatgattggcttggccctctgcaattctgatgtttctctttcttttttttttgtcctctcatttctttttctatagataatcatttttttatgattaaattattactactagtataaaacttatgaagaatatagcaaagttatgatatttttaggacttctgaagacaaatctagccataacgtttttaagattttagaaatcgaaacgttcaaaatgatattgatggttaaagctcaaacactgttatgaatattagtggaagagatgaaaaaccagtgtttttaagtgtctttggttctgggaatgtgactatagcgtttgttgagtatacaaagtacaaacaaatagttttccatgatggcacctgggcaattaattaacccaaaaaactagtttacatattactagtttcaaacattaaaagctcatattagtaccatgacactttctgctacaattactgactaataacacaagttcatggcactttgtagacaggcaaggagagtgtgcataagcagggctttacataacttcatacagtatatatggattatggagctacagatgcaatccaaacacaacaaaaaggcaccattaagcattatgagtatctgattggcacaaaaacttttcagcgacagaattttcaagagactgatagctgctatgtatatgttctttattttccttggaactcatactgttcttcttacttccttgagctcactgcataatcacggggaccaacttgcctcagtaactgcatcagcagaaggaacaggagataaccaagttgtttagccatgtagcaatgctgaaaataaggtaaacagaaagagagagagacaaggatgtagtacaacatacctgaaaatatgattccagcttctgcttcagagtggcatgctccctcttcatcttctgaagagacctgcggcatctgaaagagaacatggcctcatcacatcatgtgaggaaattgcatgatgattggatagtatgtgaagaacaagttggacgagtcaatgaaatgcatacccttccagattcctgtcattgcagtttactttgaacacagagcactcattcttcatcctcagtgcaccaatgctgcgccaaacacaggccaactttagcgaattttgaacacataaagcaggcaaagatgacaagctttcggtgagaacattcatattaacaaataatatttgttcatttcacatcaataagcattcttaagtttgaatgtttttatattggttatttaagacctaagacatgattttacactgatgagacctgtaaaagaatattgttcactctgtgttctgggcatatgccccagttttatacctggatccgctgcctttgagttgttgcacaagagaatctaatctgtagaaatcctgagggtatttatcactgcatcaaaagaaatggaagtaaatgtaattgtcatgtctttcaaatcatgggtaatcattgtacaaaaaatcaattatctattcatatcgtggatgcagacatattacttacattgcttgttctatatttgtcaacagtcttgatgaatctttgaagaacagagccgcaacttcctcaacaaaattggggcttgattcatcctgcagttcttccagctgattaaactgttcatcaaggtaaccctgcaggaaaaccacgaggtagattataggcaaaagaaagaagcatgaaatacacaaccaaaaaaaaaacttttgtgcagtccatataatacaaataagtgtactaatttacaagggtaaatctatataattagtcaaagattaaaaaaaaagtcaggttccagcaagtgacttactcccttcgtcccataaaaaacgaatctagaaccggatgtgatattttctagtactatgaatctggacgtatatatgtctagattcgtagtactaggatgtgtcgcatccggtactaggttggttttttatgggatggagggagtaggcttcaccctagttaagtataaaggaaatctagtatttgcctaggagatactaatgtatcatcaaattgatgctactctatgattactctctaaaggttgaaagacctgactttttgtatattctcaatggaatagtacaaaggaaattaagaaagtggtttgctattgtctatggcatattacatccttgacgatctgcttaaactcattatcataatgcatgcatatgtgatgtaaaagaaagttgtataacttttagataagataagatgggtgccaactgctaagtgagcattattgcatcatcccagactagtagactacactacaaaactgagttatgctgttgcaaatgaaattcacaattgaaacagagtgcatgaatgatataagctccacatgaccacatatctgaccattgattgataatgcttttctccaggggttcagtgtgccctcaggggatgtccaagggtgcaatcaaactttgttatatacttacatgtaagacaaaaactgaagaaactaactctctctcctagttaactatctcatctaatattgcagctcaggaactgagaagcaataaaacatcaactagtgtctagtgcaatacactaattaattacgatctcatttctcaaaggaacaaaagtgaaggcatgaaacctgatcgaaaagatttttcttcataaagatgatttggcgacgcaaatttgaatactccatatatggctaagctttagagatcagttcaagcaggtggagagagctgagacacaatgagccatgcacaagagggggggtgtatatatagaggaaaaaaggatttttcttataacatgcaaaacctttattctacattgataatgccctcctgtgaataaagcataacaaaaggacagagtacttttctttcatgaaactgttgaacaataactcgagtaccaatgctacaagttgctgagctctgtatttcatttggtttctgtggtttatatcctagacagcaagagatatttaagaatatttgtgacactgcacagcagaggtttgtagaacagtagcacctagaacaaggtttgttcccgaagaagcaactgtatagatgtaataaataaatattttaacagtattatattgctaatatatattttatgaaattacattatttatagacaaagaagttatttctacaattcaaatactccagagtgtgtgcaagtaactgtaacagagttgggaaacagcctatctgaatgtcacacaacgcaagccgacaaagttcgttagtgactgatgaccacttaatgttttaaggaggacagattcactaaatctagcaaatttaaactttacaagatatcttatactaaacatgagtttcgggagagattttcatgcctccctagaatgacatcaaccgttgaaattctgcattgagtatttaacagaaagtaattatcctatttcctgaattatatagataatcagagtacaaaccattggcaaccttccaccaaactctgcctccgtacaactcagttgatttcattgaacaaaattgaggttgcatgctatgcagatgacaaaattggcatatttcaattaggatttatacaatcaaccatgaaaaaaaatcaaagatgataggactaacatcctgtaaaataaataatgaaaattaccatggacatgaaatatgaacaagcacccaaaaattgttcgcccaacaatgatatttgtttttcataggataacactgcgccaggacagagtaatcccaaatacaaatgaaccttttttttcttccttacaatgggtaccccggaattccatttctcaggggaacaaaaaattatacaatcagccagtacttgtccactcagggtcaccaactatcacaactaacatagttgaacttccttgcagtataataattttccattttcaacgagtttacagctatgtcattccggtgttatgcttggacttgcactggttgaacagaaacggatacttgacaaaacaaaaacaagggtgtagcagcccttggccacaaccttgtgcacaaaacacataacagaatcagataacgactggagaatcatttattttctatgtatttgagaatgaaagtgagttggctagtgatttcgtaagtcactttcattctcctttttttttgaatgtatgaattagcactctgctggttcgttcaaagaaaagagagaggtaatgaaagtgacttacaaagtcactagccaataagccaactgttaaaaagccacttcacaaaaatataggaacaacaggaagttacgaactcagaacaatggtaagtaaattaaataaaagtacatctaccaacaacaatgtatgtattttcaataatcaaattcatatgtgtaatatctattattagcaacaccactgttcaatcagttagagctgtgcccttcctctagctaaatcagaccaataaatttctcaaagacaatcagatggataaaaacatctaggggtatctaacatgcaagaccacaaggcctggaccgctcaggcagatctatcatctgatgaaccaaaggagctctactatctgctccttttcgccacatctcacatatcctgaaagattgtcagaaaaaaagctaacagcaaagattggaaataagacataaccatcaaatggccgaaggaggcatcctactaaaaagaaagaagagaaacagtggcatccctatgctttcacactgaaaccaaatgaaaactggatgataaaaaggaagatgcatggtgggcaggaaattctacctttattccacttcatgcagaaaaggatggataaatctttctagtagctacttcccgtggtttttcagttatagttgtatattttattagctggtcccatccactactttcagtagatgctgaaaagaggaataaaatgtataattggagcaaagataatgacttattggtatctcagctggatagtgataagagaatcctaacctggaacagtatattaaaatgacatactggaagcttgcatatggctaaatggctaggtggtgaagctgtgcacctaggccaccaaggttcaaatcctaaatttgacgttggtacccactaatgtcagaagtacacacgcacttgtgcttttagtgagcatgcgtgggcctgcgctctaggtggcgtgtgaagcgtgtgcagaggaaatgcacacgtctggtggtgttagtgtggcgtgtgtgggtgtgtgcatccaattgtactttctcaaaaaaaaatgatagatacttgtttaaatggttagtgtcagtaaagttcttatcttggcgaatcatgacaacaagatgcaaaacaaataatagccacagagcacaaatctgataacaaagtgaggtggcaaaatcatcacctcactattctcatagttgcaagaatggttgcactgtttcagcttttttgcatgttccttcttatgcatattcctaaatgcatattgctagtaacataaataatgaaacaaataaggagaaacaacagctatcagaaactacagactaagcaaagtgtttccatggaaagtaagaatttgtgtgggatgatatttcatgtttatatttacaggactggatcctgcaccatacaattcagttaagaagaacaacataaaaaaaagtgaccaaagagcatttataaagatgggattttttgcagcacatctgcttatggcagtggagcaagctaagagagacagattcttccttgaaaattttggagattttggatctcgcaaatccattactcagtgatttagagccactagaccattattagaatgaatttggatgaaggaatttcaacaggaaagtagtacttactccatatacattcaacagggcaaccaacttacacactgatcagaatacaaatatactacacattgggatttcttaccactattttccatcgttacgtagtgaagtacatgtgtgcttcacattactaagattttacagcaagtaaacatgcaacatgaactcttgctagtttgtaattatattgtaattactgtatttgaaacacatgaaagagataatatcaaatcacttcacgctaatatcaattatgcactatgctcattgtaacactttgtaatgatctcggttatagtcatattataggtcatatttgttaggaaaatagaagggaaactgtatgtcatgcatcgtgccctagttttagccatattcatataatcatatcaacaccttaggaaattatctatgggaaaaaaatttgccctagatcaaaatcgcttatatcacctaatagaccaaccaattatgtccatatccttctatgcatcatttgatgttttgaggaaatgaagaactatacatctgcaagtgtttttacacagtaaaattaggtttaatttggcattgcgatagtatttaatctgcaattttactagttataaaaatgttaaataattaataaccacttatctggagccaccaaaaaaaatactactagaactggtaaagattctcttagataattatattccagagcacagcaacactaaaattggcactttgtgagctcattttacttgtacctttgtagttagcaaaagataggataacaacacataatttccaaatatcaaaggtaattttggaatttatttgccatagtctaaaatcatttattttgctacataggagatatgaaataatataggaagatcaaggtccaatgcatattctacagaaacgcatattcctagactgttgacaggtaaaataataaaatatattgtagttgacagttcgcgtacatgcctttttggacaaagaacataaacaaggcacatgatcatctttagtgtttagagcaagaggatgcccagaagctgatgacaaaatgctggagcacaccaatctatataattatatacatccataaagtttgagctggaaatatggctattgcatgcttgtctatattgaattacttgcagtactgctgctattcctcaagacaaacctcatcattgcaaggttggttcatacaacatgctaattgttttaccaataacctgaagaaagtggagagagagagagagagagagagagagagagagagcagatgtgtcaatttcaagccagcactgttttatgaatagactattggagaccagagagcactgtttcaccaagatacctactgtgaagaccgctgccatcaaatcattgggatttaagctacaaggctgaggctgtttccttcctgtttacagcatttgaaggatagaatgttagcactgtcgagcagtggtgctcttgaagaatatatgtgtatttatccctaatgtcgaacatatgttactaaggcttcctgaaatcggattcctcatgctgcactatatgtaaagttgatgcctctttagtgaagttagatcctggtattctcaaataagtaatcttaggggttgatttgaagttgtgcatgcactaggagaactgttcaaacataggctgcttcttgataactagcagcaggtatccaccttacatgctatagaaacaagctgcagaacaccactaatgcagagcagttgaagtaggaataccacaatatttttgaactttgaagccacgttaaacaaaattaactgactcttctgtcttactttgtcttaatgtttctctgactgatatattcttctgagcatggataaccacaagaaatgcatatgggtccttggctccataaagtcatgacatatgcacctgttcacatttcaagagtctgggttttggatccccaaattctgaattttcaattcctttggtgatataaatctacaaagtagaccaaaatcgttgctactgtgcttgggtgacattagaaaaactagcacagtccactaatttgataagcaaatagtactatgttgaattgcttacagtttaacagagacttaaatatagtcactatacgatgcctacatgaaccttgttttcctttccaacagcatagaaaattagcagtaacaattggtacgtgacattggtaagatcatccttgtagataaatagaatcaatccagacagtctaatattgctatagcaaagtgccttttattgatgtactaaatgtcttccatcctaagtcaaaaaagcatgtttccacgtcagggtgggtgctgtgttcttcactcctgttttcatgtgcgtatagcatgagatactagtttatgagcacaaacaggtctcctttttgcaatgtttatccatttctgttgttgtgttgtttcaccatggtcctccattcaggaaatcaaatgtgtagctataacatatttcttctctaccctattccctactttagtgttgtgaaaaagggttttgaagttgtagtatgccatacgatatggttatctatgggccaatggtagaacatgtgcaatatgtcatatcttatgttatctctgaaaaggtagagacctcacctagtgaattattaaaggagacaagatgcacacaagatcttaattacaatgatcaattgcagcctttatcttttatgaatttaatcaattcaactcgttgctgcagattcacacacccgataatcagcaattaagcacttcacttagttagtctaagtgcccaacaactttcaattcttcaataaaatgaatagtgcgatggtcgaaattcagtttgctgacctgcgtggaaaatgcttcaaatccatttgccgcagaggttaatcatgaatatcatacggttcccagagtagtgataacgcagcagtttccagagtgcttgtgaacttgttaagtgcccctcccatttctcggtatctccagttgctgcctttgcaggtggacgcaaatcctttcacctgggaagaaaaatgacagccattcagccaatgatgcccttgtactaaccatggacagcatcacgcacaaatgacataagaagaatcaactcatccttctccacgaaaacaaaaatggaaaccaattgtgcttttatagtaaccatacaaacttgacacaaaaatgacataagaagaatcaactcatccttcacgaaaacaaaaaaggcaaccagttatgctattgcactaaccatagacagcttcacacagaaaaatgcaacccatgctgcttttatactaacgaacagattactccagatagcttctttcagaaatgggcataggcagaatcagctcaactacagtctcaggtccaaacaaaactagaatatttacaaatttgaagcaaagacacaccatctgtaatcaagaacacggtactactatatttctctgcatagtaagatcaagtaaccttcaagaacattctttgaaaagaaaaaaaaaagttactaccttcaagaacatcataccattctagattttgcttactggctgacagggataacacaatagcattaacactaatcttactaattttcctgaagcggcattccaaatttcattaacaacaaaatgaaaacaggccacatatatgacataaacgagacgcgatttatcatggcaagaaggcatccatccaatcaacagtaaaggacctaacacggggaatggggatcattcagcggccgaaccccacaaaataatttattctattttattttattttgcggggagaaagaacacgagctgctattctatatttctattcgattcgaaacgtgagggattcaggcgggcaaaagggaagggaaaggaaggaggtcgtccggccgcgtggcaccctccagaacctgctcacctgccgccgttcgcgcgaggagggtaaggccaggccgccgcggccgcacaggggagaaggctagggcgcggggaggccgtccacgcgctcgtcggcggaacgcgcgaggtgggcggcgcctcgcattctcgccaccacgccgtcgcacagcttgtggaagagagaaagagaggaatttgaagagagaaagagaggaatttatatttctgagcaattttgcgctgagcttagtttctaaaagagcaggggtgctttactaaattttcttcgaaaattcttgcaaacaagattttaaccgtttggtttaaaaaaacgtaagacgtaggatcattttaaccataattttttttgtaaaattaataaatatatagatgtatttactagtaggttgttaccgaacattggtaatgcccacacctcttcctttagctatatccattaaaaaacaaattgaagtatctataatatctactaccccgtttcaggttataagactttctagcatttctcatattaatatagatgttaatgaatctagtcacacatatatgtctagattcattaacatatatataaatgttggtaatgttagaaagtcttataatattaaacggaggaagtacaaatcacccctacagtatgtttagataatagaaaaatgagagataggattggaattgaaaaatgaatgagatgagacttggggtcgtattccacccactcggcctatcttgtcctcttctgaggaaggattccatcccggcatctacctatctggcgttctttcgcccctcctcgatatcgctactttctatggttggttgctcatcgccactgctggatggctgaccgcttggagaaacgtggcttgccgcatcctacctgttgtgtcttctgtgaccaacaggatgagccaattgatcacattctaattaggtgccccaagtccctacagctgtggtggaccgtcctctcgagcctcgggctcccacattgcttcctctctagcgatgtttccttccacgagtggcactgctcccgccgactcaaagttccgagggagcatcgttgtggattcgacacggtcgtgacccttggggcgtggtccatttggaaggaacggaacaaccgcgtgttcaacaactgttcttggccctggtccaaggtggtagtaggcatggcgcaagaggctgccctttggcatctcgcccatcccctgtcgccaacgctaccttcttagcgtgctaggtcgtttggtcgtcccattgtaatcgcgagaataggcttaagtcctctttttcctccttttcctccttttcttcccaaatccctcttcatttctttgttttgccgtttgcgtaaattttatttctcttaaagtcttaacacaaaggtgcacaatccttttgcgtattcctgaaaagaaaaatcaaggattaatattaaatagaagagagagagcgaatggttagaattttaaaggtgtctttgaatatgtggaaaataatttctgtggctcattaaccaaacaaggccttttaagtagccacatctctcgccatctatctcctgttggttatctggaccaggtgagcgatcgacaagcacatacagacaaagacgctacatgtgcatgnnnnnnnnnnnnnnnnnnnnnnnnnnnnnnnnnnnnnnnnnnnnnnnnnnnnnn

SEQ ID NO: 25884 - DNA, 1235 bp, Oryza sativa
caggcggaccacataagggtcacctgcgaaaatccggttaagtggtccgcctgcgaaaataaagcggacaatgaacttcaccccgatttatatttttgtaggcggttatttggttccaaaggtcatgtccgcctgcgaaaaaagacctcgcgtcgggaaaaatgccttttctagtaatgtttatacttatgaagagagatagtatttcattaacttttaatttatagcctatgtagctaataaattgttaatattagcgtgatcttttattaaccgagcaatagaacatagaaagaaagaaacgttgtagtcataacttgggaaacaacttcagtgacatggccacttgatgagttttgagagcggttttcactgacgtggctcattgacttagtcaaccatgtaaggacgtggtagtccaatcacaaaataaaagtgaatccatatgtaagtgactagaaaaaaataaaaaagataaatgaggcccacttgttatactcattatctctctttttcctccttcctccctctccctatccctctctcccttcactattcccctgtcggaagtggcgagggagggagtggtggcaggggctcagggcgatggtagtagtaaccggcaccagagaggggctgtgtgatggcttgccgttggtgccagagagggggctgggggaatgtcgtgccactggtgttggagagggggttcggggactatgggaatggcgtgccaccaatgtcaaggagggggctgggggactagcggctcttcgcctgcctccatagcttcaccaagttcgactccaccctcgcctcctaccttgatggcttctccaagctcgagctcccattgctgagtgcggcgccaccactccccttttcacttagtcctccctgttgctgtcccatcccgcctcctcgctgcccacccctccttcacctccccgcagggatcttgtccttcatatctctcccaggtttcgccaaccgccgccgccgccaacgaggttgttgccgcctccagttcctcttccaccggacaccaaacccctccccctcctccgtcgccggtgatgccaagctaagtggcaaggccgctggttctagactttgagtggttccaagcatgaagaagttaggggaaaggaagagggctgataagtgggctccatattttttatattttttcctagtcacttatatatgggccattttctattttgtgattagat

SEQ ID NO: 25885 - DNA, 14169 bp, Oryza sativa
aaaaccgccgagggagacaaattacaccggttttaagagttagggggttcacggattagatttcgatcacttttgagagtcacaaagtgaacttattccactaagtaagcatctctgcttttattgggtaaaaatgacacgacgcattgcatcagaaactgatcatgaacaaccatcataagaaactcaaatttgactcctattacaccgaatcaactcaatgtggaaaactcaaaagtaagtgctattacaccctaccaaacttcaaatcggtcaaaagaatcgacgacgacaagcaccatcaggtgctctagtatgtatgcagtacacgtatacgtatatgtatgggtacacaaaaaaaattaaaaatgaaaacccctctaatggcagctaacgctcgcgccaagatttgaataaaaattttattgcttaattcgatcgatcgtcttcctcctcggtgggctcgtgctcgatcagcggtagcagcggtaggccggggtgtacatgcagctctcggcgtacttgacgaggtcgtcggggcgcgggaggcggctggcgaggccgagctcgtacgccttggcggcgaccttggcggcgatgtgtgcggagatcttgcggatgttggtgaagggcgggaagatgagccccctggcgaagttgtcctcgctcacctgctccgccagcgcctccgacgccgccagcagcatgtcgtcgtggacgcggatggcgcccgagatcaccacgcccagcccgaaccccgggaagatgtaggcgttgttcgattgccccggcacgtacgtcttcccctcgtactccaccgcgtcgaacgggctcccgctcgcgaacaccgcacttccctgcacaaacatttcgattcagatcgccattgacgatttcgattcagctctattgatctctcaccttggtccaggtgtatgcctcctccccggtgcattccgagtgcgacgtcgggttggagagcgcgaagatgacaggtttctgcatttgatttcatgttagtgcacttgatcatcatcatcaagaagaggagcgcacatatgcagccaccatgatgtgtgcattggttacctcgttgaaggcggccatggcctcgacgacctcctgggtgaatgtcttgccgacgccggaagtgccgatgagcacggtcggcttgatggactgcacggcctccagcagcgtcttcaccggctcgtgctcgtgcgcgaatggctgcttgaagtgctgcagcgactccttcctcgactccacgatcagccccctcgagtccaccagccacaccttcttccggcaatcattgatcggaatctccgtctacacgaataacacacaatcaaatcacactccatattgttgtttatcatattcagtgaaagtgagtgaggcaatattcagagtttgcagtgtgttttcattcagttacctgctttgacatctcgagggcaatgagctctgcgatgccagttccagcctcaccggcgccaaggaacaggtaagtgtgatctgcaagagttccaccgaccaccttgagcgccgcaatcagacctgcgaggaccactgatgctgttccctgccatccatcgttgtagaccaaattcatcacattagtatttttgtggctactgattcagacaaattatatgggcgtgaaaccagaagaggttcacaaaagtttcgctttcttgtacctgaatgtcgtcgttgaagacaaggtggctcttgctgtactttgcaagcaagtcaaaagcattgtggttggcaaagtcttcaaactgtggaaaggaaatttgatgttattcagtcatctcctgaatcctgataaaggtaaaaacagagtgtgcacatgtaacttaattaattcttctatgcagactgacctgaacgagcactttctcgccgtagttttgcttaactgcggtcataaactcctcaagaagctcgtggtattcctgataaccatgataacagagataagataaaaaagaaattctatggtaaaaagagttttctgtttcaccaattaattgcaggtgaactacgtgtgcagaaactgtggcttacctctccggtagcacggcgttgcttgagtccaatgtagaattcgtcgttgagcagtgactcattgttggtaccaacatcaattgtgattggaaggcactgcatcatacatatattcacatttatagtcagcaaagcaaatccatcaacagactaaaaatactttgatcatttcatgaagacaagaacactcacagctgatgggcgaactcctccaagggcagtgtacagagacagtttgccgacaggaatacccattccctgacatagtaacagcagcacatatcagcaaatgcttccaggtaaacatacatcatcacatctaaattctttcgacacattcatgacagcaaaatcagggcaggaaatgggggaaaaatgcactacctgacaaccaagatctccaaggccaagaatgcgctcgccgtcggtgacgacgatcacctggatgctcctctccggccagttcttgagcacctcaaggatcttccccctgaatccaccaaacaaacaaacacagattcctgtcaggctgcaaattcctaatcaacctcaccatcatcagaaggaaagcagaatcctagcaacaaaaaccgcacttgtccttgaggctgatgtacaggccctgtggccgcctgtagatgctgccgtacttctggcaggcctccccgaccgtcggcgtgtacaccaccggcagcagctcctccacgttgtcgatcaggagcttgtagaacagcctctcattcctctcctgaaaaagaaaagcacaaaaaaaccaagaaacatgacagtgttcagtaatccacagttctagtgaaagggcatgtaggtgttgagttcaaatctccataggaacaaatttcatgttgggttatctaagggctaagttctctgtttggtaagctaagtttctaatttaaaaaggctgcatgtatccgattgaatgtagagctcgagtaaaaatacccttctcaaaaaaaaaaaaagaagtaatccacagttcttgctgcatgaacattatcaatgcatttgatttgagtgggtgatcaaacttttggtggtggtggtggtggtgtttgtgattgtacctggaggtccatcatggcgatgtagcgctggagggggacggtgtagttgcggaggttgtgcatgagcttcttctcctggagctcctgcgagacgatggatggcgggaggaggccgcggaggtagtgcgcgtcgcgctccgcctccgagaaggccaaacccttgttgtgccgcgggtctctcagcagcgtgtacccgctgcatcacatcacatcacagcgcaagaaattcgaattcaaattcaaattttttgttatggccaccgaacgatcggttgcgattcggaaagactcaattctcaaattaatgtagattttcatggatttgatgcaatgaacgacacgaatcagtttttttttaggccggacaagcttgtaactgaagcgagtcaggaaaccggcggagtaaaacaaacggaaactttatggtgggtgtagagaaagttgggaacaaaaacggaaggaaataaaaagcagaggcttgagatagaacaagggattgatggatgccgaattcgaagaagaagacgaactcgaaggagatgatgtctctaacctggcgacggagaaggaccatggggtgatgagctgatcctcggtggccctgtcctcgccgtacgtgtcctccacgccgccgccggccatctcttccgatcctcttctcttctcttctcctcaaaattcaaaaaccaaacgatcgaacgaaacgatcgatcctcttctcctcagaaataaaaaggaaacgatcgatctgctcttgtcctgttataggaagaaatatttgcgtggatgggatgccgcgaggaggagaggagacggggtatttatagagagaaggtgggggcccgcgtgtgaaagggaggaaacgtcgggtcggaggagtcgcgcgggtggtggcatttaattcgtaggacgggtggttttcccatggagcgaaaggggggaaggtggtgggaaacgggaggggattgaatagtggaaaagcggaggtaggtgacggaagacgagtcgtcgtcgtgacggccgtcgccggcgagcggcgaaccggcggcgggggtatgtgcgtctgttgtttttgcgatgggcgggcaagtgcacgggtgggtaccggtggatggtgcaatggtgggggtgattggttttgcacctggttttcgggcttacccgtttgcctgtggctccgtacctggaacggtgcgaccccaccatttcccttttctattttttattgcttattataaaagtgaaataaaattgtatgtgtagtagcagcattggtagaaaaacaataaaaagagtgtagctggtttaggttttcatttagtggaagtgtggaactaacccatccgattataaggctgtgtttgaaagataggggattgagaaaagtgggaagatacgtaaaacgaggtgagccattagcacatgattaattgagtattaactattttaaactttaaaaatgaattaatatgattttttaaagcaacttttatatagaaaatttttgcaaaaaacgcaccgttaagtagtttaggaagcgtgcgcgcgaaaaacgaaacaaacaaactccctttgttctccaaacgaacgcagcctaagttagatttgatggcgtatttttcttatggatgtagtacttatcaatgttgataacccgtgataatttcgtcaattttaaaatatgcttatctaatcatatctactcataaaaattaaatgtgtgtttatagagataattatacacgtgttgtggacatctatcctttatatagtgtttctatccatcataaacaattaaagatataagtatatttgaaactttaaataaactgcaccgggtccttcgcagctggcttttacgtgcctgcattttgagtactacggcctgtttagattacaccataaattttttcatcatcgaacatttgaacacctgtataaagcattaaatatatgcttaaaaaataactagttgcacagattgcgactaatttgcgagacgaatcttttaatcctaattgctccataatttgacaatatggtgctacagtaaacatttactaatgatggattaattatgcttaataaatttgtttcacggcttactgacggatgctgtaattagtttttttactaatacccgaacaccctatgctacaccttatataatatccgatgtgacacgctaaaactttactccctgcatctaaacaacccctttatcgcacgtaggtttggttcaggtggtgtttggatccagagacttaactttagtccctacatttagacactaatttagagtattaaatatagactacttacaaaattaattatataaatgaaaactaattcgtgagacaaattttttaagcctaattaatccataattagagaatgtttaccgtagcatcacataggctaatcatggattaattaggctcaatagattcatctcgcaaattagtacaagattatggatgggttttattaatagtctacgtttaatatttataattagtatccaaacattcgatgtgataggggcttaaaagtgttagtccgtctaaagtcggtctgttttcgcgggagcacatgggccgaccagccacgtcagcataccctgcctgcatacgaggaatgtcgtcaaaggatcggcgatgtacggacagttcatcatgaaaaaaaaaaaacgaaattcaaaggaagaggaagagaagtccctccaaacaagttttaaaaataaattataagcacgggatctcgaaattaaaacaaacataccacttgtcaatgtatctcgaccgtataacatgccattgattcttcgtccattcgcgggacgccggctaagcctgtttatttctctatttttttttaaaaaacatcacatcgaatctttgaatacacaaatggagcattaaatatatattaaaaaaactaattgcataattagagggaaaatcgtgaaacaaatcttttgagcttaattagtccataattagccataagtactacagtaatccacatgtgctaatgacggattaattaggctcaaaagattcgtctcgcggttttcagacgagttatgaaattagtttttttattcgtatctaaaaattccatccaacgtccgattaaatatatgatgtgacactcaaaaaatttcttttcacgaactaaccatgccctagctcaccgtcctggcaaccagtcaagtttcagagtttttactattttagggcatattcaggtttcacactagaattcaacttcaacgttgacttttcaatggtccacagggtacctggcagctactattagccccaggcatggtcaaactacaaacccaattcgatcagacttgtttactcgtatcttttctccaaaagtgcaaggctttgagaccaaaatgcctttgttcgttcgccgcatctccggagtcgttgcttacttttaattgtctgttatacatggtggtcactgaaaacgtgtatagtacaccaaccaacagattattacggactcttggtcagtgtatactagggttgaaaacggtatggaaactttctggattccggatctattttcgaaaacagaatttatcggtcgaaattttttcggaaatttttggaaacggaaacagattcggaaatattttctcggaaacacaatcgaaaatgataatggcagtttccgtcggaactcggaatcggtcggaaactttacggaaattttctcggaatttctagaaatcacaaaataccttgaattctttttttaaagcactgaatagttaataccatggtgtttggctgttatttttttaaaaaatatttattttgcaaatttaaaattacataagaatatttttttctgtattgggatttatcaatatcattactaatttattccatagattgtgttttatgatgtattattgatacttaacaattgaacttatatgattgtgttttatgataaattgttgaccattgagacttgagaattgggtttatcagtttaaggggtttttttttattccgataaattttcgttaccgtattcgtgccggttcgttttcgctccgttttcgggttcgataatattcgattccgttttcgtatccggggtttccgattccgatttccattccgaaaaaaatatgaaaacgaaaacgataaaaataatttccgtccgtttccgtaccgttttcactcctagtgtatacaaggactgaacactgcaaacgtggaaggaagaaccgaagaagtggtagccagcatatctatggctgagttggattgttggaggtggagactaatccctcgtgcatgtaaaactaaacggttcattagttcatattaattatttcttaaaaaagattaatataatgttttaaacaattattctataaaaagaatttgcaaaaaatatactgttagcagtttgggaaatgtgggcatgaaaaagtataatacggggttgggaacccatctccccgcacggaaaacagagcagtccattagcacgtgattaattaattattaccttttttttttcaaaaaatggatcaatttgattttttaaacaactttcgtatataaatattttacaaaaaatacaccgtttagtagtttgaaaaacgtgcgcgcagaatacgagaacccctcatccgcacacaggggtacaactagcagtatagtaatgctcaatctgaaaacagatgtttattggatggattgtggcattatagaggtaaattaaatattttaataaataaagttaacatatcacttaaaacaaaaaaaaagtagtctaaataatgtagttgacaaatgtttttttataaaatgtattttttcaaacataaagtaagagtaatctgttttaataaccatggtaaacattatttacctaagcacaatatagactctaattcaagaatacataatgtaggaaaagtcaatttatgatttagttacgtatgaactcattcttactacgagttgtgtaaacggtcacgacaaaattcaatatgccctactacgtcaacttcacaaacctgtaatgctataaaatcaatctacatgtcccacaatgttgtttctttgttatagatcgaattttcactttaaattggtggatgcatggctactccctccgcttcatatttattagaaggaaaaagtacgaattaccccccgaactatcgcggtcgtccgaattacccctgaacggtcatgataatggctatgtctcggtcatgatgatggcttggtcaggatggcgacaaggactggttcattttctctctttttcattttatttttctccaggagagccaacccgtggaccatttgtgctgaaataacatgtggatcacctgttgatagttgcattggagccacatcgaggatcccagattaatcttccattctctctcttaagcaatatgcatgcttagttcattgtgatgtctaattttatggatatctgaaatcccaatttgcatgtccattgtccaagatacatgaacaaagctagagtttttcatgaatgatttatgcaacatatatcatgtaggtaggttgtgtttagtttttcttttcttggctcatatggttatgtctaggtaaccttattgattctctggttggtaatttatataagatcattttacctgtgtacaaatgagtgtgctttcagtactaatatgaattgttgccatgggttcatattgagcctattgcgccacccaatttggtaagaagacagaaggtggaggtcaacagggctgagcgtcccttgctttaggtcttgctgtccatttaagcgagttgcagcccatcatacttttcttttgcatgtgttatatatgctaaattgctaatttctacgttgtattatttattcttaattgcagatgtctccactactcaggatgcatatggctacggtatgaaattcccagttccttcgttgtctacagtatgaagttcaagctgattaatgcatatgcttgtgtttctccaaatagtgtcgtttagtgtcatatattatttctccctctgttgttttagtttgacatgaaatgcatttgtgatatatttcttcttattctttgtatatgtaatagtatgcagacaaattgagcaggtcttcttttcatgctcttctgaagaggttaagtgtttcgatgtgatctctgcaaattattgattctatgatgaggttacgtaaatatgaagtataatactatctagattccaattacactgtggagtatagtaaatgttctgattgcttttgtaggccatagtatatatattatattacatgctttttgccccttatttggttcccttccttcccggaaggctcctgtgagttgcttctttctagagttcaattaccatgttggcgctttatcttcaacaccatggacgaatttactatgccatgtcctaagaaggttatgcatgacaagaaggtatcttcaagtttatgaagataacacttttaaggtaatgccaattgttaaacatagacaacgtaagtaatctattttgtttccatttacttcaggtgccactcacaaattgttcaattataatgggggaattaggttttcttattgttattgggatcaatcagatatgtgttttctatagtttgctcatggctgtgtacactagcaaatttagattgtaaaattaatggacccatatttccagctacacttctagcctacatccttttagtattatgtgtcactccaggtttggtaagtgttcaaacctacctataatatcaatgtgaataaaaaatggaatatttcaacaggaagcatgcacttgctgaccatgggtccaaatccaacatttcatccttgaactgttcatttgaaagttaatgcaactttctattctggattagccttttgcctgaaccaatggttttaaacaatctggtgggattcagttggtctatgagttacttctatagtattgttgaggctaaaaattgactctgagttctggtgagttccaggttaatctatgttgtaaagattcaaagttggcatcccatatcacgtatcactgagatattatatttagtttggcgaaactatttcaatgattattatatgttgtcacatattgattgcacttttgtgcaaatggctgaaatgattctatattttttaatttcttcgtgattcatgctatatcattgcttcagaatttatgttgcacttcttgcaagatatctgaagtttatctcaaagttgataagttttgtactaattccaatattatgtttgtttctcttagggctagagaatatatatgcattttgtacttcaaagaaacctgggtagagtggcccatttatctgttgtctttccaaattgccattgtgtcaagaaagagaaacggacagtggtttggacatctctatatggtttagatatctcagcaatgttgtatcaaagtattgtgtttcttatatcttgggttatttgtttacttacatgttgtaaatgttaccttacggtaccaatagtttcgatagaatctctgtatcttatttcgttatcttttaatgtccacatgcagcgtagcgcgtgcctattgctagtttatttaatcgtaggcaaacgtgggtgggtgcatgcaactccgtcataaaaaaataacataaaatccaatttccgctggtggtgtgggtgttagggcaagtgatatggtagatgtgactaccccatctaaatttatccacatcattcactcataaattaagaggtaacctatacaatatgtcacctctagtaaacaaatatcaatgtctcttatactctcacacccctcttgaagtatggagtattatagcacttgcccttagagcaagtttaatagatcctaattaagccgggcttggacactattcgttaagccaattttaacttggggagtgagaaaggaagaaaaaaggatgggcgggcctttcatctattggcccgcttaagcgccacacaccagaaaaagctgttttctttccaccagaagcgagaagatgaggtgtacatgtgaatattaaatatctaaatcttcaatagagataaacaaacacctaacctaacagctattctattatattagtgatggctataggtgacatgatattagagtcggcagcgggggatattattatacgttggggtggggttcctcctcgagcgccgcgtcgggttagcacctgacctgacctgactccggtagcgggggccaccacaccacaccacacccacccccacgtctttgaccgcgacgctgactggctcggcccagtcgcgcgcatgccgcaccctcactgcgcgtgggccaggttggtcggtgggtggcccacgttgcagtgaaggtaagagactctagttggtgggtgggtgggtgggtgggtgggtcggttcggtgcgggagatagtttaagccggtcaggtcatgacctgccccgggtcgcacctgggcggtcaaagcgcacgcgtttttctatttcttggacatgcggcgtgcgggtgccactgctcccttttccatagacacaagtcagacgatacgatagctgttcatcgccatcaaaattaattaagtgctgtgagcaagttttatgctgtgttttacactaattttttaacgtacagtcccttgcttattttatgtgcatgttttctgtactactaattaaatggtatttgttttttaaataaattataaaaaaattacttggaaaattatattaatttaaatttttaaatatttctaagctaatatttaataaatcatacggtaatccactgttccgtttcaggtgtaaggagaaaagttttcgaacacatcctaactgtaattaacacagccttaacctttgttaaatcaaaagttactacttctatttttcggttacttaattatattgattaattaacaatgcataacaaacaactccaacgatagttgttactgctagtgttgtgccaccaaaattttcacaaaatattatcgtatacaataagggctcttcatattatgagcaatgtttttctgatgggatagtgcttacattgcacccaattgttggtatctagattccagaacctgatagttcgaactgatagcaaacatttgttgatgcgtggaagcaaagggacaatcaacaccagaagtttgctgctagtcgatctcacattcccgtcgggagtgttctattcggttcggttgaatggtatatatggaatactaagagcaagttcaatagtatagcccactactagctccaattcatctatagccaattcatacaatagttacttactatactattaatatatggtctcacatgtcatacacacattgcgtcttggagtccgtactgtaactagctacagatctgtagcccgctgctcttctctctcatcttttatctcattaaaatatgtttatagttggctaatagtctgctattgtacctgctctactagatgattagaatacaaataaaagctaaaaatagatttaaaatactttacgaagcttagcataaataaatgggggatttagggacttgtcgattgcccaagatttattgtaagacgtattggtttattaacgacttaaaaagtaatttatgtgtaaaatttatccgtacttctttaaaaagcattactgccatcctaacatggtttttacaaaataacccttaatatttttctgatataatggaataaaatctatgacatattataatgctagctcaattctacccagcattccagcaaacaaaaattccaaacttaaattttttgtgtagtttaaccattgccaaacagtaccactcacatagtagttgttagggttgtattttgggtggtcccagtggcagtttctttattgacctaacggcagtcggtcacgcttaccgacggtcggtccggtgttaactttttcttgggtctgtggtttggtgttgtcggtgtgtgtgggtggtgcttattccttttgttttcctagttacgatgttccattgttgtaatcttataattttttctgctcattcaatataaacttcacactgtctggtgcgagtcggtaaaaaaaaatagtagttgtagggtgattaattaaagctcctaatctcttggagagaaatggtacatgtccctttcaagtatctgaattgctggtgacggcagagtgacaggtgcatcagtgcatcagtgatgttaactcgaggctgctaatactatcaatgcaaacctaaataattagggaccagtaattagttaagttaggtttacgctacctactactccagtagcttctgaaacgtacaccagcaagcaatgaattgaatgcatgcgtagccatccgatcgatgtatcatgtatccgacgcttcacggccacacaagagcgtgtgtggttcctgatgctgccggtacgcttggactatgtttttttttttagaaaaacatccctatgaacgcagagattgacgaagtcaccacaggcgtctcgctgtcgacgggtacgtcgcctaccactgaaagaataattagccgtaaatacgagcacccgtgtgggctggttccactacaaggaacctaaccagttgagctatactcactttgcacgtttgggctatgttaactcctgcaattaaattcattcaatccgacgtgagaacgacgcgcagctgctcgatcgattggcctaatccgatgtcgtggacaatatgctatccaaactaaaaagacgtgaatattagggaagatctaatattaaataattaaaaaaagatgaggctttaaactttagagcgtatagcccaccaccttgtgacgatctcaccaccttataaagctagccaaaagacccataggcgtttctcatgttatcccaaatctagtgatcaccggttaattatcggcttctctctaattataactg

SEQ ID NO: 25886 - DNA, 1568 bp, Oryza sativa
  unsure (1)..(1568): unsure at all n locations
aaaatctagtgatcaccggttaattatcggcttctctctaattataactgcgaaggattaagaatatgtgggacgatttgagaagaaaaaaaatccttaagcgcgataattaattagagaacctagctagcccaagctttaagcgcccgatatataaaatttttttatatatggagcgcccgattaaccggtgatttttaaagatcgcaccgttgaagagcctgggaattaagcgcgcatatttattcaattattttagaaaagaacataccctggtattccctctgttttttttatgacgttggttagttcaaccacatatatttagggaagttggtagcatacgtttagttgatctgcgtgtagtataatactgttgggttaaagcaagtttaatataatatagaaaagaactattagctattaacatatatagtattagattaatatgtataacagattagcttcaagactgtctttaattttttttactcctctctcttttaatctcacctatacatttaatgtattttatcgagtatgtgaagaactagctctcacatgaaaggcggcacttattttttttaattctctcatatttatatatactccctccgtctctaaatatttgatgttgttgacttttctaaatatgtttaacagttcgtcttattaaaaaaaacttttgtgaaatatataaaactatatgtatacataaaaatatatttaacaatgaatcaaatgataggaaaagaattaataattacttaattttttaaaataagacgaacagtaaaacatgtttagaagggccaactacgtcaaatattatttaggaacggagtgattaggcctggtttagttcccaactttttcttcaaatttttaacttttccatcatattaaaactttcatacacacataaacttctaacttttccatcacatcattccaatttcaaccaaacttataattttaacgtgaactaaatacacccttagtttattttattgctcatagcaactttacgtgcatctggaccaaccgatcatgcgacgggattctatctatgtaaatggacatatcacatgtctttggttgtacttgcgttgctttagtattaaatcgatcgatctgtgtaccgccggcggtgagcggcctcgttccggtggacgccgacaacttttccggtgagcgcacgcaaaaaaggcacggctttttccggcgggcggcactgctggttgttggtgtacgctcgatatatactttggatccaacagttttcagctgccgattgtatactactagaaagaagcagcagggtacgtacactgccggtgctgatgctgaggtatctatgtgcgctgccgggttgtgtgtgtctgttatgtttaggtggacaagaaggaattagtgcggtattttgaaagaattttacgggaatttgaactgattttaagaaaatcatgtgaagttccgtagtacgatcggaaggagattagaacaaggaacaannnnnnnnnnnnnnnnnnnnnnnnnnnnnnnnnnnnnnnnnnnnnnnnnnnnnn

SEQ ID NO: 25887 - DNA, 13168 bp, Oryza sativa
  unsure (1)..(13168): unsure at all n locations
nnnnnnnnnnnnnnnnnnnnnnnnnnnnnnnnnnnnnnnnnnnnnnnnnnnnnnatatagaaaagagaagaaagaaaggctgacatgtgggtcccatatttttttaaaaaaaatgctgactaggataccacgtcagcgaaactatgtatctatactgttgtagtgctgtggaatctaaattgcactgttttgtatagtttaggggtgaagatttttagaattgggatttagggatgtcaaacaaactcgtcgtcaagttgagggacggcgggtgtgaacttattcctttccttgcttgcatctcatgggccgaaacctacaaagtccaaattatgaccctccttttctctatctatctctctctctctctctccttttccacggttcccgctgcatggaatcaattggtgacccaatattacaattttacaagttattttgagaaaataagatggtgaaaaatgaagttatttttgggattttttttctaaaaaaaatacgtacatgaaatgtctcattctattcatgcatggagccaggttgtgtcagaatcagggttcaaagtttcagactgaaactgagatttctctaagttttgagtctacatgaacatccccttctcccagatacgaaatgaatttggccatttttttaattcttttttcatttttatgagtttggtaaaattgttccaattttttgaaaattcaaaaatatttcgaaaccaaaattaccaaaatcttagcactatcggtacaatcttctaccctataattcaccaacaacagtcctacattctacatacttcacacttcattgatcggtcaggattgtttcactcaaatccaacgtcccatatcactcccacttctcctctcgcactatctccacaagatggtgtgaacttgtacttggatatgtttttgttgctgttcatgtgcaggcgttgcttgaggccacggagagtattgaccgtgatgaatctcatgcgcagtttcaatgcgcagtttcaagatgcaaaatttgatcaaattccaaagagaagtaaaaggtgactctaatactgattgtaggatcatatttagaagggtaagtgacctatttatataagtgggggctatcattttttggatgcttttgggatgagaaagttatccaatcgatcttgagtagccactggacgtggctgtgatactaattgtataatcgtaaatgacatttcatcctaaaagttatccaacgagataaggaccccacttatatattaggtcccttgtcttttcacaatcaatatgggactatttgatataattatcttcatttcaatgtccattattttaactttgtttcgatgtgttggtgtccataccttggagcaacacaagagtggaagaggcatcacttgcatgtttggccacgatagttcattcacattcacatttctcttgctcatactctattctatccatcacactctattctgtccatttattagtgttgatgatgttgatggatcttaatttgatcaggttaccgaggtgagcagatagaactaccctcctcttaaggccattcccaactcatgacactggatatagtttccataaactccacatcaccaagaaactagtactaaacaccactcttctaatgcaaacaccactattccatacttaaatttaatgctacttatctcacatgatgtcttggatattgtgtagaaaccatgtcttatgtaagacatggtttctttctctttccttatttattcacttgccacatcacttttcatcctatgtggcagcttatttaatgcaatgggcaccatcctagtcattgggttgggaatggcctaattattatgcactttgtgttgtttaatatttaacacggttaacttttagacgtaagtttgactattgatattattaaaaaaaaatcatataattataatatattttgttatgaattgttttatcatcataagtatatttgcataaatttttgaataaaacaaatgatctaaaaatcaatggtgttgatcattagaaagggggcaaagtattttcctttcaataatttattacagtcccttttatcgatctgttggatctgttgttttctaacatttcactctttttctttgtgtgttagtacatattgcatcaccctaactatttttgagcgttacactagtttagagtgatgtttcacgctgctagtgatgtttcacgctgctaaaaatgttacaccaaacatttaataaaacatttcattgttatattgtttaaagtaatgtttcactttttctccactaacatcaggtatataatgaaatattttgaccatgtaaaaaatatttgaccatccaataaaatgactgaggctagatgtccaatccatatctttgtcatgtactattttctgtgttttttcgattacatggcagacatattcttttcaagtgttgcacatagtttacagtgatgtttcacgctactagaaatgttgcaacaaacattcagtgaaatatttgatgccattgacttttttaaatatatttgactgttcgtcttatttaaaaaatttaagtaattattatttttcctatcatttgattcattgttaaatatacttttacgtatacatagttttacatatttcacacaagtttttaaataaaacgaacggtcaaacatgtttaaaacaattcaacggtgtcaaatatttagagacgaagggagtatattgtttaaattaatgtttcactacatcatgcatccaatgaaatattttgaccatataataaaatatttgaccgtccaataaaatgacttagattagatgcccaatccatatctatccactctactattttctctcttttttttgtcattacaagacagacacgcatacgtacacaactgtatacgcaacatcatactccaccctcataaacgtgcccctaaatcatgttgtaagagacagaaaccaacggcacataactaatctcactaaatatcttttgaaagctcacatgcatgtgtataatatttgtgaatgctagaattttgaaccctggtgggtggagtcatacatccacgacttcaccaccacaccggtggtgttttccgcctactattttcctatttggctagcatgcattaataaattgtttttgccaaaactgtaatgaactttattgtttgctactgaataatgtcatttcacagcggacaatcaatcagagatgtcgaaagaagcaaagtagtaggaaccaaaacaccaactataaataactagatgtctttctagcttggagcggccacaaccatggaatgtgaagactttcgttgcctttttcgtacttgtgtaagtgtggctctaattttactggttaactagtacttcttccgtttcatattataagtcatttaatttttttcctaattactcaaatgacttataatataaaatggagggagtattatattagtcaagtttgcctagaaaataagacaaattaagtttgacgaccttggcacaccaaccaaacggatattgaattccagcattttaaccaatttattgtaaagtatttggattgttgcaacatgtgaaggcaaatccgaagggaatactagttctgaaggcaacacttccattaattttctatgtacaatgtacacattacaggggaggggaacatacatgcatggtgcctagtaatagaagtggcctgctccaatcatttccacggtaagtctatctttgttttgaacaacgatatgtgccgttgaaacgttctcccccagacattttgctccccgcattggggtttaaacactgatattttcatgctgtacatagcatgcaaataacttagttgctgttattattatagcacttcctccgtttcacaatgtaagtcattttaatattttccacattcatattgatgctaatgaatctaaatagatatatatgtctagattcattagcatcaatatgaatgtgaaaaatgctagaataacttgcattgtgaaacggagggagtataaggtaataatattcttaataagagcgacttgatatcaatcctgtcctagtaatcatcaaatcctattataacaactctttaactttcacacactttctaacagttcaaaattaacccaaaatgaatagtcacaagggattcttttggttcaattttcttttttcagtgtgcggtacacgcatacgcgcacacataccactgtacacacaacactacactcacaccctcacgagtcacgaatgtgtcccgtaacatatgcaaaactattaaaaatagaagtccaaatcacaaggtcaccaactaacatgatagtaaaatgccacaagtgtcacatttatactgaaatatggtactacttatgtcccctacaggttagccatatcctggttataagctaatgctgaaaaaaaatcactttctatgaaaacactttaaaattaagtttaaaaatttaaatgttgtatcaaccttttttttatctttgatttgagacgctctccattatccttttgtccttcgcgtcgccgttcgtttggaaatggttggtacctgcatctatctgtacagaattgatggagaaaaggaggacactgtaaataattgtggtgatctgatctccattaacgtcctctcaacataatttccatgtagaacttgcaaaagcatctatgtaccttgttgattgttatccctttttggttcacatcacccacccaaaattttctccaggaacccttttttcatcctgaaatgacctccacttgcgttttctgttttccaacagtcactcgcaaaatttcgcagcacgcttagatgtaacacctgtcggttgtgtttttccctttattttgtcatacgaattaaaatgccttagttgtaaaaagtagatgaaccggtgttgaaactgtttttaattatgaaaactagcggatttcccctttcgcggagctagattttaattgatatacaactcgtggcttcatatcatatatttaaaaatagatttcaatttaatacacaacttttattttctgttttcaatcgagtctacgccgttataatttggatgcactatgatcaaagtttttattttctttcctctgattaatgtgttgtaatttctaggactagaaagagatagtgatgactgatgaccccttgcctcttttgatagtaacataaataatgtgctgctcccccggccgtttcacgttttatattattattcgttttgatttttaaaaatcaaatttcttcaaaatttgataagtttataaaaaatagcaatatttatatcacctaattagttttattaaatctaacattaaatatattttgatattttgatagtttctttgttttatgttaaaagtattattatattttttttctataaatttgatagagctataaaagtttgacttaaaagaaattcaaagtaattaataatatgaaatggaggtaatacctatcagacatttatgtttttgttacagggaagaattaagttgaatagataattatgcgcaccatagttcatgtcaacctcatgaatcttaacaaggaaaaaacagtgagccatccaatggccataagaggtttctctcaacaattattgtcaacaagtacatataaaccatccgcatcctggcccccaggagaaccaaatgctaccacatctagaaaaacacatgaccaaacttgtttagaaatgctctgcgtggctcacgactacaacaacaggtctgtttggggggagcttaagattttgagatagagctgattggtagccagcttctgagaatctaaaaaaactgggttttccagcttctgtcttttagtttattttctggattctacaattacagcttctaggaatctggatataaagctggactgtttgggggagcttctgattttgggagaaacggctatagctagaagctccccgaaacaggcccaacatctacagcccatcctgttgctgcaaggacctcgccaagccatcatcaatcaataatccaaggcatccatttgctcatccaatggtcgagggaaaaaaacaaaatataacttagagataaaaaaatacaaatatttttttaaaaaataaactttgcttatgcatcatggcacagtacagaacatcaaaattcatcggctggctgccaacatcctccatccgattggctgtctgtcctagcatagggcctgtttggggagtttctagcagctgcagcttctcctagaatctgtagttaccagaagttcccccaaacagttcagttttttatccagattctgagaatatatagttgtagaatctggaaaatgtactagaagccagaaactgggtttccagcttctccagattctcagctgttagcttttcagcggctgcttttaagaatattaagctcccttaaacaggtccataaactggtaacgaaatcaccttatctccattttgcttaattttaaggaggatggatgatggcgccaggtttaggggcttgtcggatggcggcaagtccagtcacgagccaaccacgattcggccacgggggagccgggcccacctgacagcgacaggaatataccacgcgtgttgctcccccgttggctgcagggagcacgcctgcgcggtgggccccggagcacagcggcgctgacgtgtctccggctgtggagcgcgtacggcgcgggcccaccccaaggtcggatcagcttggctgcgttcggaacttcggatctccatttgcagcttgtttggaaaggcgaggaggggattggtaagttaagagccaaaattaatggtgagattaagatagaaatttgatttttaatcttaatatcttgtttggtagagaatgtggtatttgacagaaagtttagttggagattaggtcattaatgaaaatgaatggttgagatttgtttaggtaaaggaagaatttcctcccaattaccacacccctactcagatattgaaaatgagggagttcattactcaaaacagttaatagactcatccctctaaactcctaatcccttctaaaaactctccccaaccaaacaggccgttgggtttagctaatgtctcattactcgtgagtactgatgggatacgcgtaggctacgatagcataaatcaaaattttctatcgcgtgaaccaggaaccatgcaagtattagatcatagatcgttaccattcgacgtgctgcgcagcggaaaaagacgctgagaagtcaaaggaactctcgcgaagtagcgcgcgtcaatgtagacgaagtagtcgatcgcaccggctcgaccttctcctcctcgtgcgttctcctcgccgtactcccacgtcgatcagcaccgcaaaccagcgacacctctaccggtatccacacgtacagggacggaacaccacgcacatatgtgctagcacccgtgcgcggctagggttttgctcggggagggaagtgacggctagggtttctcacgtgatgcaatgcctccgccggtcacacccctcacgaatatataggatccatcactcgggcttccaaggcccgtagaactcttattcagatccctatccgaagtaagctcatattggatctccatccaatccccttattacggtccattaagcgtgcgaccctataggttcatatatactcggctgtaacccaaaaactcattttcggtccacgcgtcaacagcggcccctagcagaacgtattgacccaccgggcatacataaagatcatatcggctgaacctctagtgtatacttgtatgaacccctttgcctcacgatatcgattaagctcaaggctagatatgtgccatcctctattagctcaatcattcactcgaacctgttgatagattatataacttgtgattgactcctcaatcacctttggcatggccatgtacttccataatctacaacatcgaggggcccagagatatctctccataggaggggcaaattctatcttaattattcatatcccactacatatttcatagcatacccgaaaactacttttataactaaccaattatggagtagcatttagcagtccctaagtaagctactacatatgttgggaaccatgataatctcaggtctaaggattcaacaccaatactaaatgagatcactgacactacaaaataattgagctattgccaccaaattattacaacaaaaaataattcgtagcaatatattgtactattgcaatgataacttttctgtggcaaataattatattttattgcaatgatctacaatcgttgttttatttagtacttttgttgtaatagaaaatgagatatcgccacaaaaagtcgtactgttgtaaaaacatgttctctcaccacaattttaatttttgtggcaatttacatagtacatgtacttttcactattttttgttgccacaatcaacaaattcgttgcaataaaaaaattgtcgtctcataatttaatttatttttttatatggacatggattgagacaaattttatatggaaattatagctctcgacgagatctacaattttataggtgataaatttttcatttgaaatcttttagatattcaaatctatgattcaaatcttagttaggtaggcttaaatggaatgatatgtattttccaacagaattgatgtgtaggtgagttggtaaaggagagcacgcgtggaggataggtcttgggttcgaatcctagccaagacacgatatcaaaaaaaataaatagacaaatagataggatgatagattaatatttaaacttttaatttagtatgtaaaactactattaggtatgtggtatccataaccctgacagtagcccccgacttcgatacaaatgaacgaattcatattctcaaccgcgtgcagaccttggagtaactgttatcgagctcatgtgaccgttctcggtgagttcagagataacgttagacttcccttatcagtctcaagcgggcacctatagtgtttgtctgagtcaatctccgacgtcaaccaagaaattacagagcatacgactaagtctcccgtcttgctgtaatcgagaatttgaattgaagtcaagaaattttatctcggcgcgtacaccatctcttcattccgtattccttgtcgagatccaccaaccgttctcgagtgaccgagaaggcgcagagcctgcgacgaagccttgtcaacatttgttgtactcgccttagtcgatcttggtgtagaaccatagagacatggcccaccacataccatgtcctatacgaaaacaacctgcggatatagaaagagttccggataaggaaagacaaccagagttctgcatgaaaacgacaaggactactcggattgtatccatattggtttccctagttctacttggacaaggggacatctatgggtacaaataaaaggccccctaggaatagaattttcctgaaatcaatactcagaaaagaatcctatcttactataaagttatcccccactaactccttaagcttaacatgcaaagatgccacatcatcatccactaacaatcatcacatttaaacatcatgcaaacatgctatatctttatagtttttataatttaagagcttttcgaatacaaacatgttaaattatcatctaacataattcacataatgtttcaatgcatatttttattatattttatgatatcctatatagttcatcctcacttaattagtgcttaaatgattaatctatggtccaaattatctttctccttttttcctataattaagtcatatcacatcaattgtttttagcctttagatgattaatctatggtaccaactagtatctctctacttttcttcttccataaagttatatcaccttactttttacgtttgaatcaccattctacatactatttaaatttaaattatcataaaccacattaatttacttaatctgatgttatctagctatcttacacgttatttttttattgttatcatactaaattcccgcagcaatgcgtggggtttcacctagtattagatagaaatagcccccgagcgaatgctcaaagggtaacatgttataatatgtatggaaaactgaaaatgaattaaatttacagaccaatgttttatatatgagcatctactcttttaccgacttcgatcagtcagtttgttgaatcatacactctccctagctcctagccttgtcgtcggagaatcgttcttggatgataaggctcttggaccctttacctgccttggttgaaaaagcactgatcctagcccccagccatgaagttggaaaactcaatttccgattacacggcttggttaatacgcacggcgagaactcttacatgatcaggtcttacatggtcgtttgtctctacatgatccgacaaggccttatccgctctgggcgtccccagccgaagttcccttaggttcctcagaggccttgtcaggacggcgtaaagggacatgaggataggtttcaactctaggtgtcgtcgtggtaagggatctctgggtaaaacacttggcgatattatgtacctgatatcaactttgttggagtagaggtaatgagagaatcgctacgccactggtcgaaaaccagttgtagccccaactcgaccacttgaagcaaaggtagtgggagaatcgctacaccactggtcgaggaccaggtagtagtcgtaactcgaccacttaaagtgaaaatagcgggagaatcgttacacctctggtcgaggaccaggtagtagccgtaactcgaccagttaaagtggaaatagtgggagaatcgctacacctctggtcaaggaccaggtagtagtcgtaactcgaccacttgaagtagaaatagtgggagaatcgctacacctctggtcgaggaccaggtagtagtcttaactcgaccacgagaagtaaagccactgggagtattgctacactactggtcgaaaaccaggtgtagccttaactcgaccactagaagtagaggtgcgagagatcgctacgtcctactggtttgagaaccaggagtaggagcctcttaatcacctataggggtgctaaatttggtttgttacatgtgcatctcatgtagccagcatgactcatatacccaacttatagcatatccggatgtccgctcgcaatcatgtcgggtgatcaagccgacaacgttcacgagaatttattcgttaacaaccttttctcgaatagcccagccttggtcggcgctatgagataggtcgtcggtcttcgttggtaggttgggtgcgacaactccgtatttgtcgagaacgttctcgataatggggtgtgcttgaccacaacctactcaagtgctcaattgtttctgaaaaatattttctagaaggcaagatatatagcagagaatatcgagtatgtactcaaaaaactgcatagatcttctagtattatcaggacataacgagcagatgtaaatatcagggattatgtaaatcgtaaacaagcatgatttatactgaagaaaatagaacgagcccccagcgttaaaccgtagtcaatttaacatccgaaacactcacacaatagatattgtataaaaaaacatgctctaggtgaccataataaattatagatctgacgacgatggttctgatcttgtcggggcacgtactctggtcatgtcggatctccctggttcgaagtcgtcgagtagcttgttgttggagaatccgtctcttaaacccatctcgtcgaaactttgaagcaccaaaagatcccctacctggcgcaccactgtcgatgtttgatgtcgcgattccggtatttgtatggtatggggatcgttggtactatgatatatgcgagattgaggtaaaagagatggaggcgaggatttttatacaggttcgagcccctgaattgtcaggttataaccctacatcatgttggccgaagccggtattgctcttattcaccataatcacaccagtacaatatttggggtagcctatctaactgttgtcgacatggcggtctgaagttctaactcgtagtcgacaacatggtagtcttcctcttcgagtttgtgctcggcgagatcagagacagcgctagatccctacggccggcctctgtaggtaccggatagggtcgatctaggcatatctctgatgtcgatatccggcggcttgtcttgacgtatgttggcttgtatgttgtggcttctgttgttccgtgtcctctatggtgggtgtgtcccctctcctcctagggggccttgtatttatacccataggtgtccccttgtccaagtagaactagggaaaccaatatggatacaatccgagtagtccttgtcgtttccatgtagaactctggttgtctttccttatccggaacttcttctatatccgcaggttgtttccgtataggacaaggtatgtggtgggtcctgccgagatttagtcaactactattagttatgtggtatctataaccctgacacatactttttttttacgttggcccacacttcgtagacataggtaatttatttttgtgacaaggaaaaactactactccctccattccataatatttttttttcatccatcccaaactaatacaaaacaaaaatactacaacatccatactttatcaaattccaatataactattccccccttatctactttcaatattaagtaaacttattttaagaaaaataaaatgagttaaaaataaacatattatgaaaccgatggagtaacaagtaaccaacagtcgaacacttcaattcttcctttcttagggcatttacagtgtgtcactctcgtatgaggagcctcagtgtgtcacgtaggctagagctacgagtcctaaatttgaattcttcacactacaagtggctctgcgagtggctttaattttgtatttcagcccctagtaccttttgtttcagttctcatattttctttaatttgtggagatccaaaatttacacttaacacccttaaatccagaaaagaatataaaatcccccatttcccctctttcccttatccttacgcccact

SEQ ID NO: 25888 - DNA, 7465 bp, Oryza sativa
  unsure (1)..(7465): unsure at all n locations
cccggcgacgaccacgaggcaggcattggagcttcgacgacgactagatcgggggcgccagcgtgcctcggctgtcctgtcctcgttgcgagcgtcctctgctgggagcctctagatcaaggcggcggagaagagggagacggcgacgaggtggatggcgagcagcgaggatggcgacgagccccgcggtggcgcagagctgagtgtcgcgatcttcttggcagcgcggagaggaggatgacggctagctccttgccacaggctacgacgggcttcctctccgaccgctgatgagctcccttccctccatctcccttctccctctctctgtttccaggcgacgtgggcaaagacgatgcgaagcgaagccacgccctccacaacgcatctccttccttctctccccacactgccaaccctcgaacatgccgaagaacagagtgaccatctttggtcatgcggtcctcaattttgtgggcccacctgcaaacgtggcatcgaattgcatatgaacaccgacgtggatagttcaggctgaacgacagcgggatgcactgtgaacgcccttacctctgcatgaggcagagagagagggagtggatgtgtggtcaacaggaggtagaactcatgatgctctctttcttccctttcaacctctgggaaaggagcaccggcttctgcagcatctagtaggtataattactgtcttactggaaggctgcaaaagaagaggttttggacatttgggtcctggtcaagtttagactttgcgaaacctgacaaaacaaacagacctcttactctgtactgtactggagtacgtatgccaccgcccaactactgcatccctgcgactgcgaacagcaggacgaagaatgcaatcatttctagcgaggcaggcgtctttctgtccgctcaggagagaacacgaggaacaaatacatgctcttcctcctcacagaagtttgaatttctccctgttttcttcttcatccaaagtgttctctgtctgtggccgtattaggtccacagccaattttttttaaaattatatggatacatacttaaagtattaaacatagactaataacaaaataaattatagattccgcatataaactgtgagacgaatttattaagcttaattaatccatcattaccaaatgtttactgtagcaccacattgtttgaaagttcacattgaagtttggaagtttgattgaaattagtacgatatgatatgatagaaaagttgtgtgtatgaaaggtttgatgtgatagaaagttggaagtttggaaaaaaactttggaactaaacatggcctaaatcatgacataattgggctcaaaagattcgtctcgcaatttacatgcaaactgtgcaattggttttttttcgtccacatttaatgctctatgcatgtgtccaaacatttgatgtgacgaaatttttggaagtttgaaggggaactaaacgcagcctgtggtcatctatgaaaaaaaatagataaggctactctgaggataaaatgatctggatttggctgcgggagctatcggagacgacgaagagagatgatgctagggtacttgcttgacggggttcacaaatttgtcgaaatgggttcaaatcttgtgaaattcgaccctctcgacatgggccagaattagatatgccttcagaatttcaaacggtttcaaaaggttcaaatttggattgggaatttactaaaaggtcacttttttcgctatcacggttggggttaaaaaaaaagctaaacaaccaaagagtaatgaagaaaaaattggaaaagaattaaatatgggcctcacggttgaaaccactccttttaccacttcactgtcaagtgcatatcggaaagttaaattacactgttatattggttctaactaaatcttctaagaaagatatcacgtgattatattttctataaaaaaaaggaattatatgttgcagtccattcatctcttttgttgcttatttgagtgtttcactctttttcattgggatgttgcacatgatgtacaagacattttcttggacatagaagggtcgtgatgttgcaatcaattttttttcaatattgcatctgattaaaataattttcaccaagtgatggaacatttttttattgagcaatgaaatatctaaaaccttttttgctcaaacaaatttactaagcggtaaatatctgaaaacatttttcatatataaggtgaaacaccatttgggttttgactgggatcggacgtttgatccttagtcgctctcttattcagggccaaatgtgtgcatacatcttcgaacaatcctagccctcaaaagtgatagtcgattgacaattgaaatactccctccgtcccaaaataagtgcagttgtggatttccgtgtccagcgtttgaccatccgtcttatttgattttttttatataattagtatctttgttgtaattagatgataaaacatgaataatattttatgcatgacttatttttattattttttaataaaatttcaaataaaacggatggtcaagcgttgaacacataaactcacaaccacacttaaaatgggacaaatggaattttttaagaaaactttcagacatcttgttaaatctgggtggggcgcattttccttaaatgaatacttctatccattctccagcaaatgcagcacccaccacagtagacgtcacttggcctcaaagtgatgtccagttcaggcagctactagcaaggttaatttcagacaattcatcacgtttgataaactgtacaaggtagtagtagtagtatatatcatcatcatgatccatgttatccatgtcttgattcaatgcttgttcttgacagtcaccagtcaccacttaccactacacacactaaccgcccatgagcaatgcctgatgattccataaaaaagtcaagagcaaccaaataagcatgcagccaagccatacatacatccactattgcccatgcaacttttttgctagagatttgcatgacatcacaatgcatcttccccatatggacatctattattatatatttccatctattactaattcccccgtttcaagatgtatgacgtcgttgatttttcacataatatttatcaatttgttttattcaaaaatttagtataaatatgtaaagagtgtaaaagtataagttaaggttatattttatttgatgataaaacaagtcataatgaaataaaaaatatttatataagtttttttttaataagatgaataatcaaatgttatgtgaaaagtcaacgacgctatatatttttaaatggatggagtaatttagttgcatatctataggtatagcaagatgcaggcatgttttccctgaggttggagacagattaattaaataaactaacaaagtgacatacatacatgtaaagttgtcatgctagtgctgagcttatcttatcccatccaagcttgcatttttattaattagtgttaaaccctacttgcatatatgcgtgcgtgcttccctctcaaatgtcactagatgactctctctcaacgcaatcctggttctggcgacaagtcctcttcacagccttctctgcttagatatgaaacgagctttttaactctatatagtacacatatataaatcaacaacttatctatagcaagtaggtcggtccaaatttatggatttaagctcctcctctgcatgctctgaagaatataatctcttttttttccattttgcactaagagtataaacacatttttataagctcctcattttttttttgccaaagtcatatctcacaaatgcaaaatcgagtttttttttcctaatgtactctaggatgaatgtgagtcctctattactcttgatctaacagaatactacaagattttctggattaaaattgaaattgaaaatgtgtagcgttaaggaaaattcacatgttcaatagatgacagtggaaattactctaattgaagtctcaaataaagcatttttaaatagctctgtagatgaaaggtatttgttgttttaaacggaaccgtaggagaagaaaattatatttcaattaagcggaaataaaaacccaaatggggttacatgaaaaagaaaagcatctcctcaaatagaagagactcgcaaaacacctcaagaaaaagaatcgtggcctttacagcatacggaacaactaaacaacccttaaccctagctaaactaacaactaaataactacggaacccaatgtaaggatcaacatcaaacttgtcgtaaagagtacaacacaacagctccaactttgcaaacatgtgtcattgttgctgagcttgccacctaacgacacaacagctttgactctacagtgatcgtgtcatcgttgccagaggcattgtcaaaacgaataaacaccaccgatttcccaccatggacataagcctaagccaacaagtgccacttcctatacatggttagcaccagcacccttagaaagagagaataatatgttatcattgccaagcttcaacacaccctcaacaacaaagcaactccgactccacctagcagaaacaaactaagaaagctggttctacaccataaacaagaatggaacaaagatggcaaaggcttcaccaaacatcccaggcttgtagagctttagagtcgatgcaggggtccacgaacgaccttcgctataagggtaagcttctccaaagcagtgtccccacggaggacatgatgtgaaacacgaccaccactcgtccagaagccgaaacaaggttttcacctgaagatggtagggatggggaaatgttataacaacgcctccaagaacggtaataacgcctcaggtgtcaccatcgtcaagctggcccaatggcctgacaaggctttcgccaacagttccccattcaacaccatgaaaccaacccgtacaacgacgcttgctagaacaccgcaccatcccttcagcaaccaagcccaggccatcaccccatgctcaggcgtgctcacacaagactgctatcccacagtgggtttcccaaccaaaaagccacaaatattaatttcctctcctacccctgccggcaacgcgtctctctgctccctctctcttgtcgccgttctctctgctctctccctctctctcagcaaagcggacggcgagccacgcgggtcgcggaggcggacggccctgccccaccccgctgccggcatcgaagcggcggcatcgacggggcacggggcgagatctgggtgcgcgtcgccacccctctccctttgcccgtcgccaacctccccgccgccgcccgtcgcaccgttgccgtcgccgtggtgtccagatctggtcggccgcgccgtcgccgtcgtgggtggatctgggcgcggatccggggctagatccgcgccgcatcgagacggacgtggcgccggcggagatcagggaggacgacgactcttccacctcgccggtgtcggatccgctctttccccctctcttccccgccgccgcttgtcgccgtccacctggtcggcgcggcctccagctcctccaccacctcgagctctagccaagggtgttacgggaaatacgggtgtggggaacagtgtccacaagctacggtgtgctcaacgcggctcctcgcttcgtttctctgtcaaaagtcatcgaggggcacgtccccctggagaaaacacgcgcctctccaggggcacacggcacggacgggcaaagtaacggcggtaagcaggtacacgggttgagggtactcattaaacatggcttcagaaagacaacggctccctagtgcagtgctgctcccgccagtaatgttgttgctcctctgtctctccagagtccagaccctactcctacttcaaggacctgaacttccttttcactgtatcgtagcgccgtgccaacatagctatactcgatagcaagacagaaaattcgtctgtacacttgaaaaattgttcatgagagagagagagacgagagcttgctgtgcaagaatcttgaacaaatcgctgaattcaggagtactaggagtagtacagtactagagtggtagagaagagagagagagagagagagctgggttggagtggagaccaggaatggaggaagtagaaaggtgtcagtgctgctgctttgcctgcaaaatccccttccttccaaagctccccccctgcccttttcggtctctgcctgccctgcttcttgcccaccaccacctgtgtcctcttcctctcctctccttgcattgcagccttctccttgcttcactgcctccctcacctcctatatatccttcccccttgcctcctccacccacccacacttcacacttcttgtttgatcaatcacagagacagagagagagagatggcttggaatggcaggtttggagaggatggagaggaagagaggagccttgagctcagccttgccctccctggatacttctccagctcaggtcaccacctcccttgctctcttcttgattcatcttgccctcaaagtttcctgctttgtttgatcatatctgtgtgttttgtcctatgctttacatttctggtggattttcatttctcaggtttgcaggggaacacgagcactgctgctgatggagccaagggaaacgatgggttcaaggcaaggtgatgaaaattttctggttttttttttgggagcagtctgtttgctcgcaacaacatttttctgacgaatctgcagcaaaaagatgctaaaatttgcccctaaattctctgcgattcgcagcaggccggcggctccggtggtcgggtggccgccggtgcggtcgttccggcggaacctcgcctcgtcgtcgtcgtcgtcgaagccgccgcgtggaggccgagacgccgccgccgccgccacgggaggcaaggtggcccggttcgtcaaggtgaacatggacggcgtcccgatcggccggaaggtcgacctggcggcgcacggcggctacggcgagctctccgccgccgtcgaccgtctcttccgcggcctcctcgccggtaaaccccaccacctcgacattatatatcatcggagttttctatctcgagctttctcttgatggtgtttgctcgcttgcttgctcgcgttggcagctcaaagggacccaaccatggccaccgccgccgccgccgccgctgccggcgagagctgcacaggagaggaggaggcgatcgccgggctcctcgacggcggcagcggcgagtacacgctcgtctacgaggacgacgagggcgaccagatgctcgtcggcgacgtgccatggaagtgagtccgacacacacacacaccatgaatgaatctctcgtcttctccaaagctaatggcgacgaattcttgattgattggcatgnnnnnnnnnnnnnnnnnnnnnnnnnnnnnnnnnnnnnnnnnn

SEQ ID NO: 25889 - DNA, 2339 bp, Oryza sativa
tcttgagaaatttgatcgatttttacccgtgatttttgttcttgatcttgtttttgcagatacgagcagggagcaggaagagggcagctgccgagtgatcttgatcttgtttttttcatcgccgggagcagagcaggaagcatatctgcatagtgattatgatagctctctgttttgtttttaatccttttctcttcgcgttcttggaagatttttgtgtacaaaaatgcgcaagaagcgtctttttttggggatcatgatgttgtcgactacgactaggacaagatgtaatcgagaatggaaattgttagtactattaattaggatcaagttcatctgttcttgcaagctactaatcctggacatgctgagtgatgtgtctttgtcagtgtcgccggttgatgttttatcttgcgattctcgtgaagcatctgcacatctttcgcaatcgtcgattcaggtttcggagagcaagaaacgcacgttgattttgggagtgtttgtagttattcgtccgagcggtcaggcctatgtgtgttcatctgagtttggctcggttcagacttcagagtagattcagtattcagttacacttggtttagaacggaaatggtttcaaatcttggttttttccgctaaacggtaatatcttttacaaaaattttatattaaaaaattgcttaaaaatcatattaatctatttttagtttttttagctaatacttaattaatcatgtactaacctactatattgtttttcgtgtgtaggaattaattcccaacacagcctaggatttcttctgagcttttagaagatggtgaaaagaacaaaatgaatatttttcagaaaaatgttttaactgctatcagctgaaagcctgaaactctcatgttatctccctctgaagttatctgtggtattgttcggttgttcgagaagatatcttcaaaattatactcctactcactatattttgttgtctaaatagtcctagagcaattataatattctggttttatttttaacgatgattgcttatctagagaagaataaatagccttttacggtccttgttagtactagtattaggctattgggaccacctatacatttgtcgacaaattttctcctaaaaatttgataaatgtaattataatacaatcgtagtgtaattacaatgtaacttaaatgtaattacagtgtaacttacatgtaactacagtgtaacttgtatataagtttcacgtaattttgaatcgttaaatctattacaagatttgttttggtgaggaagaaaaaaaaatcacagcacacacatatgtgtaaggatttgttcccacaacctccattttacccaaataacatattacagagatatttttgagagttacatacaagttacactatagttacatatagttacagtgtaattacatgaaagttacagtgtaattacattacgattgtactgtaattacatctgtcaaatttttgggagaaaatttgtcgacaaatatatagcaaaatcgttttcggtttgctgtaaaatttacaaaaataaaacagtttttcttaatgggccgaaaatacgtgggccaaaataggaaacgaagcggccgaaaaaaaacttgggctgtcgtacaccagcaatagcacgatgtcgaggcacacggtggagggacagccgccgatcgataggttatttaatttagaagaaatgggttgtatccattggttaaaattctgcaaaatttaaagctttaaatctgtaagaaaaataaataaatagatagtccctttaaagcttattacgtacccatcaaaatgtacgctacttgatcgtgtgtagtgtaggcgtaggaaaaagaaaaaaacccatcaaaataaaaaaaaaactccctactacaagttactttggcttctttttgtcaaatattttaagtttgactaagtttatagcaaaatatagtaatatttttaacacaaaataaacatattattaaaatatatttgatgttagatttaataacactatgttgatgtggtgcatgttgctagatttttctataaatctgatcaaacttgaaatgatttgactagaaaaaaagtcaaaattacttagggccagtttagattccacccaaaaattttacaccttgtcacatcgaacatttaaacacctgcattaactatcaaatataggctaaaaaataactaattgcacatattgcaactactttgcgagacgaatcttttaagcctaattgttccatgatttgataatgtggtgctacagttaaaaaaaatatgttaatgacagattaattaggcttaataa

SEQ ID NO: 25890 - DNA, 11859 bp, Oryza sativa
ttaaacaccttatgagatgtgactgagagagtaattataaataattaaaaaaatgcccagcacgaatattgcagcagccgtccctgtccttttttccttttttctcccccaatccaactcctacttggttgcgttcgttctaaacccgagcccgatttcagtgtgttttgagacttgggcccttatacaagggcccgtagtacactaggcctccgactctcgccttccccttccttgttgcccccttacccaagttgatccgtcgccgagttcgcttgagccccaatctccgatcccccaccatcgccggcgccgccgccgctccaccctgccgcttttcctcccgccgccgcatcctcgccggtgagagcatcctcccgctcgttacatcttcctcacaccttttattttttttatttttctctctcgacgaatttgcgaacctagactggtagttcaaccctagcttctcctccctagatctggaagctacttttacctttgcccttttttgttgttgatcttggtagtaatggtggtgacaggtagtttgtcccccggagaaaatctccccactgattcttcgttgggattttagggttttgtggcggcgatttcctgtggttctcgatttgtttctgctcgctgtttcgcgagattagggagattgggaggtatagtgtgtgtcgtgtgtgtgtgtgtggggaggggttgtggcggcggtggattggttgcgaggggcaagtgattcatgtgcgcgagatgttgatttgattttttttttgtttcgtcggtgacagcgcgggatggccggagcgacggatctccccccgaagggcgggttcagctacgacaattgcgcgaggaacgccatgcttgtggagaagggcttgaagatgcctgggttcctcaagaccgggactaccatcgtcggtttggtctttcaggtactcttttgttctgctaactggtactcttagtttttttttcttttttcttttgcgtgtgctggttaatttgtgtgcaatcaagggaatcataaaactttatggacataaggataatggatataactgaattgtgctgtaacattagttttctcagctttttttcccctcaactatagtttttagtatgtgcgcaccgcacgaatttatgcttctgtttatgtaaaattttttgaacctgaaagaataatggattaccagaggagatttctagtggcaacattggctattgcagttgctttcagcagggaagtagatggtgcttgttttaacctcctattgtatttttgctcctagtctcctagttgttaatactttgatggatgattctgttttccatgcttcgttccatctaattggcatccttttctgctcatcatgaataatttgctgagttaactttggtgtaactatgctttctacttaggatggtgttgttcttggggcagacacgagggccaccgagggtcctatagttgctgataagaactgcgagaaaattcattatatggcgccaaacatatattgctgtggagcaggaactgccgctgacactgaggctgtaacaggtattaattatggtatcctggtagcatgaagagaaaaaaatagttgtggactgtatactccaacccagttgtttcattagtttgcttctctgtcttataaaaaaaattgaaaaatacaacttgttttgtttcaactctagatatggtcagttcccagcttcaacttcaccgttatgcaactggtcgtgagtccagagttgtaacctctcttacattactgaagtcgcacctttttaggtgattgctctctgcctccctctctctcaaacattgcaaatgtttatgcgtcatcagctagactatcatacattgcaaacgttttaccttctttcttccttatgttttagctaccaaggtcatgtcagtgctgcccttgttcttggtggagtagatgttactgggccacacctgcacactgtgagtaactgagtatggttgtctgttaaaaatatctgttaagagaaattttgggtagttttgttaatcttttgaatcatataggtttatccacatggctccacggacactcttccttttgccacaatgggttctggatcccttgcggcaatgtcagtgtttgaatcgaagtacaaagaaggcctcacagtaagtgaaccagtgtaattttgttctttgttcaggctagcatttgctgattgctctatacctttttttatttacatatattgatactgcatatcttttcattatgttttatatcattctaattatttcttaaattctctagagggaggagggaatacaacttgttgctgaggcaattcgtggtggtatcttcaatgacttgggcagtggcagcaatgtggatgtttgcgtaatcaccaaggtacataaattattattattattattgcatggcattaacaggcaaactatggttgtggcaatttatttgtccgtgtatgctatctttctcacacatggttgcagttcttgatataatttcctgtgaactgaaattcccattcagttatctatgtccatttcgttctattcagttgctctagtcaataatctatgacactcgtttccttcggtttggttgctctatgcaataatttacggaaagtgcaatagtcttagataaatagatacctgcagtgccaaaaataaatccaaatatttctatgctataatcttcccgtcaggggtagaatatttgattgaaccaactttaaaatgctcttgttgcttgaaaagtggacgcgtgtttctatcttctgttttgctaacaaagtcctcctgttaacattaccaggggaagacagagtacttgagaaaccaccagttaccaaatccaaggacttacgttagttcgaaggggtacaacttcaccaaggggcagactggtcagtgtcttattaatgttacatcatattgatagaaatgcttcagcaatatgaactcattcgtgtttcttctctcgtctcgcagtggtgttgtccacaaagataacacaactgaagccgaaggtagaggtgacagagggtgatgcaatggaggagtgattttgtgtgcttacattcagacaagcagtcacgttgagaacatatgctttcatttcagtggaaatgcttgaacaaaaaaagatgactcttgttgtacttccttgggcttaatgcacatctttaagttgattttcgacacatttatggaggaccgatcttatatatttgctaaacggtggtgcttctattcatgatgttgcttcgtgtattcaaaggttcatttagcgcgaactgaatgactaccaatcttcctcgagtccgatcgctgagattatattcctagcagacttaagtttgtagctggagtctcagttgataagcctttttttttaaaaaaaaaattatcagtgctgacataaattacaatgtcttaaaattaaatccaaaattaagttttaaaattctaattttgaccgtggcttataagggcaacgatgggtgaaaagaatcatataattgatatttcaaaatttaaatccgttgatacaaacttttttttgtgatatgaaggaattattgatgtaagtactgaaccaaaaataaccgacaacaaagttcagaactactttatccggtacaacaaaagttcagaactattttctcctataataattcagagtagatactgcaaattgcaacaccaccaacacatttggcttcgatttcatttctgaaaattttgtttgtagagtccatcaggctccttcgaaacatacagaacttcaccacattctataaactataacaacagcactgagtcactaataaaagttggaactctgtctatggggaatcaattcaggtactgagaatgagcagctgcaatcagggcagctccaaggccagacccgtcgtttgcaagcttgacagccaccgacttcgacgcctcttctccgagcaactccgtcagcgtggtctccaggcactgccggaattcggtgtaatgttcatatagaccgccatcgatggcgatgaccgactttcgcttgtcgcctgggacgcctctgccgatcttcctgaggatccctacgatcccagcagcagccagccgggctgatcttcgggtgacgatgtcacagatttcgacaaccatcttccttgtttctaaggatgtgtctgtgatctgtggtaaaagtggacaatgccgtgtaatgtgttcattgtgcataaaatggatagagggaatacagttcaatgctggatttactgatgaagattaccttcaggttatctgcaagtttttcagccacaattctgagatcaggtgttccatcatgatgcatcacggaaatatcaggagtcctgaatataatgagagagaggataagccagcacatcttttttcaaagttgcttatctcattttggaaaattgcaaagccatatgttttgcgcctaataattattatggatcaatggtgaaactccaagtgatcctatagatattctcagcaaatcatgctttatttgcctagcttatagattaagattaccacacaactgagtttagcgagaaatatacctcagaataaagcgggttttgagcttggtctgatctagattgccaaaaattgaagactgcaaagatattttaagaagcactctccttacgatttcacctagatacattcctgaaatcaatttctcgaagatctgaaaaaaacaagtcatagtttttttagacaacaggtagcagttctatataatgtgggtaaaacttttgacatgtgaggagtatgcaatcttctagagaaacttgcctgctctccagggtttaagctctctttatctagtgcttcatcatattctgttattggaagacaggatgaggagaagttaccccattctgtattaataacctgaaattcagaaagtacagtgagaaagaaatccaaatacagatagtagatgattctatgcagtacatgccagttacttcggttgagaaatatctaatccttaccatgtttcctgattttggtaactcgccttccaacttagggatagcatttgccttctcaagatatgcggcgtttgagccagtgcctaagatcacaccgacgacaatatcttcgtcgtagtagctgcctgccgccaatgtcccaacagtgtcattgatctgaaacagtcaaaaaataatgtcaagcttatcataagaacaaatttcgctttgttcaaaaatgatatggaactgatcatttcagaactaaccaatgcggaaacgcgcatgtccagaccttgcttctccatggccatctgcaattcggccaccacatcttcacctacctgtcatattccaaagaagcactaatttcagaaaaagaaaccaatgacaaaattctgacagcatttcacataacaatgtgaaaaacagattcgctgtgacattgatgttgtgaatttgtttttttagataacaactgatgcagtgatgtgggaaaactgacaaatcaagagaattcttacagcatcatcaatagaaaacgccttggtccacttgataagagtcccagacgcaatcgatgtttgccgcacagggaaagagaaggtgaaccccagttccctttgcctgtcgttgaacacggcattatgtccttcatcagcgacgaacttggctaacgcggaagcgatgaagccaaacagctcctgagattggcatcacagcaacattacaaacatggtcatccaatgagactaaatgtgatgttttactatgatatatactagccaattcacccaaaaacttatgatactatatggaaacaagtgtggacatgctcactcaccgaggagttgccggacatgagatggggagggatcgagacctccctcgactcgcgcttcacgacccgtttctcctttccaggaagctgcacacgcaggactcggaagtttgttcccccaagatccagcgcgtagaacaagccctcttcggtcctacattatttagcacaacaaaaggttgttagtcatgctgatcacgaaaaatacagtaatacacacattgctgttctgcgattttgttgctttggcagatagctttgcttaagcccttttctgctattcacaaaaaaaaaaaaaacagaaaaggagaaatgcagtgataaacacattgttgttctgcatttatgtcattctggcagcaaacttgacaaaaagcctttttctgcaaactacagatttttttttaaaaaaaatggaaactttttttttacctttttatgcagaaatacagtaccgcacacattgctgttccactattctgttgttttagtaacgagaatagcaaaagatattttccgctaatcatacaaaaacgaaaagtctcagctggtgcatctacagaaatgcagtaacactacacgcattgatgctctgcagttatgctgtcttggcagcgagcttagcaagaaaacaatttccttgctaatcgcaacaaataaaagaaaacttttctgctgatcttaacaagaaaacttttctgcctttttttttttggcatcggcaagctgtaactagacacggttacacgctcgcacgctgacacgcaatgttgcacggggtcacacacgtgctgccgcagcaggtgacacgagtgcgagcaatttgacacgcgcatggacacgcaagagcgcggtaactttttcttttttttaaaaaaaaagagtaggtaaattatgttctagccttctagggattaatttaatttaatttaatctaatcccaatttgcttggccccgacacacgacgctgtgtcactggcagctcactgcaggtggcaacaagccaacgatagctcatgttaccaaccgacatgaaaccaaattgggagaaaaaacacctactaaaaatgtgattatcatgcaattaaccaccacctacttaaccaaaggagattaaaccagcttgcaaattaatcctgacaaaccaatttttattttcaatcagagtatccgaatcatctgtagctgctgatattaaagtgttcatggcatccaagaaccacacaattactaagaaatttccaagtaggagagagctaaaagaagaagtggatgatgaaacagtaattaaaaggaaacaagacctgtgattattagtgattataaatataattactagtagtaattagttacccattggggaggttgtcgacgtaggaaacgatcatcttgatcttgctgcggcctcctccgccaaccccgccgccatctcgccggccatcgccgccgccaccccatccagccgcgccgccggcgtcgcgcactcctcccgcagcgccaccaccacctgctccgcagcagccaccgccgcagccaccatggtctccgaccagcaaccaatcgatggatcgatcgaggagtgaggaagacgagaagatccaagaaatgcgagattggtggtcaagatcaaaggccggagctaaccaagatcgcgtacacaggtctctgggattaggaggaggaggagatgaggaatttatagcggtggcggaattgaaagggatttcgtgggaggaagaggagttcgaggcggaagaggaagaaggcggggttgggttgggtgggtgacgcggcgtcgcgtcagcttaaattcgaagggtttttttaaaagaaaataataataaatgactgaaattgggttgaaaaataaggggggcgttgcaaagagtgttgctttgaattcacctctgcccacgggaaacgtatgcttcggttgaccccctgggtttgactgcaattttgcgtttgcgttttttttttgggtgaaacttttcggttcacggaaacacaatttggcttgatttatttataaattttgatcaatggtttagttaacttaaaagttatgaaaaactatattaaaaagcacttttctgttatatagttatattgattttatagctattaaccagtaaaaaaagattttatagctattaatattataatttggaagaaaacaggcaacttaacttgttagattttttatgaattagacttgacacgagtgctcatatttacgatttgttattattctttcaatgacccctatgctcgtatttacgtctcagtgtcatgcaatgagatgtatatggtgagttaacgatgtgtgtgcgcgtgttcatacgaatattgtacgcgcatgtatgtgaatacttaaaaaaaattaaatcctagctgtgaaacctggatataaacatgtccaggtttgtagctaggatttttttttgacagagtagtatatatatgtatctaagaaaatattttatgatagattaatgattaaagtttaatcattaatagtttttagactaaactatgagtacgtgttataaaaaatcacatggcaggagcagtaaactagtgatacaaggcctatctgaaggtgatatctcatcctatgtcgtgatccctctacatctctttcactatctacttttgatgtaagctgcaacctttgacttatgagccacttcagtatacggcagaaatttaggcctcttatgatacgtatggatttttcatttcttattagtgattttttttatctttttccttacaaaattttatatgatctttatatgaaacaacaacaattgttgtcgtaaacaaatgcgcacgcagcctgtattattagtcatgcatgtgctacatcctttgtctcaaaataagtttgcatttatatatggatttaaagatggagggcgcaagtgatatggctaatattatacggttagaatacatttttttttgttaaaaacaattggaatacacagactacacaatataagttcataggtttttcctcctttttttgaaaagcaatacttgtgcggttggcagttgaacacacagtttatagtagtagttgcttggaatttattgtcttgatactcctatttgagaagtgtgtcttcaggttcagaccaaaagcttatagtcaaaaagatacgagtagtattccctacacacaaattttggagctactccatccgtcctaaaatatacttcatccgtttcataatataagactttctagcattatctatatttatttaggtgttaatgaatctagacatatatatgcgtttagattcattaacatctatatgtatgtgggcaatgctaaaaagtcttacattgtgaaacggagggagtaagtatttttagttatgaatctggataactgtgtgtccatcatagctaaaaattgctatattttaggacagaggtaggtggacagaagcaaagacttaaatttgatagcagcagcagccaggttagttgagtcaaaccaacaaactaatcagctactgttctaaaagactagaagaacaaaagagaattatctcaacatactcccaaaccaaaatcgttggacaatcctagtgtacggctctgcaaaaaaaaaaaatacaaagcaggtggctgcgagagaagaggccggtttcaaggaatttgacctggactcccctcgttctggactcggaatagccattagccaatagcagccgggtttggattagatattttaggtggataagggtttcatggcacctcactctgacgtgagaaaacactgccttttgcattgtcatgctatcaacatcctactaacaaatagtaagagaataaaaatttaagataggagagcgtgcatggcattgttattagtattatttaaagtagatgcagtgtttgagctctcgattttcagttttagatttctgttgtcttttgtaacttacgtcccttttggtcttttgggtcttatgcagtggcggaggcaagattttcatgaagccggggtaattctaattaaaactgttacccacatattacggttaaaaaaagtaaaactattttattgaaaacaatggactattagggcctgtttggtatagctctaactcctaaatttagctccaagagttgggtctggagtggagttgtggagctgcctaaacccagctccacaactctagttcattttgtgagagagctccacccagctccactcccagttttggtggagctgaaactgtttggctgagctccagctccaggaggggtagagctgaagctggagctgtgccaaacagacccttagtaggcgcgatctcctgcatgcattgatgcttaggtgttttaattcacataactaattattgtggcctcaagtacatgcacaaacagactcaaccaaacgggcatgcatggaacaggaaaaatcaggcaccatcttgttatttgcgttctaaagtatgaaatccatatactctatgaagtgcctatattacactttatcagggttacagataagacataccctatatcctacgacttatgaaatataccgataaggtataccttcacgtatacggcttatttccgtatacgctgttggaaatttatctcaagttatgaaaaatatctctatgagttaatgaatagccggaatcctactcggaggggataaaatcttgggataaaatctttggttataccgtgccagtttacatatctctaagtctttcttggggtcaaggtattccacggtataaaaaggacccctagggagaggcaaagcgcatcgcatctcatcgccaacacatccaccaaagtttacgaagccggagtccacaaagccaactcgccgggagatctcgtcgagatcttcaactacgatctcgtcagtatcgcctgtttcggttactctctttgtaatctgttctcatcatcatcaatcccatataaactggactagggctattacctaataagaggcctgaaccagtataatccttgtcttttgtctgttttgatgtcgtactacgtagacccctgttccaacgtaccacgatactctattcatccggtccgcgagtatcactcgtcgacacactttgaccgggaagatagcaaattgttgcacaaaagtcactctatctcaatgggtcgtggatggggagcctaggcaactgcccgccctagtcgggcggtaaatccgccgctggtcttatgccttgaaccactaagagctaagcttaaggataaaggttgtgtactttaaattttcatttttattaccaatcacaagaattgtgaatatagattacggtaggttattgccatgttcggcaatggtgggctattcatctgccacgcgtacgccacgtaggataataccgctttggattaggtcaagagggctattcgtccggtatagacagttcagggtataaaatatctggttttgtggttaggggggtaatttatactattgtcatagttcgagaggtaattcgtacttttttccttcacaatataagcgcgaaaaacactactacaggatagattttcctggacgcccctcttttttgtttccatgcggttcgtaagtggaaccgcatggaaaaaaagtggacaggctccaggatgtcgcccgcacgggataacacattatcccgtgcgggcgggttaagccaaccgcacacccgcgtggtccaccgcatttaacctggccgcccacctccctctgcctgctctccctcgatcttttccactccactcctccctcccactctcctctcctctcctctctctctctctccctcagtgcacagcgcgcccctccctctctcccttagtgcatgacggcgggcgaagagggcggcggatccggcggcacccgccccatcccctccttccccttgcagaaccgggggaggcggcggcggatccggctgtgcgc

SEQ ID NO: 25891 - DNA, 19441 bp, Oryza sativa
catttgcgccggcgacgggagcgagcggcggattcgtagccggcgaccacgagggcgacgacggcgggcctcggctaggcagcggcggactagggttagggttagggtttcttttttctttttttttctccgtgcgagcgcccgtacgcaaagattggttttcgcttgcgggtgcgccacccgcacgcgaaaatcgcgatttttccagacgactgggtgcgtgcgggccgcccacccgcacgcgaaaattggatagcccgcccggaaaaatcggtgtcgtagcagtgaaagaagcacagaggtcagcagcgaaagaaattaacgatgaaaagataataagaaagccaagtacaccatttgctttgatcgaattcggctccaacttttcttcgcgtttttgctctctattatacgtaggactagcagtaatcaaattgcaattgagatgatgcattaactaatcagttgtttcctcttcgccgacttgtgtacatcggaatcaggtctgtgggccggccacctgcatctccgtgtcggcccagtccaacaaaactgatcatgatcaattgtgcagccatgattcggtccaatcttatttcagaggccgagattgttagcccattcacaaaaattaggtaccaaaaatgtaattgtaaaatataggaaaaaatatatgaatacactgtttggataaacagcaggaattagagaagagattcaaagttaattttttatgggggtcggatctcatgctaacttttctacaaaacctccttgtcttgaccataggaatttcataggattgttcagtctcaatcttttgtttcaatgaatcgaataggaaatttatgattcaaatcgtacaaatttcatatgttttccctacaaatcggtgccctaggttttgttttttcacacggagagaagcataattcttatagttttctcgttgagatcagactaaactccgaaaatcctatatggcacataatccctccatccaaaaacagccaaattggagctatgtatgtggacattgggatgtcctgatacatagcgaagattttatttaatttattgtttttttaacgaagggaataagtgctggcagccagcgcacgcgcatgtgcatgttgggcctggtgggccacctttggaaacgacaagaatcaaaatcacgattagcgctaattactgattccgcattatctgttttccaataagcacggacaatccatgtgcttaatttgacgagcctcctgcggttttttttttctcaaactgttgttgcagttttttacccaaaaaaaaaaaagaaatctatacttagaatttgaatcttttaaccagaaattgtaaaactctacttaaattctgaaaatttcaacttaaactctgaaacttacaactcaatattccaaactttcatctcaaaattcaaaactttaaacttaaatttaaaaaattttcaactcaagttttgaaactttcatcctaaaattcaaaacttccatcgtaaaattaaaaaatttcaactcaaatgttaaaattacaactaaaaatctaaaatctttcaacaattttttaaaaccgtttaactaaatccgctcggtcgacctccgcccggtaaggctagtgagggggcagggaggctggcggcggcgacgacgtcgtcgaaaggaagggccttcgacggtgacggcgacggcttcatctccaccaccaagctcgcacgctctatggccgacatcaacaccgaccttttcgacctgtccctctccgcctgcgcgatggcctctccctttcccctgacatggcgctcccgctggccacccttctctctgtcgtccgcggctggtcgccggatgccatcaggggaagaagcaagaaaagacaaaaaaagaaaaaggaaaggaaaaggtgaaggatatagaggagaggggagtactgaggatgatatgtggagccacatggcccacttttttttattttttttattcttgtaactgattatgtgggcctcacagattttattattatttcgcattgaattgcctcgtaagtgtgacgtcaatgccatttggcaacgaagacctagtcaactgatccatgtatgcgccacatcagctaaaactagggtcaatactgccaagggacctcgtttgcattgttttgtaagttgagggatgtgttgtatccagttttctggactgagaatggaaaataagactagaggacaatggagggacctagagtgaacttattccaaaaaatcacaagaacagcggaaggtccagtcgaacaaaacaagccatggtttggcccaagcttatttcagaggctgaaattgttggcccaagcttattcagaggccgaaatcgttggcccattcctgtagataggagactttactccaaaatccctgcagcttcagtttttttagagagagacaaagtcgtacaactcgtacagttcctggttgagatcagaccaagcccaagtacccaactgcaaatcaaatccaaaacagattagctaaaaaaatatcaacaattcttttcttgacaaaaacaattacaatttacaaaggcaccgatcaatccccaacctcgcagatgtatttttgtatgtgagttgcatacaaattacattatattgtaactataacatgatacaattacatcataattatattatataatgatgatatttgaaagtgtttcactccagaactgactaaagttgtataggcagcctgtctaaactgaaagaaaaaaaaaggagcaacagaagagcaagggcggcatgagcgtggcatgtacagtatatatgcacgtgcctgcatgataatgcaacttgtcctgtctgcctcaggtcgtcatgattctttgggagctcgctcgctcgcacgcaaacatcggtggtagccttcattgtgtcgcgccgcccgcccgggcagagacaccatcgttagttcacaggcttcctttcttttcttttttttttaatttctcccagttctcttctctgttggcttcagcgatgagcttagatctactccgtccgtcccaaactaaacgcaaccataaattttcgtgtcaaactttaatagttaatcttatttaattttttatgattagtatttttattgctattagattataaaacataaattggactttatgtgtgacttatttttttagtttttttttaaaaaataaataaaacgaattattaaagctggacaccgaaacttatagttgagtagtaactactccctccatctacttttaatagttatatttctaaatatgaaaattctatttttataagcatatttcaatccaacaacatatcctcttaataactttctcggatttaatacatgactctccattattccacacatgattggctacatgggtatcgaaaaatgtaaatattaatgaatcgcttgtttacgaggaatgactagtagcatgtttaaattaatgataagtagaattacttatccttagtctgtatgtcaagatgaaatatgactatcaaaagtagatggaaagagtattatacaagttgcattgacttttttttatttaaacttatattttgattaaatttatagaaaaatttaacaacgcctttaatactaaaatgattttattaaatcttagatttgtcgacgtttgatgtcgcgattccggcatttgcatagtatggggatcgttggtactaggatatacgcgagactaaggtaaaagatggagacggggatttttatacaggttcgggtccctgaattgtgaggtaataaccctacatcctgttggccgaagccggtgttgctctttattcatctggatcacacaagtacaatatttggggtagcctatctaactgttaccgacatggcggtctgaattaaaggtctgactcgtagtcgataacagggtaatcttcctcctcgaatccgtgcccggcgagatcagaaacagcgctagatccctacggccggcctctgtaggtaccggatagggtcgatccaggtgtatctctgaagtcgatatccagcggcttgtcttggcatatgttggcttgtatgttgtggcttctgttgttccgtgtatgttgattgtcccctctcctcctagagggtcttgtatttatacccataggtatccccttgtccaaatagaactagggaaaccaatatggatataattcgagtagttcttgtcgttttcatgtacaactctggttgtctttccttatccggaactcttcctatatccgcaggttgtttccgtataggacatggtatgtgatgccgagatttagtcaactaaatcctatcgatgggtcatgccgagatttagttaactactattaggtatgtggtatccataaccctgacaatagcccccgacttcgatgcaaatgaacgaattcatattctcaaccgcgcgcagaccttggagtaactgttatcgtgctcacgtgaccgttctcggtgaattcaaagataacgtttgacttcctttttcagccttgtgcgggcatataaagggtttatctgagtcaatcttacacgaccagatcttacctttttcagaactcttacacgaccagatcttacatggtcttttgtctctacaggatccaacaaggccttatcggctctgcgcgtccccaaccgaagtccccttaggttcctcggaggccttgtcaagacggtgtaaacggacagtaggataggtttcaacgctaggtgtcatcatggtaagggatctctgggtaaaacacttggcgatattgtgtacctgatatcaacttcgttgaagtagaggtaatgggagaatcgctacaccgctggtcgagaaccagttagtagtcgtagctcgaccactagaagtggaaatagtgggagaatcgctacaccactggtcgagaaccaggtagtagtcataactcgaccactagaagtggaaatagtggatgaaatcgctacaccgctggttgaggaccagatagtagtctaaactcgaccacttgaattggaaatagtgggagaatcgctacacctctagtcaagaaccagttagtagtcgtaactcaaccactagaagtaaatttacgagagatcgctacgattgactggttgagaaccagtgaataggtgtctctcgatcatttggagtcgtggtacgaggaccgctacgctgccggtcgaagaccagtcatagctgttcctcaaccatctgaagtcatggtgcgaggaccgctgcattattgctgtagtcgtatctcgaccatctgaagttaaggtgcgagagattgctacgttttactagttcgagaaccagcgagcgagtagaattatctctcgaacaccaatggaagttgcggtgcgagagattgctacgtattggttcgaaaaccagcgagcaaatagagttatctctcggacaccaatggacgttgcgatgcgagagattgctacatactggttcgagaaccagcgagcgagtagagttatctctcggacactaatggacgttgcgatgcgagagattgctacgtactggttcgagaaccagcgagcgagtagagttatctctcggacaccaatggaagttgtgcggtgcgagagattgctacgtgctggatcgagaaccaacgagcgagtagagttatctctcggacaccaatggaagttgcggtaagagagatcgctacgtgctggttcgagaaccagcgagcgagtagagttatctctcgaacaccaatggaagttgcggtgcgagagattgctacgtgctggttcgagaaccagcgagattgctacgtgctggttcgagaaccagcgagcgagtagagttatctctcgaacaccaatggaggcgctagagttggtttattacatgtgcctctcatgtggccagcatgactcacacacccaacttgtagcatatccggatgtccgttcacaatcatgtcgggcgatcaagccgacaacgttcacgaggaattatctgttaacatccttttctcgaatagtccagccacggccagtgctatgagataggtcgtcggtcttcattggtaggttgggcgcgacgactctgcatttgtcgagatcattctcgataatgcggtgtactcgaccacaacctactcgagtgctcaattgttcctgaaaaatattttctagaaggcaagacatacagcagagaatatcgagtatgtactcaaaaaactgcatgggtcttctagtattatcaggatataatgagcagatgtaaatatcaggtattatgtaaactgtaaacaagcatgatttatacagaagaaaatagagcgagcccccaacgttagatttgtagtcgatttaacatcggggacactcgcgcaatagatattgtataaaagacatgctctagataaacgtaataaattattgatctgacaatgttgtatgatctgaataggtacaataaattcgtagataaaatattgcatacctttatagatatatgccagatgtatctacgaaattagtagattaatttaaaaatcgatctcactaattaccttctgtgcacctgtctgagtagcccagacatatcttaccaaagcaattgtacatatgcactgtgtggataaatgttgattggtccaaacatgcatgcacgtttttttggcttggatctgtctgttggtgtactctgtcgatgatagtagatgccgtgtccagcttggactcagcgggccgatgccttgcaccagctagctgtaggagttgatgccacgcgcggaacgatttgtttgcaccttaacctggctaggacagtgcgacgtttgatctcgattcaaatcgggcccgtgtccgaggacaccccattgggaataggaccgactcatattggatcaatctctcgtgctgtcgataccgttggtcttccaccgcgacgaagtcttgaaccttggtcgatctcgccagatcgaatataattgatgacgatgattccgatctcaacgggagacatacttcggtcgggttaaatctccccatagcagaagtcgtcgagtagcttgttgtcggagaatccatctcttgaacccatctcatcaaaatcctgaagtaccaaagtcccctacctggtgcgccactatcgatgtttgatgtcgcgattccggtatttgcatagtatggggattttttggtactaggatatacgtgagactgaggtaaaagatggagacggggatttttatacaggttcgggcccctgaattgtgaggtaataaccctacatcctgttagccgaagccggtgttgctctttatttatctggatcatacaagtataatatttggggtagcctatctaactgttgccgacatggcggtctaaattgaaggtctgactcgtagtcgataacagggtaatcttcctcctcgaatccgtgcccggtgagatcagaaacagcgctagatccctacggccggcctctgtaggtatcggatagggtcgatccaggcatatctctgaagtcgatatccggcggcttgtcttggcatatgttggcttgtatgttgtggcttctgttgttccgtgtatgttgattgtcccctctcctcctagggggtcttgtatttatacccataggtatcctcttgtccaaatagaactagggaaaccaatatggatacaatccgagtagttcttgtcgtttccatgtacagctctggttgtctttccttatccggaactcctcctatatccgcaggttgtttccgtataggacatgttatgtgatgggtcatgccgagatttagtcaactgctatttggtatgtggtagctataaccctgacaagattaaaaaaatttgttttgtattgaataatttgtcccacataaggcgacacatatcttaatttaattcgaaaaaaaaaactaatcatgctaactcctccgcttcaaaatgttgtttaagagtttgaggggccgtacttaacacggcgaaatggcggtggtgcccttgggcgccctgttttgaattggagagttgattaatctccaatgggctaatggatggggtccggtgggtcgcctgctcctgctccggcgcgccaaccggggaggggaataaaaacggaccatgacgtcacctgacgtcacccccgagaagattcctttttctctctcatcgctcgcctgtcatctgtatgagtatgcaggtacgggtacgtaagcttgctgtcgccgtacgtgtccacaaccaaacttcaaaaagattccgcccaggatccttctgtaaaagacgagttgctagctaggtgaccatttcttttttctatactcctattataatacggctacatgcgtatacggtagtggccacagcaaccagaaaacaacgaccagaaatatatggtagctaaaataaatcttactccgtatcaaattttaataacatcatcaagttttgataagatttctcatgtgtctatcagagtttggtaaaaagactaaataaatatatatacatttttataagtttatcaaaagaataaaagaataatatggtttaaaatgacatcgacggtttttcaccgtatcttgcggcacgtacgctccggccgccggccgaattaccgggcgtacctgtactactccaacttgtgggatcgccgtacatttggaatccggtggtccacccggcggcagacgcgcaacccgtgcaatcctgtggctgcgagcaccctacacgtacgtacgtacggatcaaactcactcaccccttgtaacaacgggtttaccgttcacttgcttgatactactacgactgcagcagcactagctactgaatatttgttggacgaccaaatcgcaccggtgttgcatcaacttaattaatgtgcaatctgcttagtacccctaccacctttcaaaacgccaattccaccgtaccaatttttacatggtacgtactacgcaccttagtatacgagcccaaggacgaaaggatgatagtatgatataccatgcctatgagaaactttcagggatcttccggctagcttcacaaggtggtgggatacatgatctgagttcgaagcctcacccctcctaattatttgatattatgtcattttctaatattctcgtcttttttataccatgcctatagtatatatttgagcccaagaatgaaacgatatatcatgcatatagtcttgttaagtaggcgctgattagaacgtcatgtagcagtgatagaaatagtactaagtatatgaggttatttacctatactactaaataaatgatcttcacagaacccctttttccaactcacatgcgggtcgttacaacgcctgcctacaatatactctatcccgagggagggtagatgggccacctgcaaaaagacatctttgcagacgggcctcttccgtctacgaaaaaacctcccttcacttgcctctcttttcacctacgaaaatacatttcacaggcggtatcttaccactacaagataattgagctattgccaccaaattattactataaaaaataattcgtagcaatatattgtactattgcaatgataatttttctgtggtaaataagtatattttattgcaacgacctacgatcgttgtttcattagtacttttgttgcagtagaaaatgagatatcgccacaaaaaatcgtactgttgtaaaaaacatgttctatcgccacaattttaattttcgtggcaatttacatagtccatggtacttttcactatttttttgttgccacaatcaacaaattcattgcaataaaaaaaattgtcgtctcataatgtaacttatttttttcatgtggacacggattgagacaaattttatatggaaactagaaagatagcccgcgcacatgcgcgggcaccttatataatgtgtgtgaattttattataaatatttatgtgtggctgactttttattaaaatatttttactatattctaaactaaaattaagcttatttagtgtgctttagatgctagttattttcttaccattacacttgcaacatataaattctaaaataaaattacttgagattatgcaggtttgaaattatgagaaagcattatgtcaaaacaaagaaggtggttcctatgagaaaatttagggtattttgactccccaaaaggattatctcgataccccaaaagaaatccaataatatcaatttttgtttgattttattttaagttatatacacacacacacacacacacacacacacacacacacacacacacacacacacacacacacacacacatatattgtaacagtcctcataaaatgttttttttctatttagaatgggttttaaatccagcaacatttttttagttttcaatttatttcaagccctattttttttcaaagttccattctatgaatcatccttgaaatgctttaatctttgcaatttagagtgaaaatataaatgcatttatggcatggggtaaaggtatatgttataaattttatctcatgaaatattgaagtagtggtcatagtattttttgtgaattatcactaaattgaagtgtcttataacaaataatactccctccattccataatataaagcacaactatttttttctgatgttccataattaatataaggcgtgcatgcatgcatgcaattaattagcacatcttatccattaaattattattttttaaaatcctccaccctcaagatctctaatctattgggtgtatgcattatatttattagggtgatacaaattaggaggtgataataatagtttcttggtatttgggttaagggtggttgtgccttatattttgtaacgaagggagtacatgtttctagattgttctacatcaggactcatgatttaaaatgttagcatgttttaccagaaaaataaaaaaaatggacatggcctttaattcttatatggaattgacttgatatatttctaaggccacctcaaggttgtatcattattaagattcctaggtgcaatccacatgcttattggtatgatcttcaaccgaccacacatttattttcaacttgttgtctataatgctagatgagtacatttatgattaaaaaaattatatatgtcacttaaaattctttttctctaatttattagtgacttcatagatcatatttgtaagttggatgctatgaacatcattattaagaacatttatttatttctgaaaaagattgttttaaaagtatcaaggtcaatttgtataagtacatcaccccgtatgcatgttaagagaaattaattaagtcggtagaaagtcactatatatctaacgggatataagtaatagatagaggtccatttgttttttttgcccatatagataattttaattttaattgttaaggagatagaaaacaaagagaaaataatggcaaggagagagggaggtttgggatgtttttctaaatgatcaatctaaccatctaaaataatgtattggatgtttaagtcaaaaccgatggtcggatgttttgttttcttgtcagaatttttaggattttatctgatctatgagagcaacgtaacatcttaagagtgtttataggtggacttttaacaccgcatgccgcaacggagtaagagagatgcaaggaggtttgggctttttttttaaaaaaaaaagatctaatgacccaaaataatgtgtcaatcgattgaaaataatatttccatagatttaaataaaaaccaatggttggattatttttttcaaaaattcaaagatttttctttgctttaagaatgccatataatagtttagaagcatctatgcgatgtttaatggatttgaatgtcgcataggggtggggagaggagagaggtttgggtttttctatttaaaaatactaacaatctaaaaaaagtattggagtacgtacatacttacgtgggaggacgagaggtggggttttacatgaggaggtaaaaacagtcacagaaattcccgatcgaccgagcgtcgtttctgtataaggggtactatttccgatcatacctttttggctatttttaaattttgttttttctaatttatttctgcattgtattaatgtcgacactgagaagtttaaatgataaatatggtcagttaccggccgatcgagcatcgtttctgaagagatgctaccgattccaaccgtttccgaccgttttcaccctggaggtgcgcctaatcaatctaatctaacggttgataatgttggaccaccgatttaattgaaagtcgagggatggatgttttgctttatctaatccaatggtgtaaaataatgggtccaccaatttaagtaaaatcgacgttgagattaaataatgccacatggcaatgtatccatcaatttaagtagaaatcgataatcgattacttctttttttttatgattttatagtatttctctaatttaatagcaccaagtagcggtttaaaagtgtttgttgtaagatgtataaagtgacagagggagagttagtagacctagtaggtgaaagtctatttgtggggcatttttgcctgtgaaaataattttggttttaattaatttttcataaagacaaagaaagaaacatatagaagtacgtaggtacattgcacattacgtacgcttgtttgtttgtagaggggagcttccagatgtgatttttactgccaaatagatctaacgatctaaaataatgggtccaccaatttaaatgaaaatcaatggtcggatttatttttttttattagaatgccacttggcgactcgatagcgtttataggaagtttaatggacttttagtatataatagattatagctctcgacgagatctacaattttgtaggtgataactttttcatttgaaatcttttagatattcaaatctatgattcaaatctcagttaggtaggctcaaatggaacgatatgcattttccaacagaattgatgcataggtgagttggtaaaagagagcacgtgtgaaggataggtcttaagttcgaatcctagccaagacacgatatcaaaaaaaataaacagataggatgatagattaatatttgaacttttaatttggtgcgcaaaactattgccacatatggagtggtggcaataatttttattacaacgatgtgaagtgttgcaatatgtctttttgccacatccattccgtggcaacatctaaatttattgctactaaataaaaatcgttgcaataacctattactacgctatttattaccacgactagcaacaattttaaaattgtggcaacatgtatctattgtcataattttagtattgatgccacgtttttttttcgtagcatcaaatgatttttctagtagtgtacctaagtacacttatattttgcactatgtgactattgcttctgtttttataaatatgatttctattttgcagacaaaacaaataatatcttcaatataatgttaagtttgaacccgtcacgttcaaagatgaacatgtacattcatgcatttgcaaaaaggtgaacctacccatcggacaaggtgggtcgatcgacccagctatagcccgtgtcacccccacaccccacatagacacctctagccctcctagcagcatatcctgtcaacccaccagcctgataagtcaacaactgcccatcatcaacgttagtcacgtactccctttgtcccaaaaagagacaactcctagcttcccaatgcataattaaaagagaggataaaggaccaaaacatccctcataaatagcaaattagtattgatggataggtagataaggggtattgaagaaataaaatttttcgatttgtagttgatttattttgggacaaagtttaaattacagaagttgatttattttgggacggaggtagtacgtctcacgtacatggaacgatcaacgtctttcaactccgattggcatcactgttggagttggatggttcgtcttgcaaccaacgccgatgttataccgccgttctgcctgttattttggtgtatggtgaatgttatggagtattgcttcatttttaaatgaaaggcaccatcttagattttttttcctttagttgattggttgtagtactatattttctaagttattataaaataaatatgcgatatatatttgattgccattatcgagttagtatatcttcactctgtttatattttaaagctgtgtactcctagctatagcactaaagaccgaacttagtatggactaattacagcgataaccatcggtaattgctactactccatgcagtacttggtttccatatttttgcatgcgtcggtcgttggaggcaagcaagcaagctgcagcgtcgtcagaggtagacgcatcgatgttgttcttccatgtccttcgaatcttcatgattgccgctctctgcttaattactgttctcttcacgcacaccgtccaaatcccatccatctatccatccgtccacacacctgcaagtttaaattcccatgcagttactacatgaacagtactgctgtcaagtttaattaatttcgcgccgctcctccttctgcctactccctccccggcaccgctcctccttctgcctactccctcccccggcaccactccgtcctcctccgcttgctccctcccccggcgccgctccctcccccagcgcccgttagtcctcctccgcccgctcatgcagctccttccctacacacgctcgctcgcccgcgccgctcctcattctgccgttcgccgctcacgcctgtgcctgctcgcttgcacgccgctccttccatccacaccgccggtcgccggttgtttgccgctcctgcttccaccgcccgccgttcgctgctccttcctcactaggagtagacgtggtgctaacatctccaaacgtcattcatcccatccccacccctatccattctaccaaacaaaaaactagcatcatctcattttataaaccaaacaagtatgtgagatcacccaatccctaaaatcagggatggtttcatcctatcccacatagtccccaaacaaaacacatgcttagttgtacgcaaaacgagaaagcttatgagcacatggtttataactatcataaactcaaaattttggtttttttgaaagaaactaattatatgtagaaaagttttttttaaaaaaataaacatagtttaacagtttagaaaacgtactaacagaaaatgagaaagttaccgctcagatcttagacttaactccatagactcatatgaaaggtcactcataaattatttttcacgaataagctgtttggtatataaatcagctctcggtcaaccgatgaggttgtactttggatacatgtgtgcgagtgcatctttcgtgtataacgtggccctgttcttcccctccccacacacatgaatgtgtgtgtatttaaacggcttttggggggtcacctttcgcaggtactataccccaagagctgaaaaaattgcaaggccggggcttagccatatctgctagcagaaacctgtaggctggatcatgtaccagctgcatttgatgcataccctatgctttagctaaggaggagtacgatcgattcatcaatatcgctcgatcggtgacgacgtcgtccctgcgacatcagatcgtactactgctacagtacagcttttgcctgttccaatcactaaccagcctgcctctctctctctctttgccatggatggctagctagctagatcgatctatcgatgcagagtgattagctagctagctagaattggtgaattgtggtgacgacgagatcgttagcaacagtggccacgagtcaagatgctgtatatatgtatggatgagtcatcagtgtgatgcatgatctcacatctcgtcactgatgatctccagcttgagcttgcgctgaggtgagctgagctacactgctgcttctttgaccttctccatcgatcgaatcccgtggtgataaactgttaactgaggtaattgtaactactgcagcttcgtctctctctctctctctctcacgaaagatgcgtgatgctgatgcatatgcggttttttggatgtactgtttggacggttgcatactgtgcccgttcaatgtcagcatctccatcttcatatgttgctgccccgcctcatctcgatcgccaacttctattgtttcgcttgtgcttatacttataagttaaaatttaaattttaaaatttagttttgaagttaattttaagattttttttatcatagtttatttcacaccattatttgcttttcagtagtttaataacatataaataaaagttatatttataggttagttttgagagcactgctcccgtccagcaaacggtacccccaggtaccggtacccctggtacgaaacttaatttgaccattgaattagagcggggcacgatcgggattgaacttaatctcgcgaggactcagtctcctgcccatgcgctgcatccgcatctgaagtctacgccgtgtcaccgccgcaatcctttcgccctactccgacgcggtgtccaagtgccgtcctcttccggcctctgatgcggtggtgtggcggctcgcctctcggctgcccctgtgcggtacggcagctcgtccttcgtccacggtcacaacttgtcccctcccctccatcctctatgcatctcggctggtggcacctacgcagtctccggcacaggatcacaacaccctgagtttctttacggaagatgtatgagagagatgaagtatttctttcctgctggacattgctttgctgctatattcattggaagaatctgctatgttgatgggagaggctgagtttgatttatgttgtgtgccaagttctggacctagttccttgtcttttgatatatgtaatgaacctacttgattttgctgaaagtatgaatgtaatagtagtaaaaaagtagatgttctgaaagtttgtagtttcttgctctgatgtgtaaactgttctttcgttgtagaccttaagcttactgtttcatcttaaacaaaattaacatcggcggtcattgagcaaattgtcaactatcttgaataaaagggacactattacaactagtgatcccataaataaacttctgaaattcttcgatctcttttctttgcttgcccaatttcttcttgcttgtgcgatccatggccaaaagcctttcagccatctcaatatctagcttcgttttttcttctttctgtcccctccttctaggtttgctaatgctcgcgatccaatgcataccacagcgatgcgattccctgaacaaaggcttgcgatggcgtcggtagacgagctgtcgaggccatattcgccgcgctgagctagtcgccatggtcacctcttcttgttggtgcattgaggtcatcatcatccaggggtagatcgactcccagaaatcggcggcggccggacctggaccggctacgggaagggcaagttgggaatgggcaggttggcgacggttggttgcagtgagggaggaagcgaagtccggcgagattggctgtgccgccgccagggacgacggaaggggatcgggaagagacagattaccgggtcagggacttgtaccgtctctatgaaaattgactaaccacgtaaaaatccaattctgcccttccactagttccatacacgcgaacaaagggggaggtaccctgcaccggattcctgtacctcgcggtaccgatgattgtgggtcgtttgatctggctgaatggacggttacgattgcagtaccgcgtggtaccaaaaattctgctggacagtaaaaaatctctttgatttgctaataagcagtatgaataaacatatgcataagcgaaaggctaggtgctactacttctactgtggaagtgctcatggaggggggccgaatggccgatcgatcgagaaagcattcatccattccattctctcgctctctcaaaagttgcaatcttttttttttctcctcttcttctttttctttttcgttttccagctcatctctgatggatcatctctctctccccgtgtggtaattccgatgtgatcgatgacgcgtgcatgcgtcggagtaggagtacagcctctgttgttctttttggtcttcttcttctacttcctcccaaaaatgcgttgtgagcgagaaaaagagaagcttttttttggtgtgcgtgagtgtgcaactctcaatatttgttgcccgaaatctttcgagtttgcgtctttttgggcttacactgtcccttttttatcgctgcgtccaatcctaatccactatttatgcctaattaattactccgtctgttcttgaatatgacaacttaacttaagtagtggattgaaccttacgtggtactgtactatatatctagacatacattatatctagatatattgtaccaggtaatatctcatatagtactaggatgttatattctctggtactctctaccggtagtacagtaggaatggtctgaattgttcgttattaagggtaaattataaatttactaatataatgattacggaatactttattatttatgttttttttgtctaaatcaatttatggtcatccattttattggcatcactcatattttatcgaaaagaaaaataaaagagaaagaagatttagtcactaataaatgacgattataccttacacctattttttttacaataatgctccctcaaaatttctataaccactaactgaaatggtaatataaatagatctaaaccactagataaaaaagataaactgttcatattgctttctatcagtagcctgggattgggacggaggaagcgaagagagagaaagagagaggtggttttgttttgtttgtccggtaatggctgccgcattggtggtggtggcctcctctcctcttcttttatttcgaacgcgacgccacccacgcgcctccccctcccccctgcggtttccctctcttattcaaaacctgtctcgattctcactcactctcactcactcggactcctcacccgctagctaccccggagcgcgccgcgccaccgctcgacagcggcgagatgggcaaggcggcgcggtggttccgcaacatgtggggaggagggaggaaggagcagaagggcgaggcgccggcgagtggggggaagaggtggagcttcgggaagtcgtcgagggactcggcggaggccgcggcggctgctgctgcggcggcggcggaggcttccgggggcaatgcggcgatcgccagggcggccgaggcggcgtggctcaggtcggtgtacgccgacacggagcgggagcagagcaagcacgccatcgcc

SEQ ID NO: 25892 - DNA, 24867 bp, Oryza sativa
  unsure (1)..(24867): unsure at all n locations
nnnnnnnnnnnnnnnnnnnnnnnnnnnnnnnnnnnnnnaaaatttgattcatactacacttggatgtaaattcttgctagctattctctctgtcccaaaatgaaacctagctgttgtcttgttatttggatggttcttaaatgttttatcattttttaaaattaagatattacaaatacttgaattatgtgaaactattaaagaaaaactaaagctccgggtaaatttgttgaataaaaagcacaatttagattagtctcggattcatgaagtcatgatcctgttctccgacactgggacagtagcatgggaagtgggaccaattatgaatgattttgtgtgcttgttttggttagcttccaggctttcttgacatccaaatctaggatatgtagtactactactaatcactttgttgtggaaaaaaatataggagtatattagttatatgatttcgacaaaactgagggagaaactaatcagtgtatatgataaatgtgctctataggaaaatgcaataatcgagacaagaatggatacatgggttttatataacctggtttattcgaagtgttctataatgggctttattcataagtagtaaaaattaaatctagaccgtctttttcttctaatatatattgtaatgtatatgtaccactatctcaattactgataatagaatatttttctattgatagtataactcataaatcaatatttttctgctggtaataacagtagaatctaagtaacattagtagagaccacatctactcagtttatttaatgttctacaacttatgaagttattagggacggtcatagcacaactcatcgagattttttcatggattgagggagtttgaggtaatggtttgaaggagaccaagacaagtttgcatataacgtggtaacaagattgttttgcccttgggcaggggcagcgggggcgataattatatacacaacaagtaagacggtgatatgagtatattagagtcacgcctgtgatggaaccagaatcttattcctaagcctagtgctaaattagtattatttatataattttatcttcatgttctaatttttagaattttaaagtacaattttaatagatatttcaggtcgggagtgggattgcacaaccctactcctatatctgcctctaagtcacaccatttggcagatacatctagggcatgtttggctgtcgttcccgcgacagcgctgctgctgcagcgcttgtgttgtgcggttgcagttttgctgctgctagctatcgtgcagctgcaaaaaataccagccgaacatgcccttaaacctttgaattttctctaattgagaacactcagattagttttgaatttaaaattttattcccacatggaccattcctttcattatttagcaaccatttaaatagctctatctgcttgtgattctttcaattctctagcaagaaccaatagcctattagtttcgcttgtacttatacatacaagcaaaaatttaaattttaaccttaattttgaagttaatttggtgactttttcattgtagtttatcttcaaacatttgctttcaaatcactaaggacatatgtatataaaacttttacctataaattatatttggtagctaataagtaataagccacactgataagtagtataatataagggaaacaatggggttgcaggttttgttttggtctggaattacatttaaggctagttttgaatagcaaaatcgaacatagataattaaatttccacagttttggtctggaattatgtttattatgtgcaaataggagtttttatttgggggagggggagggtcttagtacagtatgtttgaacaagaattacaaaaggccgaaccttttcagaaatttcctgttgtctctctttgccaaagctttctgaccttttttgtgtcacgtgtgctttatatcaaaaactattttgaaccaaagaacaagctttgagtactaagctggaaaaaggaaatgaaatgtcggtaatgggaaatttggatcagtaccaaaattaatgattattctttattccacggtttggtttgtcctaccgttcactcctcctggattaatatgattttcttgattaacttctacataaaaattttttacacaaaacacatatttagtagttggagaaacgtgttcatggataatgaggaattagctattccaaatagctacttactctctccgtcccaaaaagaaaaaaaaagaataatctagatgagaatttaacactacctaggacaataaatttgtacaacctcttatccatatttattatcctgagtggtatcaaatcatcacctatcttgccttcttttttttagatggagagagtagaactcagcctaagatgatggtacgtgatatggtacggcaggagtattaaccttgcaccatgagttgttgaatttttatcaaagtagagaacactgagattagttttgaatttaaaatttttataaccgtacatggaccattccttcattatttagcaatcattcaaattagccccacctgcttgtgattctccaagttctgtaccgagaggtataaagcaagacttcatttggccagtcctcgactgtgattgtggtgcatggaagcaggttttgctgcttgctgttgctgcagccgcagccgagcatcccctctgttcttttagcgaaatgtaacataacaccagctagaagattaattacttttcttttttgatttgaaatgtttattatctgcaaataggagagatcactccgtttttcccttttttgcgaggaaacatctcagtacttttcaacaagaataaaaaaggttgatgttttttctttttttttattggcgtttgagccgcggaaaatttttaaattttatacttaattttaagttgatattgaggtttctattatagtttatttttcagacttagctttattgctatcaataaattacttttaattacttcatgaagttttccacggctcatcaaccatagaccagatgatgagaggctgtcagaaatttccttgtgcacgtctttcactttgccaaagctttctgaccttttcgttccacgtgtgcttcatatcaacaactcttttgaatgaaagaacaaagctttttgggttttatagaagctattactaattgggtagagattgcggtaacgaattaacgatcactacaaacaataaacctatcatgcagctcgtaggctgttattaaccgggtagaaaaatcgaattgaatcctacatgatctactagcattctagctagctaacacacttgtattattaagtacttgcatatactatatagctagattgggcctcttttcataaggtaattagagtatagagattgtgatatgattagaacaaatactaatgagcatagcagctcgtagctatgggcgctgttataaattggaccgcataatcgaattgaatcctagccatatgatctaccaatagcatttttttagagaaaacactaatagcattctagcttgcacaggctgcacagtactctacttatcatttggaattctttctgtagatcctactactatagggtaccatgcatgtagatatttgacctcctcctttagatgagctaccaaagctaatggcatactctctccgtccaaaaaaaaacaaaccctggttttcgtgtctaacgtttgaccgtctgtcttatttaaaaaaattatgaaaaaatattaaaaagataagtcacgcataaagtattaatcatgttttatcatctaacaacaatgaaaatactaattataaaaaatttcatataagacggacagtcaaacgttggcacggaaacccagggtttgccttttttttttgggacgaagggagtgcagtatatatgggcctaccaaaaacactccaagctttgtgcaaagcgagaggctcccatcggatggcctattcagtcaaagaaaaggccaaaatttaaattttcaaatttaattttgacattgattttgagatattttcaacgtaatttctttttcagcattgacttttaagtcaccgagaacacatatattaaagttttacctacaaatttatttttattctctaataagccgttttgacttattacgaaaaaagccaaataatgaggcccaaagactgcacctccatcttttgttagcttagcctagctagtccagctaaaaaagacaatgtatactccatatatcacggtttgttttgaattcagcttgatttgatttgatttgatctcaatagaacatttgagattcgtgcttggatcggagggagaggggaggaggaggatgaggagcggaccacagagacacaaaaactgtgcgcggcgtgacagagagggagtagggagcgctcgtgacgacgcgtggggcatatcagtgtgcatctctctgtcgctcggtcggactccccactgccaacccggacccacctgctccctctcctccaaagcttatccgatctctctttacagaagcgctcccattggcccaatgcccatcgtataatcctaacaataatattatacttatacttcctttatattaagtttatttttagctcatttattttatctcataataattttattttagattaaccattgcattcgattttaaaaataggaatttgattgtattggctgtagataaagttatggatagttgcattggatttgatagattatggacattctagtctttttgttttttattggtatgtgcggaatgagtgaaaaatgaacttattctgagataggggagtactacttttttcttttgcgattagacgggaaacacatatgcacatacaccgctgcacaagtaacatcatacacacatccatgcaaatgcattatttaatacatgctctaaaagagatggaaacccacctacatgtgcctaatattaattcgtgggaattataattttaattctggtgggtggaatcatgcactcatgactgctcccccataccactggtgttttcccaaaatctcacactattttattccctcgttaccaaaataagttcattcaaaatacattgatttttaagcagaatttaattttatcttaaaaataggttgaatttcatttctcagtgtatgcatcaagaaattttatttccgatgccccttacttatcaactgtcaatattgttaatgagagtccccctctctgttaacatcttttttagatactagcaggggtgatttcattttaaaacaagggaagcattttaaaattagataaataaattattccgaataaaaataaatttatgattatgaaaatacaaagaccaaacatatgtaatcttagagactatatcaatatccaaaaaactattttaaaaaataatgaagcgagaaattattcacaataaacttataaaaaaataagggtcttaaaaatggataggggtttgttccatatcgacggatttaaattgcctttctagtgcaatttattgatttttttttgttgaaaacatagtgattcaaattcataattgccttattttttttcccaaaggaatgagttgttttgtttgtttgctagtagggctgtatcttttgctcccagcttgttaagttactgcttgtgatcgatttgtcatgtttccggcaactagctccaactcctgactcgggtttgttaagtgggcctaatatgttttcgtttggttgtggggtggtattcaattttcaagcctcctgaggttaattgtagtaaatagttatcgaaaaggattttttttttgccaactcttcaactatatatatatatttttatcaaaacacagtgaggggtccccacggttttgataaaaaaaatagaactaaaataatatacaaaatttggcagatgccaggaaagaaaagaaaagtcaatccatgactcaaatctggctttaaatttcttctccaaaaagaatcaaaaggctgaatttcctgaaaaatcttaaatcacaccgtaaagtcttaaaaaacagaggacgaagataacatcatgcaaaatcgtgatgctggtgctatgttgtcaatatcacacactttcattttctagctatgtatgacacatagccagaaatgcctatataatgtcgtacttagccagaatgcttatatttcaaaatggaaggagtacttatactaatataggagtatatactgacaaatttaactgcaaaagataaaaacaattattaatacatttgcatacatgcaatttaggccccattcgcttcattgtttggaagttacaacttcctcatttttcattagcgcacgtctcaaattgtttaacagagtgttttttttaaaaaaaaaacaaccttgtatatgatagtagaagtttcttttctaaaaaatcaattaaacttgtttttcaagtttatagtaattaatattataattaattatgtgctaatgatttgtcttgttttacatgtcaccaggcccggccctgaggaggtcgagctgtgccaccgcactatgccctcgaagtcgagcggcccaaccccatatatgtatgctatggatataggagcccataggccataggaacttagatttagaaagcccgggagaggaagatatacaacttatttgataagaatgtttttttatgtattacatttgttagaaacatcattatattatcagagttgtattaaagagcctatctttctagcttcgctccgggccactaaattgacaggatcggacctgcatgtcacaaagttaccacaacgaatggccgaaaataactcagcttaggtcgtgttctatagtcccctctcccaattttcacttccttgtttttcgtgcgcacattttccgaaccattaaatggtgtatttttttataaaaaatataggaaaattgcttttaaaattatgttaatctaatttttaaagttttctaaactaatgcttaattatttatgcgctaatgagttatcccctttcctatgcaggggaaaagttcccaatcagcatatcccaacacagccttagtagtagtactccagtttaaaacatggcaaggaaggggttgctttgatactggcacacaaatcatttcatgttccaaatttgaatgtgatgctatccagatccatatgcaccccatccatacattataccaccacttgagcatgtgagatagtagaagttggcctgaacacagtcaggactcaggacccagggagagactctggccactgctgttgcctattgctgctaactgatctagcagcagcagtgaactgaaagtctgaaaatcaccctctattcaaccatccatgcatgttttgctctgtttgtgaggggctacttgctttcttttcagcaatgattaggttctgatttgatagatgaggaggggatagatacggtgatgctgatgctggtgtttgttccctggagtacattggggtagtactgccacatttttgttcttttctcaagattcttgtccttgagctctgttttcctttcaccttgttccaggccggtctctgcacctttccaatcactccgttctttgcatttgccacttgttggttttacatttgacatccttttcaaaggagggactttggagggtttttgaaggaatttgatctaaattcaacaaaaatcattaatacccctaaccttctgtcttagtacgtgttggttggatagagacagagtaacatgtcctaagggttattttcgtcggaaacaagacaatgtcaaaaccggtagagacaattgggcataactcatcgggggttgaacgaattgtgccatttgtagtatctaaacaaacctttgtgttagatcagtttttaagatatggacataaacttatacctcattagaaacacataatttcacaaaaattctaaatatagcttaacatgaatcgatacatctacaagaatcaaagaaaaaatcttgacatttgagatgagaccttataatagtttgcgatgaaacaagtcctaccagttggtcccatgcatgaaccatgggggaagaaaacatatggccaatttggttatcatcaaactttgttacaactggtgtattgtttggttagagaatgagcagtcccaccattttatctacggttaattatgagttatagagcttgtttgggggagcttctagctactgcagcttctctcaaaatcagaagctctcccaaacagtctagcttttggtccaaattctgagaagttgcagttgtagaatccagaaaatgaactagaagtcagaaactgtaaaactcaacttttccagatttttagaagctggctaccaaccacctgcttttcagaatcttaagctcccccaaacaggcccataatgcttattagcgaataaaaaataatttatgattacaatttttatatatgtattattagcgacaaaaagccaagctaaaaaaactactatgataaaaaaaatcaaataagttaactctaaaattaagacttaaaatttaattttgactacaactgataggctgaagagtaaatgatggagcatactctctatatcccataatataaggcatggtcaaaattggcacggtctccaaaactaatttttagcttaaaatttctcatatactataaggtttgtaacaacaaaattataaccatatgaaaataaatttaaatctcaatctattgatataatttttaacaaataaaattcatttcatattatactaaatggtggtcaaatgttttaagggttgaatcttgaaatacgtgcgcgccttatattatgggatggagggagtataaagtaataaaacatgttataccacaactgatgatatctaacctaatcacaaacctaacaaactatgatacgtctaatatttgatgcgtgtgataatatgtggcagataattaaaatcaaggacgctacaatgattcaaaacactcagcacactataaaaaagatcaaatcataattactcttagattatactccatccatctcatattataagggattttggatggatttaacacatcaatagcactgtaaatctggtcagagaaggtgtccaattttatagtactactccctctatcccaaaatatatggcacaaccacttttctatcgtcccatagtataaggcatgcatgcatgcatacatacattaattagcatctcttggtcctataaaattgatttgttttaaatcttatatcatcaaatctcccaatcacattgcttgtatgtatcaaggtgatccaaccaaaaagtcaattaaatgttttttctggtctttgtgtatgagtggttatgccttatattttgggatggagggagtagaatgtatcacatttatctaaaatccctaataatataggatagatggagtatttaattggttggcctgtattgtgaatggatgatggagcagttgggggtggcaatggcattgcttcgatcccagctagggcagcacatggaaagcgtttgaccggtcggcaaaatgcaggggctgcatatgcatgctggctcgtttcaattcaattcggcggctcaggtctcgagccccaactacacctcagatatcactagtgatgctctctgcttgtctagctaatgccaccatcatgcatatcttactcgcataataatatatataggaggaggagagtatctcagtgcttggggagatgggacaagaaaagagcaaatttcgccgaattcgaagcctgaccggaccagacaaggctttgctcgcttgtgttagccccacactgtctgcataggatttgtttatttgagcaattgtttaatccttcgttacaacaataaacctatgataacctgttctttgaagatattacaaccatcttagatgaaaaatatataaaactaaaaagaaaattaaggaaaacggaagagtagagagatggtattacaaatgaccgcagccacaatgctaactaattcccgcatgtccatacggatatggataagtacctgtcatcattttcattcctttgatagattagcaactgacatcactaaataagtcaacaattcgaactataaagtcgacgccatttattggattatcaataacctagctgattagtccttctagatcttgatcaaagatgtcactaataaagtagacatcgacaaagattcatagaagaaaaacaagctctacatatctaatagattcatagcactaaacacgttatttcagaaaatcctaaaaacttatgcttggttagaaaaagagatggaaccccttcccccttgccgttggtgagagggagaccagggatgcaacattgtctcgagagtcatggtgtcgacgaactgttcaatatgtgtaatttgtcgtggatttgggtgacttgttttgattttaaaatgatattggatcaatagtagaaattaggtgtatcaactacgggctttacattttggaataaaaagctattatgataacatagaaactccgtgatttttagaaacttcacaattcttattgaaatttgaacatgttttcgctaaaactaatcaatcttttgctaagtttaaacaaattattttttactcgagatatgtcagaatacactggtacaatattgtataggccatactattagcaatagtgcaatttaatcaaatagtggtaaaaatgaaaggtttggttaactagggttggcagtggcgcaagagatgggtggttcgacttgttcaatttgttatggattttgatgacttattttgattttaaaaagatattggattaatagaaaagtttaggtggatcagtattttactgtatttgtaatgaaaaaaaatattaggataacgccgaaactctgtgatgtttagaaacttcatttttattgaaatttgaacatgttttttttgccaaaactaataaaccttttgctaaatttaaacaaattagtatcttttttttttctcaaggtacacctattgggacccaaaaagtataactttgtgagccctacgatctatgtggaaaaataaaatccaagaaccagcttagtaagtgcctgaaggatctatgttcaaatttcaaaacagagtgagtaatttttagaaccgtgacttgaagatcaaaaactatcaagtgcaacaacaaccttctgggagagacatttgctccggaccaacaaaaaaaatatctcgaggtaccggtacctcacggtaccaaattgttttcaatcgttggatctaacaatgcttatcctgcctagcaagatccaacgatcagaaacgatttagtaccgtgaagtaccggtacctcgagatattttttgttagaccggagcaaatctctttggaagaatttgagccaagtgcccaaacatcattagcacattccaaccacaccaccagtaaaacccatatcatatcaattttagatttttttttaagataatagataaaatctggcatttgctttatcagaaactacactcacttataacatatatttatttcttaggtaaaaaaaaagtataacagtatcagtttcaaataactgcaataaccaatgggccctcacaaatgggaaggagtattttacaacccacaaacagacaaccactgatgcagaggaacgcatcataggatctctcatcatactagcgatctgtgatccgtatatatggccactgattttgtctggagaaaggcaggaatatgggtaactgttatccactgcagtgcctgtcctcagtgtcctggatacacatttacacatactccgttcataaatataaacatttctaaattatttaacacatattaagaataagtggaaagactttcgctcatctcttaaatcaaaatttaaagttttaacttattagattccctttctaagcacctaacaattactgataatgcttagattttcgcacattagaaccggtatcttagaaatacttatattgtgcacaaaatataaattacagatgtggctggctgcatccatcagccagcccagcccgattctgatgctgatcgattgatgaactgaaagctgatgatatcatcttatctcaccaacactcgcacgaggcctgcactgttctacacacagatgttgtgcagccgctagctgcttcttctggcagctagctaagccttcaaatttcaaaaagagacacatggaatcatgcttgcgtggattaaacattgttaagcctgcatctcagatgaacaattatgtacatgttgatcgaaagaaagttggaaaacaagaggaaggagccactgcaagaatgcaggaagaatccaagaatttccaaataataatcaatataatgggatagtatttgtttgtcgcattctctcatctcagaaattccatcctcatagcataggggtaccatattttggatgcctttttttttcctctctctctctctctctcttttcttttgccttaagccatcaaaattcaactgttcatgtcagaatttaactcacatctatggtcctaaaaattcaaaaaactttaccatattattaattgttcacctaagttaaattaaaggcacttcaattcttgtcgtaagtgtgtcatttctttacaactaatgtcacgtactactatagtacttaccacacagtactgcctgttcatacagaagtaattataaacacgatttgaaaatttttaatattgcagcgtgactgatatcatgttccaagttcttcctttgatgtatataggcgatatattaacacctaagtacacgtactttttaaatcttgttaactaagtctgacatggggttagttagttctgcactgtactttcaaaactttgggattctctcatgttttctactactgtatttcatagctactactagcttctaacagttaatatgatcatatagcactaatattttactgctactagatggttttaattattttgttcaaaaatttgtggtgctgcagctgtaacaaaccggcatgcatgacgaacgagatgctggctcttagtgttgtccttaaatttgagcaaattaagtagtaggtgaatcttccacgtagtacgacgccctgagattaacattggatcaggaagctaagcatttaatttactgtgtattattactatatcaggtgtgtacttggttttagtgaagagcagctagatgtacttcagagtgcctaatatgggtagtcttacaaattgagattatataataatatatataaaagaaaaatgttgtttgtgccctgtcactgttgtcgatgcttatgtcgccaaaagatgaggatttttactgtataatctactggtaagtatatatactactgacaagggcaatttaaaaaaatattaaaaaaaagtaccaatttaattaagtatatacggatttatggaatctcggcacgcaatgcacaataggtatacagaggcaattctaccgattttagttttatattgtaatatattcaaatgagagggcaaattaatctaaaccttttgatcatttatactggcagaatactgtaaaagttctcacaactgtttataccgaaccacgagttaaactacatttctgtttccagtgttcaatctctcttgtagttttttatcttttcaactttttgtttaaatataataaaactctaaaaacttgtttataaaagattttttttgccaaaccagctttatgtccttttattaagtacctgaatgatttgtaataattatttgagatacaaatgaattaattaaaaaaatataaagttgaaaaataaattaaaaattactccctccatgctgataatattagtcgttttgaacaagggtaaaatcaatctttaaaatctttgactataaataatttctaaaatatttgtcttaaaaatatgaaaaccatatgtgtagtttagtattaaaaattacttcaataaaatcatatatatttgttgatatttctaaatatattataatagaaatagttgtcaaagctacttttttggagaccgtgcccttgtccaaaacgacaagtattatcaatccagatggagtataagaaatttatatatataattttttgagtaaatatttcttaaaactacaaatattttgattaaactatcgcaaaactacatatttaagatgttacatcataaaactacatatttaatattgaaattatcacaaaattactaattctagagtttaaatcactggcactattgttatgttggagctacaaacgttgttgttttgcgataattggcactaaacctgtagattgggatacattttttactttatttttatttttttttacaaccatcctaaatttgtagtattgtgaaaatttccgcgctaaatgtatagtttgtgatgcaatatgttaaatctacaattttacaataatttcatataagtatctacagttttatgaattttacttaactttttagcaaatactccctccgtactcgtaaaggaaaccgtttaggacaatgtttaagtcaaaccttgggaacataaatcatgaataactctcaagttgttgtgtttgaaaatgtaaaaattatatgaatagatttgtcttgaaaaatgctttcataaaagtatacatatatcacttttcaataaatatttttatagaaacaagaaattaaagttgtgttttggagaccgtgtcgctgttcaaaatgacttcctttacgaacacggagggagtaaatgtttagaagtttgagaagtgtgcccgtaaataggatggttccgttcttttctctctctctccctctctcttttaaaaaagaaaagaacacaaaaagttaaactgcttggatgatagggtagtcttggaggatgacatgtcaaaacgatctaatccggaaataagttctgcagaatttgttttcaacatttatcaagttcagaaattataaaaaatcctcttgtactttaataaaatatttcatccacttagggtgtgcattagcatatgattaaaattaaatagtgggttaatatgatttttaaagaaactttcctatattttttttaaaaaaaacatcgttttatagtttgggcagctagcgcgtgagaaatgagagatttgatattgggaatataaacttaagaatacagccttagtagtataccaccacctttgttgacaggtggtaaatgggtaattggcaggtggtaagtgggttaaattagagttatgtatgacataccatctttgttagcagcaaatctgccatgtaagtactgcactaataatttactctctgttcgaatatgatggagatgaggattaggtaagaacatgtaaaacgagaaatccattattacgtgattaattaagttttaatatttgtaaacttaaaaataattctattcgatattttagaaaaaattctagaaagttttcttacaaaaacacattatttaacggtctgaaaaaaatggctaacacaaaccaagatagaatctactgtacatcattcaaccaacagccaaactttctcaaaggaaaaaaaaaaggaaaaatccggtatggaagcatatgtgcaaaatgtaccacgcatcacacaaggagcagagagacagcattgaagctcataacgacgagccgtacaagtacgaacggtgttgctttgcttgctgcactctgcaagatttatatttgctggcctggtctgatctctctgcaagatttcgtttttatggctcctggggtattaccactgtaggtttaaaacaagcaaagcatgggtcactctgctttcttgtggtccagcttcttctgtgactctgtgtgtgtgtgtgtgtaactactgtttctctagtccttctcggtttccttcaaattttggtccacagtccacacacacaaacaatactgttaaggccaaaaagaaaacattgggaaatgtaagggagagggtagagagaacataagggcaatgtggtcactccatgatactatttcatctatttgactatatgtgtttattttgtaatgacaagttttaaagtgatctctactgatagtgtaatcaatttaaatccattatattttcttatctaattcattatatctatttatacttacaaatttagctactagtactacctttttttctaataacagtaaaactcataaatcgatggtttatatcgtttctaagagtaataatactggtggtagaatattagtaataggccacggtctaaattaaagataagttagagtagaacttctgttcaattgttcttttttctctcttctactcttcttaaatactacgtttacagtctaaatttaacacaagttcagacggttttagcttgtaaatatatcgattttaaacagaagatcatgttcaagaaacatatctgacgcttccattcgttttttttttcttttgattaacaggagaacaaaatatcctataagtttacagagacatagtaatccagcagagagagtaattgctgaagcagcagcaccagttacactgaacaaaaagaagcaaaagattcaatgagatggagattgatcatgtagccgaattaatacttttttccatgagcaatgcttcaatcagagacatttgaaaggactcccaattgattagccatatctgcaggcataacaaactttacatattcttttttcccttctgaattgtagtacattacatgagtttcatcaaccaattgtaggcttgttcaaatttcactgtcatccccaagcttaacccgggtgcattggttatttattgttgttgcacaaaagaatgcttaatgcactgtgctgatttctctgtctgcctgttcaacatatctactcggagttaagagcctatttttcagtcaggaccatctctgtgagagagacagccagcacaaacaattgtctgaaatgtgaaagaaaatctgttcatccaggatgcgtttcagtggccttcacttctctgctcagctataactaccatggacaccaaatggttcaagaatttgccaatgtgcaaagctcaggataccatgaaagttattctaccaatggtcaaatgcgataagtttcgaacattgggaatatagaatatttggaacacaggaatccaatatgaatttcatggttctcgctcctgtagaattcatgtgaaataacgattcaaaaaagaaagaattcatgtgaaagttcttatttccaattgggctataatctcttcatctgaaaacaacatgggtagtcaccttgtttgacaactagtgccattgaacactttgtcaataaatcatgtgaaaatttgcactactattaatctgtacaatcgtacatggcacacacaatcatacactcctgaattctgacctgcacctcctgatcacatagtttggctgatgaacaggtgagaattaaacgggcaggcatacttcctgcaattcagtgtgaggaaatcaaagggaatgtgctgttggtgtacctgaaaaaggaaagataatatacagtatacaaactccacaatcattttttttctcagaagcatgtgagagagaaataccttgcaaaaatgtatcaggaaatgtcaggctctgaattcatcagttctctcttcctccattcctcccaacaagagaatttactgcaaaacaacatatggccactccctctcagttctcaaggcacactctatttatgaattccccttatctgaatcacaaatactagtggctgctcctgctcagttcctaccagaattcagattttgcgcacacaaccaaagcctgcattttcatgtgactttgtcatggcaggaagcaacatcataataagttgctgaaatgaagatgtagggaggatggtacagcgatgatggggtgcagcaggaattgaaagcctgggatcattttctgacgaagcctgcagtgaattgatcaagagcctgccttatgttgctatgcaggtagtagtagacatgcaaaacgttggtaaaatgactgcctaattaaatggtttgcaagatcgaaggagaaatttggaagacaaatttacttatggttgcattgcgagctctggattagcattgcagctatgaaaaccaaaagaaaaaaaaaactcccaaatctctccacaggtaggatgaaaatggaacaggtatttcctgcccggccgccagaccagagactcgtgggaaggatatgaaagagaaatggggtttgaatccaaatccacaaaaaatattgattaggatgtgaaaatagttgtattcgtccgtttatcccgtattatcaaacatatatgaaaatttattctgaatcaacctacaaacataatggtacaatggttaatcactattttataagctcacaagtaatattacataattttttccttgatgtatcttctttaaaactctaattgcctccctagacttaatatctatgaatcaaagatacaatagaaattcgttcccgaatctgactcagaggacaaaaaaatatgagataagataaaggatgagtgaaacgttatccgggactatccgtacctggttctaaatttaaaggaaaatataggttaatatacgagaatgtcgtgatccaatcgttcctgacctaattttaccaccacaggaagtcccacattctcctgtctgttcaaaatttccgctacttttctaaaatattgacttttcatttcccatgtcattcgaaatgcatcataatacatagagctaacttcatattggaagagattgatcatttgcatgtaccacttccctttttctccctttgtatacatggcataaggttttatggggaatatgtcacatacaaataatataatccccatttttatacttctgcaattttttttcttgtgatagaaaacccaatttttttaatgagttgagggagttggttttgttagcagagaagaagttgtaaattgggatttatcgggccccatatcagaggtaggcccaagcggggaggaaggaggcaagtggagaaggggaggaataggatacaaagaagtgaggggataaggtggaggaagtggagcccactaacatgtgggtcctactattttttaatcttcttatttgactgatatgtggacccacatattttgttttattttttaaattattaaattttgcttcatgtgtcttgtagatatagaccgagtcaaattagccacgtaagtgccacttcagctgaaatgatagttgaaaccgtcttgggatttattttgcattggttttgatagttgaggaacccgttttatctggttttccggttgaaggacgaaaatcagatttgttgagaaggtaagggacctcagatgaacttattccattgaaaagtcgaatggcaaaaaggtaaacaggcctgaatttgcagcccacaatccctggcccataccaaaccaggcccaaagaaaacgtgccggttgattccccaatatgggcctcaccggcccatcttggcaacagcccattttaccacaggtaggcccaagggtaagcccaacccagtggcgcccttctgctttcattcatagctaagcttccaacggcttcctttcttcctccctcccctttggcgctctcctcttcgcttcccgccctcctctcctccaatcctcgccgcctcctccccgaaaccctagcggcgctcgacgaggcgggcggaatccggcggatgcgtggagcttcgcggctcgccgtggtggtggggagagaggagggggcgtcttccccggttgacggagtcgcgtccgacgaggcgggattccgggagggaggagagcgcagcacggcgcggcggcggagcgagagattcccgcgcgtgagaggagcgcggaggagggagcttcttcggttcttccccgtggagcgcgcgcggctggagcgagcgagcgaggcggcgtcggatcctctcgcgcacgcggtttcgctggggattggtaagttcgtgctcatcacaacgtttctgatgccattctgcacgcagatgtgctggattggggattcttatggcggcttgattgtgtgcgcgcgcgtgggttggggattctacacgcagatgctggattggggattcttatggcggcttgattgtgtgcatgtggggggtacattgcatattgattatgtgtgtcatcttctcgcggctaatggatttgcattctgcattctacacgcactagattgcgggtggtagactctgttcttatcgtgccttccgcggctaatcgatttggtgggagacaccactgtggcacgattgatgcaaacgaatgctaaatatttggattagttcatcctttatcaatcagctctgctcaattgattgttcaatatgtcttaaatgcttattgggtacttcgtaactccaatgaagttataactatgaaatgtttactgtaaatatcttgtattctgttattatggagtatttatcaaagtacattcaattatcccttctatttttttgcttctaacttatgcatgtgtcctctggagataatattatgtgtcctctatcaagttctaatgactttccttttgatattgtttgatgcagctttattgtgatcctatataagtggtcataaaaatggttgttccacattgctacatttaccttatattgcctcttctatggataacaaatgcatccgccgttaccatcttcaatgtgaattatatgcccatggaagacaaggtcaaaggccgcaaattatcagtagctgatatccacctaggtggaaatgtacttcaatctgggtgaggaactttacatgatctatgttctctctttctctctctctctatatatatatagatcaaccgtttgtgcacttactgaattctaactttggttgcaacaattcatttcaggaactattatgctgaactgatacttggtgagccaccaaaaaagttcattgtgttgattgacaccacatctaatcttctgtgggttaattctatatcttgtaaagattgccctacaaaaagtgcatccagagtaattatctactgctttatttttcttaacctaacaggtatttggaggtgactaaatattctgaaccaattacacttgtgtaggtcctgagtttctatgatctggagaattcacagactggacaacttttaccatgtagtgatgttttctgcaaacacctatccagctccacatctattccatgccaaaaagaccatccatgcattcactttgaaaagtatggcactgaaaatttgctccacggaaaaattgtccaagattttcttgtacttgaaattgtcatcaaccattacaaaacaagcaaagtcagaactaaagttcaatttggaagcatttctcaacacttgaaatccttatcctcaagctttacagttgatggtgtgatgggcttggggccatccaatacttctctggtgtaccagctggcaaagtcccaaaaatggaagaaaatgtttgctcactgccttgatggcaaaaggagtgggggcatatttgtgttaggccatattgtgggtccaaaagttagaaaaactcctctggatcaaacaaggtacttgacattgttgtttaatatgactgtggtgtagatgtattcttaattgcgaggtgatattgactatggagtatttgccaacgctgtagttctaggtaccgaactactttgctggaaataactgtaggagaaacttctctaagcctttcagctggaaatgttgagataaaaagtcaaaacatgacaatattggaaactggttctctgatttcttacctgccagagaaagtataccagtcgtttctagattctgtaagaaaattcactttcctctttcagcaccctttgctacattcattttacttgtcaatatttattgtcatttttctgtacagatattttctgatcttgaggatatcagtgtcataaacattggaggctattcatgtttccactatgaacgaaggtaaatatgtttatgattttagagattattttttcttcttcggaaaaaatggcatgtgctttctaagttcttaggaaacattaatggtctatccttttttttgccctacattaacatcatgttccatgagataagaatgtagtttgttctataggtaatctgttcaagtaattagatatattaaattttcttgctgatagtgatagattaactttttagcaatatatgaacatctttttgatacattttggtgttgattgcacaatcttcaccaataaattgttcaaagtcacagaataacctcctctctctcactggtctggggagtggcgacatgttttgacttaatggggctactagtcctctcagtttttcatcttgggaacaagcgtaccagtttagctagatccatcaaacaaccagataactaatcaacatgttgtttttgttagtattgatgctaggtttccagaggttgtatttcacttcaaggaactgcttactttgcgagtctaccctcatgaatatatgtttcacaatatggaggtatttcgtaaagaaactatgctgttgctcaaatatgcactgagaaaatattgtgatgtatattgtgttataaactgtttctctttaggagcactattactgtcttgggtttttgagttcagaacaaaggaatcatcgagagaaggacttgttcattctgggcggcaagttactaagcctgtactagaattgtactatttgatggtttgcatatttgacttggtggtaggtggtaactgcttcttgcgattataaacctgtggtgcaggaaatttgttcactgataaagttgttgtatatgacttggataatatgatggttggatggaccgaatttgattgtaagtcctgtcaacgttttagcttcattgactttcaaactgcaaccagtaaaatgttgttttataccaggttctttcgaatattgtgtgcactgtatctgttcaggtaaatccagtgtgcatgtgagagacgaaccgacaggaaaaatatatgaagttggatcgcacaggatgaactccgatgtgaagtgggatgatgaagacgtgtggagccatgatagagtgaagttggaaactgaacatacaactccagctgataacacgtctgagaaaacagaagttcacagtggactgctttcacgttcaagaaccaggttgcttgcgatgattggtgctctggtgtgttacgcgagacggtcaataaccaagctgtttgcgatgattggtgcgaccatttgttacgggattctcttggccacgttgttcctctgcaccaccttccgtcgatctaccagctggagaaatatgagtatgctgaaatggttgttggctctagttgtgggggagattttggttatcattgtagggttcatagttttgtagacaaagcacatagacattgtttcccacagatatacagttttgaagaaaaagttttacacgtagtggatgacacatacaactgcaaacagccagtttgtatagtaccgcacaaaacactgaaacagggggtagagaaagttaactgtacatatttccttcctgttaaaatttgaatgttccattgattgtaaaactgaaacgaggtttgaataatggttggattgagcctgctgcctgcagtgcaaaatcgtgttcagttttggttgtgaaattggtatctgtaacttgcaatgtttgccgtattcgagaagcttttgtttgtgtaagatcatctgatgctgttcgtcttgtgaataacaataaaatctttgatgatatcattgatatgtatatatacttagaaaaaatgccaaagcattacaacgggtaaatgatattttaattttattatcgttatatggtttagctagggtaaaattcactgtgtgaatttgcatgaatattttttaaagaaaatcatagactgtaattaggagtttgtatttcatctcaagttagcatgcgggtttttttaaaagagatttcttatatgactctttttgtattttcaaaaacaaacaagcttaaaattcaactcaaatagggatatgcatttccaaaagccgcagagaaattaaaaaccgactcaaacgaggtaccataatagtaatagagattactttacattacatcgttatgatctcttgttggctagagatgagaggatgaatgtaacaggactgcaaagaggacggaggaagcgggcgagttcatcaatggtgaatccgaatccgaatgcatcgtccgcgagcagcagcgttcccacgctatggaagagccaggcggcggaggcggcgccgagcgtcaagtagtggtgcacgccggcgacgccgcggcggtcggcgaggcgaagggtgacgacggcggccgtggtgctgagccagtagagcaggtttcccgccaagaagtagcgccaccacatcccctgcatcctcgccgcgtcggcctcggcggcggccggcgttagtgcggttgggccgccgcagagcgggcgtcggggcccttggccaggtggcggcgcaggcattcttggtgcacggcgcggcggcggcagcacgccggcgtggccagcgtgtcgcccaccttgaactcgccgaggcaggcgtggcaccaccgctcggccttccgctccggtgtgcctcgggcagagcggcagcaaaaaaaccgcgccgtcgtcgtcggtcgccggtggcaggtacagctgcaccggcagccattcttgcgtg

SEQ ID NO: 25893 - DNA, 388 bp, Oryza sativa
tttcttaatggcataggggtaaaagactctgctggaggcacgacttacacgcaaaatgcgcaattattctctgaaagaggatgaaccacgtgattaacacaaccagccactaataacaaaacacgccttcatcaattcgtaggccgtagccagctcgagcatgctggcaaattctcgcacggtctgacgaaatcacatgaaagatacgtcaaacgcccacagcaacaatccacgttcatccacccatcaattccaccctcctcccaacggcagcaattcctcaaaaaactgagctgaaatggacatggccaagtaaacaacaacactggtcagagttaaaaacctataatcaattggcgaagcagcaagaaagggtaccgagctcgaa

SEQ ID NO: 25894 - DNA, 655 bp, Oryza sativa
tagaatttacaaagcttggacgggaaacaagatcaaaaggaaccaatttttttcttgttttaattatctgtgttttacttttgaaaacctccttatcctatttatgtcgaggttggtattgttctggtggaatggtggagtgagatgaaggttgcccctccttatggggcaacatatttaagaaacttccttgaacaggctcatcttcatccatgctctctgtttaaggataaaagcaagttttaaacatatcatgaaaaacggtacatggtgtataaggaaccaataggtaataatagtgctcaataccaaataatgtcttgatagttggccgctttgacttggaactcttcttcttcaactcagctgttccataagcacaacattttttttcaaacaaaagacactaaaaatgcataatctaaagaaaggcatcatcatttacaatttcattagagagagagagagagtgctaaccaattcctgcaacctcatcatcatttacaatttcaaaattcttatatgtatagccaacaaagtttgcatccttggacggaagcatctgcaaaaatagcagtgctcttcgttttagttcattggctaagaggcaatacgaaaatgaaacatctctaattaagcatgttaatttctgcct

SEQ ID NO: 25895 - DNA, 678 bp, Oryza sativa
tgcagtcatagtaaaggaatgtggtatcttcgggtaaaggacagtttcttccttgaagcaccatcttgaaaaagggaaagtttaaggaaatgtaagtctctaatgggcaggaactattttgcttttgttatttgtagctatttccatgaagcactgattgtccattctgcttaatcttttctctagcagtttcagatgttatacaacttgctgattgtatgtctgaaattttatgaagttatactaacaattttcatgctcaactacaattattcacacatatttaaaaaatgtttactgcagtttgtagtgtatgttgtagaatcttcacacatattgttcattggaggaatatgtaatggttgcctttttttttgtttttgaatttggaacatctttttgttgaacttactgtgcgttttattatttaattaaaaacaggcttgctgaatcggcatcttatgagcttcacttgtctggttgggtggatgatgtccgtaatttcatgcacactataaagagacgccgtctacaaaatacaggcacgcctcaagatagtgacacaatgaggtactttgatgtgacatttttgtgcaactttatttttttttctaacaagattctataggtggataagctcgtatgcctttattctttggttgttttgctagttatatc

SEQ ID NO: 25896 - DNA, 895 bp, Oryza sativa
taataataatcctatatggggtagagctgtgataacatctggcagtgccagtatatttctgtataggaatcaatctggagtgcaattatgcatatctaagactcttctagtagtgatgtgactctcctctttcatgcagcccaacgtcagaagtttcgcttgcccatttgttggggtatgttgatgtttccattgtgcaaatccagctctgaaagtgtcattgttttgaaaattcacaccgaaagtgaaagggatattaaatcgattatgtgaattagtagttatacattactacccacgaaaaaaaaaaagacctccccattttcttggtatgaaaacgacagcttcacttcgctgccacacatggataccacttggtttccaccttgttgactccaaaataaaccttttttctaaacgtagttaagttagatcaccaaactataaactgctagtactattcagagacaaaaataatccaaaaggcatgaaagaacaagcaaaataattaactatagttattactactgtcaaaggctaacgtaattaggagtaacttgcatttcgctcaaagctacaagctcaattcacaaggcaaaatattcaaacttcgacaagaaaacatacaaaaaagaatttgcaagatgatacatattttacacatctctaagcatgaacccattgatccgatcaccgaaagcttttacaccggcgaactggcgacggcgaggtcctcgctcaggtcgccgttgagctcgtcgccggtgatccggtcgagaacgagcacgatccccatggcgaacgcggcgtcgaacccggcgcgcaaccacagcacgaacacgtcgcgccccatcaccacgtgcgcgtcctcgtccaccttcctccggacctccgc

SEQ ID NO: 25897 - DNA, 701 bp, Oryza sativa
ccatagcatagtggccaggttccgaatcggctgacccaatatcaggttgttgccacgtttttggaacctccacctgctgtcgatccaatacagcagcaaccgattcaacagacactcccagttcaacaggttgtacaaccaatccagcaacaggttgtgcacccagttcagcaaacaccaccaaggcagcagcctatggagccgattcagtagacgccgttaagacagcaaatcgttcagccgattcagcaccaaggttcaataagcgcattgcccgggtttgcaacgcttggtggtcagcctgtacaacaatttttaaatcaagttgtcccagaacacttggttcaccacatacagccggatggcacagtaatgcctcaagttgttcctgagcacttagcacgtaatatctagccgaaccttcataattactaagagggcaacttgaattatcaatatcagcctccttccccgcaagcccaatatcaactagggggactggctcaaccccagtttgcgtctcaatatggtcagttcgagcccatgcaacaacaggcacagggagcagctcagcaacgaccgtgggccgatgtgattgctgacgtaataagggaacagtttgggcttaaaccaaaagagagtggaagcttgtatcggcagccttaccttgagtggtttgagagagttcctcttcccaatca

SEQ ID NO: 25898 - DNA, 674 bp, Oryza sativa
cctagtcacccatgcttcatagtacaaagcatgcactcaaacttgtaggaagccccagacataagatcaataaatgtccaacaataagcacctagtcacctactcattccagtctgattcatgctttatagtacaaaagcatgcacttaaacttgtgggaagccccaaacgtagtatgtctaaactcatacaggtaaaatcaagtatgattgtatgaacacagacttctgacatacaggaacgagtaaaaactatgtctatcaggatagtaatatgtacagagaaaaagaacgcaaccagtataagttaacaagctgggaattggactcctaccttggttagactcagagaaaacacacattggtacaaaatccttggacatattcaaggagtaactctttggtgtattgccagtgttagtttgagccatctccatcttgaactgccatgccaatagcaccatgttataatgaatgatgtaactataggcaccacaagcaaaaagaaatgagtgatgaaactaacatagaacggggaacaattatcaaacagagcagagcagtatgacgtatcccgctctaattaaacctctgcactcttcaatgcatctgattctgtctagcaattcgcaaatgggaaatcaactgaaatgttacccatccaatcaatcgtat

SEQ ID NO: 25899 - DNA, 3831 bp, Oryza sativa
ggagttaccccgagaaaattgttcaaacttcaaacgttatttattcttgctataaaatattactaccacaaagtttctagtggaatggcagatcaacataccatcgcgtcgaagacaaatctctggtatatttttcacttgatcattaatgctgtcattgtatactctggtttcaatatcaccctcaacataaactgcagaactgaaataaggcaagaacaaagacagcaccaaccacagtaaaaaagaatttcaagccatagaactaggaaatggtatatagttgtatacttgtatggagaaaagaaaaagggtgatcttctcactgaaaccacgtacttcttcaccagcttctggacagcaaaagcacctagctggtcattatgaatggctatccgatgccactgagctggctttggcagatctgcatcccctactaccctctggtcaaacatgccaccagttccaactgtaaaaacagtcactgtacgaccattccttaaaattttctgcacaggaacctgtccgacttttccgcatattatagcctagaaagttgaaacaatcaattaataccaagttaagcttgaaaaccaaaacatgaagtatccttttcatattatacttaaataccctgtgaacaccacggaatccccagcccttcttggggtctacgctttggggttctaactctcgtcttgaatctgtataatcatcatcacctcccatttcactcttctcatcaatatcagaaaaggaaacagtagaactccaagcttgagattttctgtagaaatctacacagacaaatatttaatcaaaacttactcagtaaaaactgagtagaaatcttgaaacaaccatgaaaaacaacccaccaattggttttctctgctgttctaagaccctcctcaagcccttcagtaatccattgctgagagaattcatggtaaatctacgcacattgaggaaaaacgttaaataataaaatcataaaaataatcatcagaacatatatttttttcctattcctttaatggatttcaaaacaacataaacatcacagtcgtcaacttcattcaacattttcctggtagcagttctattctcaaaagcatttgttcagtgtgaccttctacaaggaaaaaactacatgaggaaataaggtgcatcaggatggcctatcacgtgggagacacttattctttatgatgaggcatcccaggtttgtctcaacagtgcagaggagttccatgacagttctgcttattctttcctgcacaaaaacaacttatggtcttattcagctacagcagctccattccgttggaacctcagggacgacatccggccaagacaaggaagctgctctacctgcctaagcggctgatccgcctagctaagctgcagcggcattctaggatcgtagtatccaataaccaccctcttcaggaggctgaattaacaccacctaaaatctaaataggcaatcacagaaaaattaacagcctactggactaaactttgcatggataaaatatgcaaacggtccaagatattctaccgagacattttaacaaacaccttgcaagcatcgcacactggccattcaggggcttcacgcgacgtcgacaacagttgcataccccatagaacagtggcagacccagcccaaaatggaaaactgcagccatggcagagttggaacagtagaacgagctcgggaaaaggacgtaccttcagccccgcgccggaggccttcgcgcgtcgccgagtcgcgggagggataagacggcgggacgacgacgacgggcgcagaccgagcgagcggggaggctatccgtacggatcgagggaggatgggaggaggcggctggcggcgttgggtggtgtccggtggagtcggccgcggcggcgctcgtgcctgggtggagcggaggagcttcgtagcgagatcaaaaggttgagttattgtgaaaactttgggccgggcctggatatttctgcttctcctggcgtaacgggccgaacctgcaccaaagttagtgggttgctgctatccttgagagtcgagacttctgcttctcatcatggttctgggttgaaacttcaaacttgagaaccccctcctcttgtcttgaaataggaaaaaaaatgataaatgcaaaaggtgaattaggtggtgtttgaatcttctgaagatgaagataaagatcgagtgttttacgtaaaacgatgtgataataacgtgtgattaattgaatcttaattattacaaacttgaaaaaatggattaatcttgttgaaagttttcatacaaaatacacagtttaacagttttaaaagattgccacaagtatccaaaatttgatccaactcttgttgagtaacgaaagtaacaaatctgacactgagttagagatggaaaacgttagggtgccaatccaaagagtggtgcattgatcaattcactctagtaaatcaatcttttacggttggtgttaagccaaagcaccatttcattaccaccgggaattagtagtctcatgctcgcgttggcaactcagtaacgaaagcgcatatagcctagtggttacagtgacctaagtagtacccaaaggtcctaagttcaaatctcctatggagcgaattttagattgggttgtttgcggggctaaattccctatctcaatggccgtatatatccggttggatatggaaaccgggtagaaaatacccttctctaaaaaaaaattattcttccctgataagagaggctaacaccttgtcacgcgttggtaacattgcttaattaataaaactatatgattcaattgataaagaaatacggaaacacggggtataagaatatgaagacataatattcttggtaataaaaaaaacatcttcaaagaatcagataaatcctgcatttcaaatgatgaaatgagacataaaaacagcatataaacaacgaaaattatgaataggactatgctctacgctgcgactcccaccaggcacattattttacctgaacatagattccagatttttcttttctattcttttctctaataaatgtatcaaactatccttacaactattcgcctatgcctcttagcatttagcagcagaacgaatgttactgaaatatgagatgtctgcacaactcaatgttcgtgacttcagagtcaacaggttgagtatgttggttatccgaaagcagttaaatgaactagcatattcaagaagcatcagtgtcccctgtagatttcttgtactcaggcttgagctcatgcgttccctggtttggtcctcgtttgttgtaaaaacacagatcattcagaatctccttcaggaattgctgcataaaacgaagcacaaacaatcacaaagcaaccattgagagtaatgaataaaatatttgttgttcataggaacaccacaaataaagtatcttaaccaatgtttttttcacttaaaaatagagacgccaaataaatcaagaatatacctctggctggtcagtttcttgcaccagcgcctttagtgcccaattgggctgtctttcaaaaagcttgaatataatattttccagttccctgcgatccctacgtattctttttgcatcagatggtttggttggtgtttgcttcttcttctcctgaagagcacaaaattaaatgtgttatgagaaactttaactgatgatgagtagttcaagatgaagaggccgaccacatgattggcatttggcaacatggtaaagataaaaaaaaaagtagaggaaatcaagtactgaactcattttataagccataatcagag

SEQ ID NO: 25900 - DNA, 732 bp, Oryza sativa
gactctagaggatcccctgttttttcaaaaaaaaaaatcgtatttgttaggcgagtttgaccggacaattaattataaattagtttttgatgatatgatatgccggatatatatatatgctgtcggtaccttttccattgttttggaggccgtacgtctctaaaatatttgatgatcagcgtaaacgttttgcacgagcttataaacaatgggcggaaacaaaaataaggcaattgggtgattgttgggcatgctcttagtagtaatggccactttgaatcaaaggaattataaaggaatttcataggattgaaatcctataggaaattttcctatgtagccatttgattcaaaggattgaagttttctaaatcctacaaaatttttatggaatggcttattgcatataggttttgaaggaaacttagcaagaggtccaacctcttggtaaaaatcctttgagtccatctctgacggagcgtggggctcctcaccgggagaccgcgcaggcccccctttgccggttcggccggggactcagggtgagattctaagctctctgtatgtggaaggttcgcgagaccggaaacacacaagacacgggcgatgtatacaggttcgggccggtgagaagcggaataccctacttctgtgttttgggagatctgtgtctgaagagctacaaagttgagccaaccttcttccttgttctgggttcccaatctggaaaag

SEQ ID NO: 25901 - DNA, 504 bp, Oryza sativa
tactatagggcgaattcgagctcggtacccttgaccttgtactggtttgtgtgtgtcggtatttcccttacaaaatgatgagttggtgtgtgcgcgcaggcgcagcgcgctactggttcaaagcacagcagccacaccttccgcgaaccgatcgttcgatcggtccagccgcgtccggtttaatataaaccggcacccgtaaagcgattggcaattcaatcggtattggattgatcaatcatcgtcacctcgttttgcttgtctacttcgatcgccgcctccgcagccgtcgtcggagaggaggaggaggaggaggaagaggaagaggaagaggaagaggaagaggaggagtgggagatgaagaaggaggcaggggcagggagcaagctggggaggtggctgggggcgccggtgcgggcgctgtcgagggcgtgcgactcgtacgtgcggaagatgtctgcgtgcgcggggcacatgccgacgcacgcggcgggcgccatgggg

SEQ ID NO: 25902 - DNA, 767 bp, Oryza sativa
  unsure (1)..(767): unsure at all n locations
nnnnnnnnnnnnnnnnnnnnnnnnnnnnnnnnnnnnnnnnnnnnnnnnnnnnnnnnnnnnnnnnnnnaaaacaaaaaaaaaggcaaccattacatattcctccaatgaacaatatgtgtgaagattctacaacatacactacaaactgcagtaaacattttttaaatatgtgtgaataattgtagttgtagcatgaaaattgttagtataacttcataaaatttcagacatacaatcagcaagttgtataacatctgaaactgctagagaaaagataaagcagaatggacaatcagtgcttcatggaaatagctacaaataacaaaagcaaaatagttcctgcccattagagacttacatttccttaaacttcccttcttcaagatggtgcttcaaggaagaactgtccttacccgaagataccacatcctttactatgactgcagacatttcatggcatgaaacaggatttttagaatcctccaaactggcaatagatgacttttcagaatattgctcagcacatgtagccttagcatcaatggtctcttgaagatcagaaaagtgaattggatttccatttccattcgtattgggcaacactctctgtgaattaacatccgtcttattgcaagaaacactaccattagcattcattttaccgggttctggatattttccagagtcacggccattcactgcctggcagtgtaaaccctcactaacttctagcctattgcccgaatgatgccttgcttgccatttga

SEQ ID NO: 25903 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnntttggttggtgtttgcttcttcttctcctgaagagcacaaaattaaatgtgttatgagaaactttaactgatgatgagtagttcaagatgaagaggccgaccacatgattggcatttggcaacatggtaaagataaaaaaaaaagtagaggaaatcaagtactgaactcattttataagccataatcagagagaaatcagaaaacatgtatgcagatccttactacctagatagcactctattaacttgaaataacatccaccacagaaattaaacacctagagttattaagaatgttgatctatatcattaatgataacagaagaacaaaaaggaaatctcaatcttcatttcggaaaatgaaagcaccttagaaccagaaggtatgagaccaaccatgccaggcaacggtatcaggctcattctgtgatcctcaattaccttcaagtagggaacaaaaccacaaatcagaatgctttaaaattacggtaatgtaagatagccaatgaaggactgcagtacttcacctgcacttttctagttttgatcatggacttttgtgtcctttcacggcataactttccatagttcaccaaattatcactgtgaggcttcatgtcaaatttatgctcgacttttccttcacatgaaagtttccctacaacacacaaggtcatctttgggtgatagtcaa

SEQ ID NO: 25904 - DNA, 2717 bp, Oryza sativa
tactacaaattgactcagatgttgttgtgaatatatttaatttggttttttaatcctatcgatagatgatacttgttctgttccaaaatatacatatttctagtgttcaaaatttataccacaatataaatattttttagcgtacttcctcatctcaatggatcacaagttcacaaccatcactccagtcattttctataccatctctagtttaatttctatgcctatttccttctaccgatcatgataattttatatctaatcttaatcggcttaaatttatagaatttgattgtttttttatgaagccgtgctaggagctagtgcttgctatctcataatagctccatggatttcatcggaactgttttatgtttcttgggctttttcgttgcggaattagacctcctattaatgttggctaattggcttattcataagttacatcggcctgccgcttagtcgaaagctatgcaacaagtctgcgatagtttaaaactggaattggcacaatactgcgaagtggtcgtcttcgcttaatttaggtcagaccttgatgctgcgactcaggcattactcaatagatatgcaaggcttacaaaagtgcccaaacaaccacaatacgaaccgtttccaattgaaaaacaaattgttaaattgttatgatttatgctactgtaaacagcttatgtgatcagattttatattttagaacataacttataatttactaccccttcgtcataaaataagatcacttttggatcctcctatttataaaagaaaattttataaagcaaccattgtatcagagtttgtaaaagtaaatgataaatgtattaggagtagataaagagagaaataattacattatattttaatgaagttaacgtattctagtttttttactggtacgtgctagattggtgaaaaataaacgtttgttggtatagatggagcattcaaatgcggaagcgaggctgctatgtaggccacgtctcacgtctgtcaggttcgaaagcaaatgcatatctgtcacaaaacaaatcgtaataggcgcgcgtatatatatgccttcggttaacggccgcgacggccgtcggcccgcctcctccacggtcaccggctagcctgtgagcttctaccgcccgcgtccgcatgagaacgacaggtgctcgacacttggccagcagccagctcgcgttaacacatggccgcgccgcccccgccgccggacacggccaccgattcgattcgaagaaggtacgacgtactgcgacccaagctagatcgatctcctctcgttttcttcaatctccttcattttatactactgcttcgccgatcaaatctgttgttgttttttaatcaaatctgaccatagttgattactccgtactgattagttgtcttgtcctgctgttttacttagtgtacatggtgacagcggaggtaggttaaccggaaagcattttttgatgctgcggcctgcaatcagtactactccctatttctgtattcactcgttcattgtacttaattttttttataattaatattcatattattattagataataaaacataaatactttatgtttagctcaaataaaacaaacgatcaaatattatagacgaaaacgactcttaaaatcggacggagactactcatctcacagttgcggggaccaaaacttgtttagaaaaagaggtgaaccatgacgctcaggctgtcacgctgagcgccctgtgccccgaaggtgggacagaggcggtgccgaaatctagaactccggagcccagcacgaggggaagctcgtggcagtgtccgcgccacgtggcaggcggccgctcatccgtcgtgctcaattgtgcaaaccgttctcaattttcacctgcaattgtttttttttaaaaaaaaatcacctgcaattccacatcatgctgtcatttggcatgttccattccatcaagtgtgattagactaagttaattttgttccgtatgattacagtgacggaatagaatgattctacgagagaacccgtactagtttagttacgagtttatccaacaagtgtattgcatcgaccgttgtttaggttatcttcacaaccgtcggcatccaatctttattccttacttacttggatgatttcgatctttacactagttaataatcgaattaacaagtctctaacttggccactgaccgcgggcggacggcgagccctagctaccactagctggtggccccacaccaccgccaccaccaccacgcgacgaagacgaagccgtataggtgaaacgtgtgtgtatcacggcgtctcccaccgagaaaaggcgacgcgattgcaaccccgcgcgagatcgacctcgcgttccactcccactcctctccaccttcaaatccacgcgagttgttgagcgagagagagagagagagagagagagatttgatttgcgtttgcgttttgcgtccatggcgcagcagcagaggatggtgatagtgggggaggagcactgcggcggcggggaggacagggagctgacggtgaggaagacgacgctgttctgccccggcgacgggctggaggcgtacgaccacgggacggggacgctggcgttcagggtggagacgtacgggcgcggcggggtgtgcggcggcggcgcggcggcgggggacctggcgctgctccgccccgagggggagcccg

SEQ ID NO: 25905 - DNA, 3625 bp, Oryza sativa
aaccaccggcttatgtcagcactagttgaaatggaaaaaagaagggtttgtgtccatcttatggcaaagaatcaatttgagtgccaaactgccaattctatgctatgtgaatcctctgtattcataatctatgaaccgccaccactgttgataccgaagtagatcgtcttgcgactgaaggcattcatagcatagtcgactcggatttgaccaaggtctgtgttaaagtggattccatatccaaatccaacaccaaatcccggttttccttgtcgaagagctggattacctgccaattttacgatgaatgatcactgctgaacagtagtgtacaacagaaaaggaaagatccacacattatcacagaagtaaacatatgtggggtgagaacaaagttaaacgcaacttgacattaggatatcaagcattcaagaccccacgttttcatgaatagggatgagtgtactcattcgtaaggttgtttaactaatctactatgattctgattctatatctgtgctgtatagtacagtaacatcgggagcaatcaaatcatttttctgtcgatggtctaatgtgttaaccttattagtttactctcgtcaagtttcattaagatggattggtcacagttacatcctaacatctcggctaagaaatatttccataaattccactggggacatacatcataatacagtagtaggctagtagctggctggtggctgtaagcgaaatccctcatttactttatggattatacagttcatttattggacaaggctgttttaagcactaatttagtatatcaacctcattttctacttaagtaaaacagaaattagtgcataggaaaacagagggagtgaagcacttaccagggacatgacaagcagatcctaagtcactgccgcagtccatgaaaatagaaccctccagatgctttgccttcacagaaacagatagttcaaatttttatgtttaatctgaatgtataatattacaacgcaaatagctagagtactatgaatactggacacttcgcactaatcatcacaaaaatataggcacaatatgaagctgaatgatttttcagttgtgtaagctccaaagcaccttcagggaaaattttaagcaacagcgctagcttacactgaatcgccagcaatgatctccatatctactagaaccctcagatgaccattatttccctctagtaacagcactagtttcttttggttcgtggctcagcttgaatttcatctctaaccaaccctacccaaaattgcttcagagtaaaggttgttggtgtcatcgtcgttgttgtgttgctgtagtgtttggttgctatcttaaatattttctaaatgatcaatgttacaccactttaaacattaagtaaaacctcaggcatctattcaataaattgccttcaattataaattccatgtttgggctcaatttctctatggcattccaagttttagttacgagctgaaatagtgtttcatacataccaaaggaaccgtatattcacagttagcaattaggcacagtcttcctgcaccaactgcaccctcaccataaccccgtacgctaccaagtccgcctattgcaaatgcttgatatggcgccatgtcccccacaatggaaccacctgtcaagctgtgagataggaaaagattaattacttctgctgaggagtttggcactttgctggagaacagtaggtgcatgcattacctagtaaccaaaaatgttggccccaatttcatgcctttcgaaactgcacattttactctgttgaaggtcagagattttggtacaagtggcaatccttgttccatttggaggttaacctgtcaataagatctatatgataaagtagatcttacagtaaatatgttaaaatatagtaaacacaaacatacttttaagaagctattatcattaacatctgcataaccagactcttgcttcaagataatcatgttatcatggaggttaccactgcatgataaagaaaacaacagacaattataagcaccttttgagtatattaaagttcttgaattgtaaaatactttagcacctgcatgttagaggaaagccatcatggtccctggctatggagcgtccctcgttattaacaggccggatatgctggacaaaaagggcaacagatatgatcaaatgaacttggagaaaagataaaaaaaatataaaaataactaaaggcaagccaacaactggatttgggtagatgtccacctcgaatttaacactggttccggatgtccagtttgatgttgatggttcattaagctcaacaccaagcgacaatcgactaagatttatccctctgctccctgatcgtgtgaagttgtcagccggaaagccatgcaccgctatttccggtgtcattgtgtgctgattgctcaaaccagagcaagtaagaacaagtgtgaacagaagaatcaactaatacaaccaaacaatattttatatgcaaaacataagtaactcttgtatgcaaaacataagtatctcagaagtgcatcaacaatacatacttacataggtttcctagaaaaaaaataaaatagactactagagtatgaaacagcaactagcattctctatggagatagaattaggtgtgacttgtccctaaggttcttctcaatatcctatcagtgcccaagacccactcaactttcatgaaagctaaacatccgcaacaaaagttatgtcacaaattcaagcttcagtccatagtatgagcacatataaagatattatgtttactgattgctctgatattatagcagatactgaccatgtgatgcaacagatcagtatgaagaattataacgcacttgtgctatgtcacttgagcatttctgttcaattccagacaagaaatttacacagatacattgaacagaaagccaacctgaatgacaaatgactgttgtgataaccattcaggccttggccgtctaaaggcaatgacagcatttgattcattgatacccttatccaatatgacatctaacttctcgctcctcccaaataggcttggatgtttgagtgatatcctgtggacacgaattcttaaaatcacagtgccaaatgcaaaaagaagtggaaagacataaacagcaattcagaggcgcagcacatgtgtgcgcccatggaaggcccaaagatcaggcaaaattcaggggcgcttgagcactgagcagctatagaaacacaactatgcgagagcaagcatgcagaacatgtttgacacaaacacggacacaccaaggcacaggcacaagcagaggaacacatgaatacaacctgtctgcgagtgcgcaatgtctggtgcacgtatacaaaaatgaaatttaccaacgagatgcaaaccaacatgcttaccttccgacgatttgcgagaaggtggcgccagagttcctgaaaacaacccaagaacacaacacgcaaacacaaagtcaagtcagacatccaagtgccaccgaaacacctctaataggcaaaagaccgagcacctcatgggcggcagcaggagcgcctcgcagagcatgtgggtgaggtcgacgtgcacatccacctt

SEQ ID NO: 25906 - DNA, 15056 bp, Oryza sativa
ttctaccagagagttcagagcggcgccgacttggatggagtggacaatggacttcggccttcttcttgggctgttttcatcaaaagcgaagaatgcttatgctttggattttggatttttcttttcgagcaagagaattctcctacgaaactgattttagggtaaaatctgtttgagtttatggtttcggtgataccaacattgtgacgtcattactgcgttgctgttgcatactccctccgtctaaaaaaatctaatcatggggtttgaaccgggacaccatccaaaaaaaaatccaatcctagatttgaacctgaacatgtgtgtgtctaagttcaaactcaggattggttttgtttttttgggacggagcgagtatgatcataagtttaaattttgtttccatatttactagtaccgctttagacgtaatcttacctaccaataggttattaattactctctccgtcccatattgattttttatagaatggaggatatatgtgtctatttttctattatatctatgttaaataaattgatgtgttacattgacatagtactatattccgttggcttggagtgttgcttttggaccggaagacttaagtttaattcctattatcatttgtgggtggtcaatttttatattgcacggtgtctataaagacaatctcaccttagtccacaaataataagaagttggaggaagtactaaccttatttagccatatagagtattgtgaagcaaacatctaataatgaatagttatacgtattacacatgatcttgcttcgaacatgatgatatacccgcaagtatcatatctaacaccacacagatattagaaaagcttgcctctaaccctgttgtcgtcaagcccctccaccttgccttgtgtctcgtgcttgccggcgagaactcaaagatgatactatccttcctactatggtcgctagattaggaggtggggtgtgcttttctcatttatttaggacgtgtctgctccatggacaactaactagttcacgcttctcgcgtgggaaagtggtcttccgcagatgagcatagacgacgccaccaagcgaggcggctttgtcattggctagattcatgacaagcgatccgaaacccttcttcatgttcctgttctaaatccaccgctttcctcacccccctcgatgctgggggacggtgttgtggagcaggtgcatccgatcgctgccatcattgatcgtattagcggatacgctgatgaaaacgtcaacgttagctggtgcaacctgatggaaggctgccttgagaacattgtcgctctcgccgaggacacaaccaaacacaaacatgcggaagctatgcagacccacattgtcgacggagggagtaccatgcagggacgagggacatgtcgcgtagcattcccgctaataatatatcatatttattacacttttttacgtatcttgcttgtttgctagaagaaaactttcacacttaacaaaacacaaaactgtttagcattaaatggaaaaaacaagtaagcttaaaaaaaactttcatttcgataacttcaattggaaacttgtattttttattaagtacgcgcttgattgaactacaaatgatgcaatagtagtagccaatcggagtctagatcctactagccgtagcaactctgtcccatatatacaaccgtgacgataataacttatttaaattttatatataggattgaaacacaaatgtaacttatttaatcctctcggccaactaaactttatctgtaaaatctatactacttatctaaatctgatgatggatttgacactgttcttttcagtttattcaccaaattattgaaacgattagttgcttcacactttgaaaaatatgtttttcagataatttttttcacgacattgtttagatcacttttttttaagctacttgtaaaatttataccttagaatgtttggtttatttatataattaagtagataatcgtaacaacattccgattccgtttgataatatataaaccaaacaggtaaaacaggagatgtcataacgcttgagtcgcagataggtaacgcttgtgttcggtatcttgtccaaataggatccgaccgattacactctctttgggaaaacacttgaccaaatcttacccactaccgaacacaaccctagtgcactagctatccgcctggttttcgagtttccaacgagccagaaggaagcccaatttttcccaaaagaaatccacccccgatatcaaaatcccttctccctcccctctcgccgccctcctcctcctcctcgtcgccgtcctcctcctcctcctcgattcgaggggtgccgccgccgccgcagctccagcatccgcgagaggctcgcgttggggatcgccaatttccacgccacggtggccaatcccccgcggcgcgcgctggtgggcgatgcgatcggatgaggtgttggcgacggcggcggcgctgcgtggtggtggagaggaggaggaggaggagggcgtcgagcttccccgcggcggggtttcggccaccgcgcctaggaggaggaggaggagccggtgatggcgcccgccgttcagccgccgccgtccccgcccccgccgcggcggccccgctcgggccctccaccggggctgaagaatctcggcaacacctgctacctcaacagcgtgctacagtgcctcgcgtcgacccctcccctcgctaccttctgcctctccttccggcactccaatctgtgtacgaaaccctagctcatactttcttcctgttctaattgattgtatgtatttgggcgattcgccaggaagctgatatgttcgcctgttggcatgcaggcaagaaggtgttgccgaacaaggacaaggagtgtgtgttctgtgtggtggaacggcagatctcgcggctgcttcggaccgaagcaggggcgctagactcgccagcgaagatcatacgctgcctgccgctctttgccgagcatttccggtggggccgccaagaggatgcgcacgagttcctgcgctatattatagacgcttgtcacaccgctggtctgcgcatacgcaagcggctacctgcgtcaaacgccaatggggacgctggcgaggaggaggtccgggtgcaagggccatatatggtgatgaaggagacatttggcggtgcgctgctcagccaagtgaagtgcctcacctgcaagggagagtcaaacaagaccgacgagataatggatatcagcctcgacctgcctggaagcaattctgttgctgatgcgcttgcccgtttttttcagcctgagatattggagggttcaaacaagtacagctgcgaaaggtacattttatccgctagttagttgctgataaattgtcaagtggttctaagtcgcctaggcagtacggacgtgggcatggcagcatggtgtctagctccttgtcacactacgcagcatgctggaggcaggatggcacctagctcctaatcggactatgcaaccgctttcttgttattaccacgttagactggatagtgacacgtagcgtgagggcaaactaactacttttttaactgtattttggtatagcttaattagggcttgtttttgatgagggatctagatggaaatataattattctaagtccaatagtaatttttttatttagtttcttgaaaaaaaaacacactaatgttttgttaaaaaatctcaaggtattttgttaagaaaaacaagtgtattctggatattttgtaaaaaaagttgtagtgttgaatgcctaggttttcgaatgaaatgtccaagtttcaaaatctgctaggaatgtttttgctttccgcttgattggactgcttaacccctgtggaaaaggtaagccagttacgttttccttatatttcactggaatcaagttttctgttcaaatttcctggaagatttcttatcagggaatgattgatctagtggtcgtgtgcttgcttaatcttgctgacaacggctttaacatttggtacatttacaaaaaagaacctgtgttccaaaggaaattggaaaaccttgcccaatttggaggtccaattgcctttcctatattggcagtggtccatccaataatttataagaaaaatcaatatattatataaaaagcaatcattatacattttacaaagtgcgcactcacttttcacaaagggaaaagtaggtaatagatagctagcctctttaaccttgctcgttgaggtatttcccggacggggcagtttatgcttataaaggaatgcaaccctgccaaccacacctttagggtcttaggggattaaagtgagctcaatacgagaacctgttaatattaactgtgctatcagtttccatttatattcttttcatgaagccactataatgcttgcccattcatagttttgaacttgggtttccgaaattcttcttatgtgttccggacatgccctaacttgcgaaaggcaatttttttttgtatcgcagatgcaagaagctcacctcagcacggaagcaattgtttgtccttagggcacctaaggtgctcgtcatacaactcaaggttatcaatcttcattcctgatatttttattctatagaacttgttattgattaagatatgttgctgatgacctctgtttacttccattctggtttgttgccactagagatttgagggaataaatggtgggaagatcaacaggaacatagaattcaaagagactctctttctttctgacttcatgtataataaaaaccaggttcagaatatcctcttgattgttacattagtatttgttgcttgttctacatgtagttaataatgtcaaactagtcgtggaaacaagttatgtcaatcgtagcaatccatcaagcagtgaccacatgctgcctgtttatgtaattttattgtgctacttttttgcatttatgctacagcatgaagtcataaatctttaaggatcattttttttctgcaattattgttaggtgaactctccaagaatgttgtttaggatcaagaaattctggattatatatgtcttatagttatattttgtggcgtttatgtggtatgaccctacaagagcttcataaagttgcaaagaaaagttccatagggtcaaactacatctggactatgacacagcattttaggattattcttcacttgaaatcactttcatccgcatttttcattgtttgtttttaacatttctgctaatatttcataccaagaatcagatcagtttgttttaattatattgctttgcatggatctgcaggattcactgccagtatataatctttttggcagtattgttcactcagggttctctccagattctggtcactactatgcgtatgttaaggtaataataggcttttccccagtacttaaagtcttcaattattttgccctgacatctaactaaatgattgttgactatgctcaggatgctattggtcgctggtattgttgtaatgattcccatatctccccctcaagctctcaggatgttctatctgagaaggtctacatcctattctatattctgagtaccaaaactcaaaagcctagtacaaatggttactcttctagtgcagctaaatcttccaacagcaatggaaatggcatatcaaatgccacatctaatgagcccctgaagataccactagtaaaacagaatggactatgttctagtaaaggtattgcaccgccacccctgaagaatggcaagattgcaccaggtatgcacctcaagccaatccacttgaagaataatggaacggggaaagtttcttcaaatggcaaggcaagcatcattccgggcaataagctagaagttagtgagggtttaacactgccagcagtgaatggccgtgactctggaaaatatgcagaacccggtaaaatgaatgctaatggtagtgtttcttgcaataagacggatgttaattcacagagagtgttgcccaatacgaatggaaatggaaatccaattcacttttctgatcttcaagagaccattgatgctaaggctacatgtgctgagcaatattctgaaaagtcatctattgccagtttggaggattctaaaaatcctgtttcatgccatgaaatgtctgcagtcatagtaaaggatgtggtatcttcgggtaaggacagttcttccttgaagcaccatcttgaagaagggaagtttaaggaaatgtaagtctctaatgggcaggaactattttgcttttgttatttgtagctatttccatgaagcactgattgtccattctgctttatcttttctctagcagtttcagatgttatacaacttgctgattgtatgtctgaaattttatgaagttatactaacaattttcatgctacaactacaattattcacacatatttaaaaaatgtttactgcagtttgtagtgtatgttgtagaatcttcacacatattgttcattggaggaatatgtaatggttgcctttttttttgtttttgaatttggaacatctttttgttgaacttactgtgcgttttattatttaattaaaaacaggcttgctgaatcggcatcttctgagcttcacttgtctggttgggtggatgatgtccgtaatttcatgcacactataaagagacgccgtctacaaaatacaggcacgcctcaagatagtgacacaatgaggtactttgatgtgacatttttgtgcaactttatttttttttcttacaagattctataggtggataagctcgtatgcctttattctttggttgttttgctagttatatctttttgtctggaaatgtttccttcatgttctgcattattgccccaattcaaccttgatccataactatgcgttgctagaattttggtatttcgtggctgcagcatcagtattatagttttagttactgacaaaatacccatgctttgctatgggtaaaagaaaatatatattatgtcaaagacatgtttgcttatttgaatacatgatattcatttgattcaaataaacattagactattgtataatatcagaaaatataagggactaatttgaaaaaagtacaaaagtagtggtgcactagtgtcttttatagtactctctccgtttcggaagccccacactgccacacaagtcatacgtcaaacatgattcaatggcttccatttctcttctgtgctattgcttacatcattcaatggctctaatatttgtatatttctctctttttttggcaatgcagaaaggagctgataagcgaatctggaagaatatttaggtcaaaaattccagaatcgctgagggagcatctcattcaagccctgcggtcatattaccaggacaaattttcactgggaggataaattttgtgcggcggttcattagaaacttaagaaaatgtatctgtatttaccattttgtagaatggcaaattgatggtggatgtatgttccatgtggtatatgtttgctctggtaattacctgtttgccttctttatttatttattactatatattgctctgcattgctaacttatcttatgcttggcggttcaggttcaacggaatcctgttggtcaactaccagctccttgtgcggcttatttttgaggcatttttgttatccaaatgaggttgagacgtagagtggccaaattacatgtaaaatattgtcttctttttgctgttgctcctgattctataggcttaaacaacaccaacaacccccattccttcccttctgtctagaatgtagaaattgttttttcccttctgtacaataatagttcgcagattagcagtgtatggggtttttgacctttactgaaggaaaagcccgtttgtggcttcagtactgggtttgttctgaattagtgtccattgcatagaattgctggtaaaatcatcagaatataaattatccaaaagcaacatgtcgtttggacaattagacttaggacttgttaggtatcgcgccaggacaagcatgaatgtttggttagctaggggaaaaaatagcttagcatagcatccaaacaggcctacatctattagttaccatgttcactgtgctgatcatccaattgccattgctttgactttgcgtacagcagcacggacatttgaacatattgctggttggtgcgtaatgggataagagagcatcgaaaatgaaaaaaaaaagaaaagaaaagggaagtagaacaataaaaaggggtggttcatgtttgcttgtcgctggcgtctgaattgttcttcgtgtctgcatcattttcgaatcggcgcgtgtaagctaagaaagcggactgaaaacctttaaaatcggatatccatccccgttaatcattgaatcctgaaaacaaatgttttgcatgcattgtacatcgaactatcaatcgacaatcgttcgccatcccacataaattgcatcttgcctgtttcaaaggtacaaaaagacaaacgatcatcttcaagtcctcgaaaacctgatgctaacatttccaagatcaaaacggtgtcacgagctcgaattatttcggcaacttgcttttgtattgttggaagttggctggccagcgtctcctaccggagcaaacgagccaaggagcgcgagcgcgacggcgagccgctcgatcccgcgcaccgacggctcggatccaccctgccgtcgccgccgccgccggccaaccaccgcgggcattatccggtattccggtgcagcgcgcacgtagtacgctacgtagacgtgagctggtttgtcacctgtcaacctcgcgctgagacgagcggcagcatcgccagcgagcagcatcatatcctaccgaacgaacgcccatccaccaccaccgcgtttcacctttcacgccaccaccgccggtgagctgtgtgatgggccgtactactgctggtgtgtgttgatttgatgctctcacgagctcgtggtggactggtggtggtgtttgtttacacgctcaaagattaaacaaatatttgccgatgggtttgttggtcagtagtgtgtagacaaacaacgcaattatctatttcgtccgttttaaaatatttatatctaatatacgacgggatactattttagtataataaatttgaataaagaatattctagcattactatgtggtaatattttagaacggaggttgtactcctactgcaataaaaaaataacataactcgaacacgaagtcgtcacaaaggacctgcctgcttcccgtcggcacatccctgttcctgcttccggcgtgaatctgaacttgtttttgtaagaagctgttgtgcttaaatgggggtacatagtctaagggttcctttaatctgacaggatgaacaagatcatttcaagaagagcatgcaaaagtttttattcacttaacaaaggaggatttacaaatgcgaattacagttcggttatcacgatgatcggccgtatcgattgagttggtccagatttataaaccgccaggttcaaaacaaattcaaaccaaaattttaacttttggtaaaatttatttgagttctacccaatttcgtcgataaccctagctttaactgcagtagtaaagaagtacttactgcacttaggctgagttcggcacttcatttccctaactcacttctttcgttttacttatacaaaagttgctttaaaaatcatattgatcttttttttaaaaaaatagctatacttaattaatcatgtgttaaaagaccgctctgtttttgcgtgcaggggatgggttctcatcttgcactgctgaacacagccttactttgtctactagagtattacttctatttcaaaatataaaaacttagaatcggattaaacacatattatctaaatttgttgttttagaaacactaaaatgtgtattttagagtgaagtcggtactagcctctgccttgcctagagattcctggcggtcctggagtaggtacggcgccggtaacatcccatcagccatcaccaggagtccaggaaaaggaggcaatcagccgtctcctgtctcccccgtctccgtgcgggcaccgcacggcatctgcggcatctgcaggcgctgcactgcagcagcagccacccccaccacatccaccaccattttccaagggaatccccacccgaaaaggccgtgaaaccggtcgttttccccgcaccccccacctgcgcctccacctgcgatgccaagccggcaggcagcggcgccccctccctcctcgagatgccaaagcacgcacgcacctgcgcgcgcacacgaaagcccgcggcctcgcacggctcggctcggctcggctctcccgaaggaaaggagaaaagaaagacggggagagaaaaaaaccgtgcgctgcactgcaggcagcatcagtgcatcaccaccaactggcgttcgcgtcccctcgctttatccaatttacaaatggtctttattaaacaaaaccgatggttttcttttgaccctttttgtcttcattaacacaggaatctcgcgtgtattgtgacagatatttgtgtcattatgtgcatttcttgaaatgtttttttggggtataatttcactagtagtattttaaattggtttttaggctaaaaagtgagtagcatcttttgtccctggataatttactagaccttaataggagtattcagtacgattggcattagtgaggatttcacagtttttaaataaaaaaggagagaggactgacaatttgcagctcgcaccgacactgcatagataattggcgtcttcagaactgacaaaactgacttttgtttttaaaattctctcttcaaatttgtttgtaatttgagaaaatttgagggatcattctgcattttgccgaataaaagcgagtctgcaagagattgccaaccgtccacctctctctctctctctcccacgccacgccacgccacgcttctcctcctccagatccggttcgcctcgccggcgatggccgaagatccggcggggtcccgccgctggcggtgcgacgccggcgacgagcacggctgttggctctcctcctccgccggcggcggcggcgacgaccacttcgaccgcctccccgacccgctcctgctcgtcatcttcaaccgcatcggcgacgtcaaggcgctcggccgctgctccctcgtctcccgccgcttccacgacctcgtccccctcgtcgactccgtgctcgtccgcgtcgactgcgtcatccccgacgaccccgcgtcctcgtcgtcgtcgtcgtcctcgccgtccgccgcgccatcctcccctacggcgtccgcgcgcgcgcgcaccgttttctcccagatcgcgcgcatcgtgctcggcggcatcgtcaagcccatccaggcgctcggccagatactttcccccgccaaatcagcctccgtcctcgcagcatccgtaacctcctccccctcctcctcctcctcctagtcctccttttagccgccgcttcccggtgacgtgtcgcaccactcgccatcggaggtgctccgctccttcaaggagctacgccgcctgcggatcgagctccccgccggcgagctcagcatggaagaaggcgtgctgctcaagtggaaggcggacttcgggtccacgctcggcagctgcgtcatcctcggcgcctcctccgccggcaaggacggcggcgcgggagcagctcccgctgttgactgtggcgagtccgacgagacagggagtattccggagtcgttctacacgaatggggggctgaagctgcgggtggtgtggacaatcagctcgctgattgctgcgtctgcgcggcattacttgctgcagccgatcattgccgaccacacgacgctggagagcctggacctgacagacgccgatgggcagggagtgctcaccatggacaagtggcagctgcaagaactgcgggtgaagccggtatcggcatctgggggctcacacaggacgctgatgccagcgcttagcatgcggctgtggtacgcgcctcacattgagctgcccgggggtttggtgctgaatggagcaacattggtagccattaaaccaaccgaggaggcaacaagggacacggttgggagtgggattgctgggtctgcaggtggatgctgggtttcagatgcctttgaggagccgtatcggacagccgtggggatgctcctgaagcggaggacatatagccttgagatgaactcgttctaagctgatggcaatttggaagttctatccgtgaggtaaattctgcactgcattcaatactatgtttgtctaattatcttcagcaattgctgtttgcgatgccatgctttggcttctcacattgtagcatttgcttcaacaacattgttgcttattcgtggaaaaattaacacgcgctcaccagtataaacttgcatagtagtaaacagcacgagtcttcgaatttctgaaatttggtttatgaggcttgccatgacttcagttaggttgtcataatcaaacaaaatagcacaacctttcgctaatttgaatgcgaggttgtaaggagttggaggagatctgttgttttagctgactcgttatatccttgagtcttgtggttattcctactagtatatagcaagcttcccgtatcagtttacatgatctggatatgcatttcttggctgccaaattaatggaacttgattcacatcatatcttccactaacatcatgtgctttgaaaatacatcgttttccacttgacatctaatcacgattttctgtatccagcagtaacaaatgaacaaagcatcattcatttttcttgaagaatactctgtagctgaaagtattcttttttgcggtaggcacaataaccttcactgaactgcactgaaataaataaaatcactcatcagtggtgatgtacaaaacatatatcgagttttattttattttttgtccatgttgcttatgagaattgttcctgtaaattctgagagtctggcaatccaccaagtttacatccagaaacaaaggggcgttgcatgagctactgtctttctttgcaactagtagaagcaaaacaacctagatgaccaaccctctttacttaccttaatgtattgttacagggtatgaatcacgcataccaatatgtgccacggtctgtaatcttttgttgttttttcttaccattcttgtataagaactgtagtcatcaaggaccatccattccattgctagtttgaaattatgcaattagggaatagaaaagtaccaaaaagggttaggctattaaaaggtgtgtatggtttttatggtgagaatggtgttccaacatttatgatctatgtactgatcatttgattgtacatcaccaccacggaatcgtggatcacccagtatggccccacatgatacatactttacttctaaataactaattacttaaccagttctcatggtggaatcttctgcacctccttgtattgttggagggcgtgtcacatgccacttccttaactcttgagattcgttttagccgtagatctgctgcacgagagaatagaaagaggaaggaagatcccacctggatgcaggatccacttgttttttttaaaaaaaactttatagatcattttgaaaccctctgaaatagtcccctttcatttcgcaaattgcaaaaaggaaacaaaatcagcaattttacttaagaaaatgtccaatgccttgttaactcatgcatgtgcacttggatacttgatgcaataacaaagatatttgaaaagcagagaacatatattatgtttgcattatgcttgttgtgttttgcaagatcaacagttccaccattccactgtatgtttccatggtgtagtagtaagctttaagcaaccaatggatttgtttttggcgtgttgctaacatcttatatttctctccttttcaggatgttaatttattgcaagttgcaactcaaagtactacgcggcataagaaatggagtagaagttcactggctgcctgttttactccggcacacgccctacccagacatgctgcaagttcttatttaacgcactacttgtcttgagcatctgtcagcaaggacctgaacggaggctatacaaccgatgatgacgagaagccgaacatgcatcctagtttgttggaattgctgggctactcaatgttgagcttgttgtttgcctctttgaggaagcccgtacctctcccagacgttggtagcacggataatttgtgccatgccaagctgttaagtgctaatcctaatttatcttccagtactcaggagtcctgtaccgtactttttgcagaaaaagtttgtagtagtacatgcgaggttactctgtttctgtacatcaatattcaagggcacaactagcagaatcttgtgtaattgagcactgacgtacgtagcattatcaattatgcagtgaatccaagtgcttacgcatgcatgtgtttttcgtcgctgcatcaatattgctctgcgttttcctcatgctgctcgatgtatgtcgtctcgcgatctgcgaacagtattttggattggatggtgttgtttgtcgcgcgtatcggtgagaaactgagtataatggaaagccagatcgagatcggtggcatcgccaagcgcaagcggttgcctcgcctggagccggacgacggtcgcctctggtcgagtgcctcccgtccgacgcacgcgggatatccgtgagctagcgccgacggaccacactgcatatgcttcgcgatcgatcacggattcgcaggcgcggagggagccacagcccacagccatgtggcacgggacagcctgagctgccgggggaaggatcatgaagaggaccttgaattcgttcgtggatgctaacaatcttgaacattgccaaaacttatctccactgcaaaatttggtaattatcttctaacataaagctcggcaaaagtaacaaacaaaatacaacttgtgcttctcgaccttatcaaatattgaga

SEQ ID NO: 25907 - DNA, 16929 bp, Oryza sativa
  unsure (1)..(16929): unsure at all n locations
cccaaaaaggattggtaaaatttgatataactatttaaattatatggaaaaaacactgaaacatccactcgagagtttagaaccattttccgtttattattgtgtcctcccgatgtataggaatgacagatctatcttgtgtatctataattgtcgatatattacctctttcgggatcatgacaaatcacatatatcacataactatctcgatgtccccggtcccggatcggtatagtgactgtaagttaattaagagctactcaccgtttgatctaatttagacaggacagatcacacacaaaaccactgtttatggtcctatattgcaagagtgcgtaccaccgtttgatgtatagcaagctgtagcatgacacgaaacgttgtttacgttaccgttactgtatctaatttaaacggatcaacggttggtatggccgtttatacgtataccatgagcgatccgtcacgtttagacaatgcatgctctatcactcgcttgcgaatacataattccgtcattagcgattaatcagccattttctatttgtcggtcgtataatagacgtgtacgcttgaagctcttatatgaagagcggacgggaatcacaaacatcagatttcgattaataatcgtccatattttgataattaagttgtttgatggtacgtaccctctccgttcgtccgacatatccgtatctctttgattgttgaaaatcggaatgtacagacgaaattgctttgcatttctcgagctgcaaatcacaacagagatctgaatcgcgacgtctcttgtcccttgacccagttagggctggatatcgagccagctcggctcggctcggctcggcctggcggctcgttatcctaacgagctaaaagtctagctcggctcggctcgtttgtaatctcgagtccagctcgtttggctcgcgagcttgcagtcgaggaggcatcgaaggctcgcgagattagatgatttttgctaattgagtgctcatgggaagaaacaaatcttgggaagacccctccaaccaaaataaaaccaaaaccaaccaaaatccatctgcatttagctcgacaaattaatcgatgggaaaaagaaaaagaaacgcaaagcaagtgatccccaaatcaagcaaagcaagagatccccaaatcaaacaaactggagtagaaaattaaacatttaactcccaacttccagctgcatgcaaatcagttcactcatcaatggaacaaatggaggcactggcctctctgcacgatgatggatgcaggacgcaggggttgcttcacgtggatttggcgatggctccgcacgacggctgacggtgcttggcggcggggacttgcgcggcagtagggacgaggactccgcaggacacgacgatgacgatggtggctgcggccgcacccgacgggagtgggggcttcgcgcgccaatggctcggcgacggcttcgtgcttccctcgatcgatgctgtgcctaaagctcaggcagcagccgagcaggacgggctggacggccgacaatgctgccacaagacgggaggagtcaattgagtggttgctattgacctaccacggtgaaaggataaggttgacattggaaggctttatcgtgggtgctgcatcgtgggccttgacacacgcctgggctcctggccagtgatgcctggctcgttttggctcgcgagcggctcgtgagttagctcgagctagctcgttatgactaacgagccgatacatgagctcggctcgttaacaattcctaacaagccgagccgagctgagacgagctaaccacgagccaagcgagctaacgagccatgagcttttcgtccaaccctagatccagtacagtgtcctgaggcatgaggaggccccaacgaattatctgcttcgtttgtttgttaattattaggggatgttaacatgtttagttgctagtcacatattatcacgtctaaggttagacatatttgattatattgacagttgttggttatagtcatagttgtggtaagatttttttttctaataaattgggtcccatatgtcattgatttatgaaagtgtggcaagattcccttagatttgctaaggtgtggctaataatttgatcgtattaacttaagcaagtgtggcaatatttattgataaataatggtaaagtatggctaggaagcaaatacaccggggcccctttgaattgtaggaataaaaaaacgaaggaataggaaaaacatacgattctaatagggatgtaagtgtaaaacagaggattacaaaatacaggaaaaacacaggaatgatcgtttgattggactgcaggaaaaacatagaaattggatgagagagattgtcggtgacatgaggccgggagtatcatgactagaggcttgaggcagacacaatcgcccacgtggcctggcaccctcggggggcgtcgggcccgagggtgatgtgttcgccctcctctttgtctccccgagggggtcggactgctcccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacaaaccggtcagatcgtgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaagcaagatattgtatgaagaagaagggcgaacatgcagattgataaactgacgcgtggtggacaagaatgaccgatttgtgaccggtctgacactggtcatatcgtcagcagacagtcatgttcccacgtcgcgcctgcttccggcggaagtggaggtaggtatgggccgtcccatcagaaggtcattcagacggcaaccatacaaatctccgtccatttatgaaaagataggataagtccccacacaaaaaagagagatggtgcatgtggtatccccttgagatataaaaggaggaccttgcccacttagaaaaggggaacgatccgagaacgatcggggactggacttttccagattgggaacccagaacaagggagaggttggctcatactttgtagctccttcagacacagatctcccaaaacacaggagtagggtattacgcttctcagcggcccgaacctgtatacatcgcccgtgtcttgtgtgtttccggtctcgcgaaccttccacatacagagagcttagaatctcaccctgagtccccggccgaaccggcaaaggggggcctgcgcggtctcccggtgaggagccccacgctccgtcagagatggactcaaaggatttttaccaagaggttggacctcttgctaagtttccttcaaaacctatatgcaataagccattccataaaaattttgtaggatttagaaaacttcaatcctttgaatcaaatggctacataggaaaatttcctataggatttcaatcctatgaaattcctttataattcctttgattcaaagtggccattactactaagagcatgcccaacaatcacccaattgccttatttttgtttccgcccattgtttataagctcgtgcaaaacgtttacgctgatcatcaaatattttagagacgtacggcctccaaaacaatggaaaaggtaccgacagcatatatatatatccggcatatcatatcatcaaaaactaatttataattaattgtccggtcaaactcgcctaacaaatacgatttttttttttgaaaaaacaactggcatgtccagctgtcctctctaaccaaaggtaatccaatttacttgcccaagaggaaatacacagcgtaagaacggagtgttcgatacacagttcacagctcccatggaccggagcgacatcccatcgtcgtcgtcgtcgtcatcgcgtgcggctgatctgcgccatggtcgtcgccggcggcgtggtccttggtacgagcagtgtcagcggcggcgccggcggtggccaagacggcggcggcctgcccctgcacgacgctccacgcctcccggacgtggtgctcctcggtgagcgagttgccgacggcgcagcgcagcacgtacatgccgcccaccacggcggagctcatgtacgcgcgccccgtcgcgttcaccgcctcgaggagcctcctgttgagctcgttgctggccgtgagctcgtcgccgccgacgagctgtgcggcggcgccgccgccgcgcagccggaagcagaccagcgcgaactgcctcggacgggcacctcgaaccgcgcgtcggcgcgcaccatgcgcttgagcgcggncgccatgcggacgtgggagcgcacgacggcgcgcaagccagcgttttcttttcagatgaagacgagccacagggggagcgcgcggaaccggcggctcagcgcgacctgtcagtccttgtagtccaccgcggcgtggtggtggtggtcgcccctcgcgggcctcgccgccgcggtccgcgtccttgaggatcacgtcgtcgtcggtgccaagcgcggcgacgagcgccgccggccgcgccacccacagcgcgcagcagtccatgttggcgagaagccacttgtgcgggttcgtgctgaacgagtccacggcctcggcgccggcgatggcgtggcggaactccgggcacacgcacgcggcgccggcgtacgccgcgtccacgtgcacccacacgccgcgcccctccacggcggcgcacagctcgcgcagagggtccaccgccgccgtcggcgtggtcccgaccgtcgcgcacaggaacagcgggaccctccccgccgcttcgtccgcggccacggcggcctgcagcgccgtcgccgtgagaacgaagccgctctcccggcacgtcggtatctcccggcagttaccacggcgaatgccggcgatgcgcgcggccttctggaacgagaagtgagtctggtcggagcagtagacgacgaggtcgccgatcctctcctcgccgatctcggcgagcttctcgtccctcgcggcgacgatggtgcaaagcatggcctcgcatgacgtccccagcaacgtcccgccgccgcctccggcgaacagcagcctctccggcaggtgcagcgccttgccgagccagtcagtgacaacgacctccagctcggtggccgccggcgaggcttcccacgtgaaagggttgacgttgaggccggcggcgagagcctcgccgagggcgcccacgttgctggccgtcgccgagaagtgcgcgaagtgacgtgggctctgccagtgagtgagccccgggagcatgagctcgcggacgtcgcgcagcccggcggtgagcgcgtcgggctccggcgtcgacggcgccgtcgccgggagcttcccggcgaggaagcctggagcgacggcggggcgcacggggtagtcgttgatgccggcgtagtagtccgcgatgaagtcgacgacctgccgtccctggcgccggaactcgccggcgtccagcgggcggcggccgagtagtggcgtagtagcagctacagggaaggcggcgtcggagtgattcaagatggccatggatggcagacgcaggagccaatcgaacggagaggagttaatagctctggattcgactaattagtggattgtgttctttggataatggctatttataagcacagatagattttccggctggcaaaaaatggtctgcggcagtgccgcaccgcgcgcgtccctccgcgcgacatgagaggaggcggcggactgcgcgttggctcccgttttttccctctctttttttctgtgtttattccgtaccttctgttttcgtttttttgtttttttattttttcggttttaatacgtacgtatgctaactttgtatatgtacaaatacaaactttatatacatgtatacaaagtttgtatactcgtatgctacgtgtattttttgtgttttatacatatatattacaaattttttatacacgtatacaaagtttatatacacatataagtttgtatatacgtgcattttgtgggtttttatatgtacatatatcaatattttatacacgtatacaaagtttgtatacacatatataaagtttatatatatatatattttaggttttttatacgtacacacataaactttatatacatgtgtatatttttttatattaaaagtgtgtacatataaaaaattatatgtatatatacacacatgtatatatatactgcatataaaccatatatgtatatacaaaatttatacacatgtatatatatatatagtatatacatacatgtgctgtagagaagagagactaagagaggaaaaaatgacaatcagcgcccccctggtgcgaaattgctagttcgcgacgcgtgtcccatcacattgctgcagccaagcgttttccttgagttaagccgatgtcttcctcagctcgttggaacggacgccaagccacggttaccgactgcacatggaattgagccgttgtttcatcagaagacagaatagataaggctgattttatctctactttcctaacccacctccctcgttttcacgctcacgcttttcagacggctaaatgatgtgttttttcaaacaaatttctatataaaagttactttaaaaaatcatattaatcctatcaaatttatttttgctaatacttaattaattataggctaaacgctgtttagttttgcgtgtcagagagttcactcccgaacacagcctaaatatgctgctaaccaagaacagatggatatatagattgtaaaacacatatgtatgtctacaaccagtgtaagaaattctggaatgaattttggtcatttcggactctcgatacaatattatttcgtccgatttttttattttttattcttttgtgaatttggtaatattctatttaaatttgatcaacatttgttcaaaattttagaaatttcggaccgaaatttcggtatatcaatgatgtccgatagaatcggccaaacgaaaaattaaaccctgtctataacaccatgttcataagtcacaacaaacaccatattattgaagcatgtaaatccgtttatattgcagaagcaaaaagaaaaccaaaactcttcgggagtagtacaagctacaggttgctatctaaagtctcttctgcaatcagctttcatgtactctgaacaccggctcccaaatcccaatcagctttcagcacagctgctcggctccaattctaaaattggtagaatgtatatttgtggctaaaaagggaaattgaatgaagagtataagttggaattttcttagcacaagagcaattattcacaatatttgcaacaatactattcttgtgccgaagagaaaatcaagccacagagattaaattgatggctagattaaaatgaggaatttggatatttggatcaagaattaaaggatgagtttaagatcaaaggatgggctaacaattaattccaatgagattggaattacttcggtttaggttcaaggcaaaattggaggatttcttggtccataattcataatagtaaaaatggttttcaaactaaattttgaataaaagagctttagtcgaaagaaagtttaatattcgaaacagaattccaacaagaaataccaaatatgtttttaaatgaaaaatacaaaagggactaaataccagagaggttttatgcaagttagttttaggaggtcctgctaattatattttcctaggtttagaaggttattaagaatataagaatcagcatggtgcaagattagaaaatgacacattttcaggatgttacgttgttaatcatagcaaaactatggtcaagtgtcctcaaattatggtcctttatatcttccattgctgatttgcttcggacctagctaaggaaaaaaacaggtgttcacagatgtttgaattcctaggaaaaaatctcctctgcttttccaatgtcccaattctccattccaaaatggatgacagtgacaaaacctatatagggattgaaatcctccagttttcccacaaatttcgtacaaaccaaagtgaccacaaactctagatctccatattcttaattctgaatctgtgataaacctctgaaagtgcttgatatgcctctcaaaggctcacggtctcacctacccccacccacacccgataacaaacatcatcttggccatcgctttccgatcggacggctcggaacacaccaggagtcgcccagagccccagactgatccaccaccacccgcggcgtacgctccacgacacgagccccaagttcggctggtcgccacgccacccatctccatcttcgcccacgcacccgcacggtcgcacgcacgcacgcgccaatgtcgtggctcgcgcgctccatcgcggcgacgctctcctcgccgcgcggcgagccggaccccgacgccgacgagcccgaccacgccggcgacagggcgtcctccccggagggttcctccccgcgtgaccccgactccgacgaggccgagcagcccgacaccccgagccgccgcggcgtcaaggacgacatctccgagctcaccgagaccctcacccgccggctctggggcgtcgcctccttcctcgggcccccgcccccggcggagtcctccaccccgcncgggagngagnaggagaagggtagggatgggaaaaaggagtcagcgcagtcgccgcggatcgcggggatccggagcgatctggcggagattggggggagggtgaggagcggcatctcgatgctgcagagcaacaaagcggtggcggagatatccaagatcgcgtcctccctcctgccatttgggcagggggatgcggacgagggggagcccgtggctggcgtcactgaggaggttgtggtgttcgtgcggcacatctcgaccaggcccgagacttggctcgatttcccactgttcatcagtgagcgctatgcagatggtaagtttcactgccttggtgatgtctcagacttactttgtgtaatttggtgcattagggatggaatgcttgtactttctggtctcaattcgagcgaatttggttgtgatttgtgggaagataattcattggagttgggaaatcaggaaaccctttgctgttaacttatgatttcttaggagggctgtcatgtcaacttgagcaaaattgcgtaaccggtgataaatattctcatcatttcactatataaaaccaataacaatttgaaagagtagatgctggacttggtgatgtccacatgttctgtggaaaatcgggcaggttatactgaattgtgctagtacttatgttggatttgtgcattattgcttgacttgaggagacaattatcagggcccagagttttgtttatgactcatgtttccattccaaagttaacattcttagttgattttatgttccgttatttcgtgcactggtcttcgagactgactcaatagtactaggaagatatgaattaattatggaaattcagaagtaatactaattacaatgacaagatggcttagttccacacaggaaatgaaacagattaagatcatactggattttgaaatttcattatgtttctgttgaatgctaccaagtttattatggtgtattagtgcaagcatatattttgcaagtatagcctgtatgtacactggcttcaaatctcatctttcttttggataatggccgtctggtggactgcatattttttatatacttattaaagttctgtcaatgaattcattgttcaaatctatataatgtctcaagaatatcatttattcatcagaaggtagtaccgtgtttaatagctttaaacagcaaacttcttgaatgcttcgtgtccttttcgaaaatccagctttctttgagaatcaaagctgcaaaagataataatcaacactactattttacatcttgcagtataatactatgtcatactgtatgctaacgttatgatctactccctaacaaatgtgttattttaatagactttgaactttcggatgctcagtatgtgcatgcattatccatggagcaccttgtgccaagcctgtcagatataaaagctgccatttgctctactgatatgagtgaagcatgtttctggaagatatattttgtgcttctgcactcgaaactcaacaagcaagacgctgaacttctttcaacaccacaggtaattccattatcgtgcaattaatatttttttaacaagtaatttatcatggaatctgttgtattccttgaaatgcatgatgagcttcttaaaccaaaataagaaggggaggaaattgagccattccagcttatatagtagtttagcaccactatcttagttaccacgaaattcttgataaccaccctaccccttcacatgtgaaataccttatttgatgacttggttagcgcatacaggttgtgcctagaatgggctaccctcaagtactgttatgtgcagtggcggtgtcggtggactgagaccttgggccacctatgccatggtccaaggcctggaactggcccattaatttgtgctcattatcaccatggataggcaaaggcagcccaaaatagttggctggcctggacttgtaccatatctagttccactactccaccccttatgtttacacacaaataaattgaagggtgtaccagggtagtatacccagtatctctaatctagatgcagctttattttgactagctgggcgcattgtcagttcttgtgttgtaacacagtcaacttctttcctcggtttacattttctgatgccaaggttttagtctgattccacttcaaacattctcttccattcagatcctacaagcaagggaggaattgctgcaaagtttacagactaagaataagcgaggatctgaggttccggaggaagaggaatcatcaaaaactgtgattatgtcctctgcccctgctgaagagaaagtgatacaaccttcaagcattgaaaacaaagctggaaaaccagaggtttcatcgttcgaagaacccagttctgatatctcgccagatgtcgaggctgaaaagttccccattgcaattacagagatggaaatagtagacaagtcggtaattgaagaagagttgtcagtgaaaaatgaaaccaagagtttagccatcgagcccaaaattcattccgagactgatgaagatgaagttgatgaatggcctgatgatgacgacgatgcagaagaggtggttggcacagaaggtaacagaacttcactgggacaggaggaagatgtatcgttcagtgatctggaggatgacgatgacgatggcaataaagggatagcgaagtagctaggcgggctcaaggtatggtcccagactcccagtgcaatcatcactttccgacagtcccataagcacatgctggcttcatttcagtagcggcagatacgcattaagggatcattactttgttattattaggcccatgaagtgatgaacccccaaacttgctcagtctgggataccctgcttagagccgtaatgatagggcaatgcctcagctcgtgttaatgctgatggcgactacatctgtattattgacctctctgcctgtacatagagccctctgggcgtgctgttataacccaaggtacgtactacaaccactgtgtttgatctgaagtttccttgtcgccgctcttttcgtacgacaagagtctactgtttgctcaccgtactttggattatcatcatgcttgagatcccaaatatccgcttcaataatgctaatcatccacacgtgaccgctgagtgttgattgttgaacaaccaatggcgattcatttggcccaaccactagagtagagcactattagtatgcagtaaaactggcaagagatgttcaacggcgaggaaggacggtcaggtcaggtgatcgctgctgccgcgtgaggctgtagacgctgtagctgccttgctgttgccgggtagtataatctatcgcggagccagccgaccgcgccaacagattggcagacggcacggccccgtagagcaacgtagtcacggtcgcacacagcagccaacccagtggagcagcacaaaaccaaccggatcaccggggaaatccgcgcgtctgcggcgcctctcacgcacgcacagcgcgagggaggggagcatctcagcatctgcctagcttggcgcggcgggggcagcgtgagatggagcccatgtgagccgcatctggggacacgcatgggcgccgtacctcgcgagagagtcgcgcacgcaccaaaatccgcacctgacgccgggtgcctgcgtgcgtcgcgcgggccggcgcgcgggggcagtcaaacgcggccaaagcagattaaggaactggacgaggcgatcacatgggggaggggcaaatggcaaagggcaacacaccatcccatgcatgttgcaggcaggcacccgttgctttcaaattcagctctctcttcttctcttctcccggatgccaatacgtacgagatcgcggtgatagcgcatgaaaaacaagcgtaacgaggggggagggaggctgatggcacgtcggtgtcacggcgacatgcgacgacgacgacgagaactcggcgaacggaggagcagcagcagcctagtaagggtgtctgattatgtcctggatctcggagagcgatggacacagggtctctttcctcgcgagaatcggcgccatgtgccttgtctgcacgcgccaccggcgagcattttcatatccattttccctatcacatcttcagaatttctggcctgatatgcagtgaaagctgtctggtttttttatactttggaccaggagaagatggaggagaagaatcactgcctcaaaactgagttctgtgagaagcttctcaagcagatgtgcgttccattgggcaagaaaacaattgctagaggttgaaggtaaataatacaagagccgtgccatcaaacagatgtacttttcagtggagaggaaatattgagtaggtagcttctgatatgaaaataacaattggaaggttaggagaacatgcaccatcaggcaacaggccaaacaaggtttacaggtcacttgtagtatttcctatttgcctccacatggactgttgcaattcaaggagcacacttgggcgtacttgtctttttcaatgatagtaacagaaatcaaaacaacctggcctagccaatgcacatgacaaagccaaagacagcatggagcaaaggccccttaatgaggggctccatttgggagtaaggtaaaagttctttcagaacatactattatcattcattcattcacaaacaacaaacaggaggacaatagaagatgttctgaacaagtgattaattctatatactggatgaaaaaaaaggacaatctgacatgtatatggatacccaaggtaatcgatcaaagtacatggtagaaacatgtattatcttcatttgaaggtaaagtttgttaagagagaagaagaacccatctaggcacaaaagattcttacaaaagaattgcctgaaggaataaaagcatcccacaggcttaatccaaactatatctatctacatctccacagttcagtatatgtgatgaatcttgacccctagaatagggatcaaagcttccatgtgtaagcatcgaacatttgcatcactcttccctttacaaagagccctttgatgcttgcaaagtgttttctttcaaacaaaaaagaaccccattaaactcttcatcttctatcactccacttgctcaccaattaggtcgagaccaacaaccaagaatgagaccccttggaacagaagaaagtagaaatggattccctgagcagatagcaaactgcgagctgctgccgttaacaagaggaaggaaagtgccagttccttcctgtagatcctattgtgcttcttcttcttggagtcctttttaggattcgactcctcctttgttagcgcgtcaagattgggagcagatcctactctttgctgcttggagtgtttctcaactagcccaacaagatcgccctccgaagaacgacctgatttcttggtgacaacccactcataggcactcccgagctggaacaatccagaaatcatggcattgaacttggttacggacatagtgttctcgaaaagaaggtatgggacaatgaatgggaaagattttggggctgggaggatgttcaggatggacattgtagctggaatgtagcatacaacccaggcagggagctcagcttcaggaacaaacattgtcatgggaaggatgacacagaaaagtgtgaatgaatagaagggtaggatgagcttgcggaggaggaagaaaaggaatatgaggttgaacttcttccagaacccaatctgcacaagaaattaggcagcgatattaggttaattatccaatgaaacagtataaaaactgtggactaataggtagaaatcaaatatgaagaagggataaaaaaaacttaattagtatatgtcctggtacgagattgtgataagttctttgatgatttcaatcaagtgaaccgacagagaattcttatggacattggtaacttgcttgagtggttagcaactcatcatcttgttcaattttcttatattgtgcctcaatataagataatatgcataaagtttgcccaaacatgtaaaaaggtaccatggttgatgcttctcaacaactactccatcttgtaaattctcattaaacccataacatattgggaaagtgactctagcaaagaaactacagttacaggctatgctagtacatgcattgctggaaattttagctttcacagtgctacagaagaaaagtatcgtaccttagattttataatgtccacaaagcagagtctgaacaattgcatgggacctgagtgccacctgtgttgctgctttctgtacgcttcatatgattctggcaactcacattgacactgcaagggaaatcacatgaatcaaattattagtctttgacatttatacaatgcagattctgcttaagccacgaagaaattattgattgtacctcaacatcattcaggaagacaaacttccatcccttaagatgtgctcggacagcaatatccatgtcctccactgttgttctctccatccagccccccgaatcctcaagcgccttaattctccaaactccggcagttccattgaatccaaagaagttgaggaatgcaccattcacctgctgctccacctcaaagtggaagcacaaatttacgttctgtagtctagtcagcaggttctcatccttgtttacgaaagaccatcttgcctgaaccaacccaacgtcatccttcccctggaattcaacattcaagatgtcagaaaatataactaatacggttcatagtcatagaagcaaagcaacaacgtgtttacaactgccagcattgttcagttgagtccaaccttgaaatgtggcacggttcgcttcaggaaatcggcttgtggttggaaatcggcatcaaatatgacaacaaactcataatccttcacataactgcaattcatggctgatttaaggtttccagccttgtagccatcccggatcacccggtgccggtatatgatgcgcacgccctcccgctgccatttctccacctcctccttgatcagcgcagaagtggtagcatcatcagaatcgtccaacacctgcaccaagaagtttgactttggccagtccaggttgcaaactgccccaatggattgctggtacacctgcaaacatccagatgaaatggaatcaattgaattggcctagcctctcagataattgagcctcagatttccaaattgtgcgtagcacgctctagtcttaaaaggagtacgctatgctgcccagtttgatgttcaattagcatgtcttctggttgacgacaacatccagacagagaatcagggcaataagtatgcttgaaaggtacgacacccaacggcaaaattcaaccttaaaaacaccaaatttttgctcttgttatagtgtattgagcaagcaagatcacagcaacttaaaacttcagaaaccacccaagttgttgttaatgcagaacatctccgggtcaaagaggaacacaggtcaaagatccaaaccaatctaatgcagagtctacacaaaatcagcagaatcctcctgctgaattcgcgcagaggagaactagaactaagggatcgaatcccaattgcagctaaaataattcgaatattttgatccaggaagatacaaatgtacatatagcaagagaatgaacagccaatctgaaattccaacttaagagggcaatggagcaaatgattggagctttgctttgggcttacctctctctcgttgcacatgggcatctggacgagcaccatggggtagtcgccggcgccagcctcgacgtccggcttgccggcggcggcggcctgcggcacgggcttgatgcccttgaacctgatccagaagcagccgaggcacaggacgaggcggtcgatgctctggaccatgaagagggcgactcaggcgttggtgaggaactggagcggcggcgcgaggtagtcgaggcggaggcgcatccacccggcgtaggaggcggcgaagaggccgtcgacggcgaggagcgacgccacctcctcgaggtgccacccctggaggtaggcggcgacctcgacggcgagcagcagcagagacaggacgagggacacccggatgcagccgtag

SEQ ID NO: 25908 - DNA, 45880 bp, Oryza sativa
cagccagagtgaccagcggttaatgcctttgttatcccgccttaaaatttttcatcaggctacatcgagcgtttaacacctatataaaatattaaatataagttaaaaaataattaattgtacaaattgtgactaatttacgagatgaatcttttaagtctaattgtttcatggtttgacgatgtgtcgatatggtgctacagtataattttctaatgatagattaattaaatttaataaattcaccttgcagtttactaggattccgtaattagtttttttataagtacctaaacattttatacaatacctgatgtaacacgctaaaattttacatcctcgtctaaacacccccctagaagctggcaaaacggtgaaacactcgcgagctggactcacgcacggacgcttcgccgctgcttctttccatccctgacgacgatgaaaccgcgtgtgttttcccttgacaacgagattaacgttagccgagccgcggtttgccggtttgggttttggttggttgggctcgtgcgcgcgcgtgccgccggatgggctcgcacgtcgtctcgtctcgtctcgtcgcgtccaattcgttgcgtgcggttgtggcggctgctgcagcatggcgcgctgtcggtggcagccacggccacagctacaattatcccccctccggctgccgccgccgccgcagaaaaacggccgaacagcaggagttcctctcatttcttctcgatatcttcatcagaaaaacggccattgatgagtatgaaggattaatttcttgctgattaaatgatgattttttttaaaaaaaaaaggtgttcgtgtcagacgtgcatgagcggatcatggaagggaagaggcgaggagaggtgagaaggaatcaaatcaggattacagatctacacgatgcttcaactgggctcaaatggagacaaaaacatggtttggttctaccaacaacattgtccatgagaaactaaacaagaggatcaacttactaactactacttgtatctccatacttcagatcgaaagaatctgagcatcccgggacaaaattagcatccactaacacacgcaacttcagatcatcagatgagctagctagcctgtcatctgtgggactaataactacgatttctggacatcatcatcatcatcatcatcaattgcatgccccaaacatcgactcctttcttttcacttccttttgcatcaaaccacctcaattcaaacctaacccatccatgattttcacacgaacactagcacaagattacattttctttttccaagtcacaagacagcatcatatcttgcacacataagtggagctcattttgagagggattattattggagagacaaagccatgggcagccacatctcgcagccagccaagatcctaaacgtgcatgagcccatcagcacagtggcatcggccaactatgcccccgtggatatgctcacgtttaattgtgggtgccttgcttgcttgcttgcttcccatggccagctagaccatggctagtagctgcagtagaagtattaactaggcatagggacacacactgcttcgtgaactgtacagctttgtgggtttggttgccctgcggcttccatcgtttttattcttgcttgctccatgggagtgagggaatcattccatctgcaggttcttggctcccattttttcttttttttcgcggggatggctcccattttttcgactgacacagacatactccatccgtcccaaaaaagacaaaccctggttttcgtgtccaacgtttaaccgtccgtcttatttgaaaaaattaaaaagataagtcacgcataaagtattaatcatgttttatcatctaacaacaatgaaagtactaactataaaaaaatttcacataagacggacagtcaaacgttggcacgggaacccacggtttgtattttttttttggacggagggagtataagtattcagtgcagcttccatggatggaagttgtttaattaagctagctactctcgatctgtatgacttgcattgactttgccatggtaaaaaacctgatcttttgttgtgcttagctcaattgctcaaaccagtagaaagagtagtagaaaataatctgggagaagcagtggtggtactgtttttgtcggcagaacattttggctggtgaaatgcctatatcctgttggaattatgattaaagtttgtagctttggatcgtagtagctcctgatcaagttgtgttttatttgcacatctctttcctaggaagagagagcttagcaatatggagtttatgagctgatactacaagtgaaccgtcggtgggaaaagaccaagaaaatttccctgttgtcaccttgaactctgaagagtttcgggatctcgatgattatagtagcctcatcagcatgagaaatttctcgaaattggaaattagtatacagcactgtcaaacgagagattctcagcagaagcgtgcattagaaacttccgtcggttctaacttctgaattattgtcccaagaacaggaaaaaatgtagccctgtcatcaaacccaataaaattctcgtgttagtacagtatgctataactatctagaaaatatgaagcatcatgttggttgggtagaccatgttactttgtttacgtatcagtactatctacgtataaaaaaccgtatctacacagttaaactattactacaaactttaacaaagtattttttttcttcaccgatcataccaaacttactgagtactgggtaattcgccatagaaaaactcttatggcacatcagtagtaaaatgtagcaattgtcaaacgacagtgttcgctggagtagttagcaaaacgaaaaataaattggcaactacaacagttgaaaactgtcgtacttggttgatgccatgtttacctctgaacatgggagaagctaatcacaaccacctaatctgactattttagtcgcacgtctttgagacagattccccggatcatgcttgcctggtgcccaattagctgcacaccgatgcgattaatttccgcgacgggattagcaaaattaggccctaaaaattcgcactttgtggccgtttcgagacacggctgaaagctgaagcttagttggcagtttgactatacctgaatgaaaattgaaaaaaagccttgtcaaacatcacattaatctaagtaactatcattagctgtggtctacatctctaataatctcatagtagactgcattaccatgtccaaacaatgaaaaaatggaggaggtcagaagtgaaaaaggaaaaccagaaagcatatataggaggctcacacttggcgttgtcggtgcttagtcaattggtcaccacctgcactgcaggaaaaggtcgtctacctaggcccgttcttcaaaacgaaaaaaaaaagattaacgtgggcatatgcttcatgaatcatgagcttgtaaacgatgtgattttcataaaaactttttgtaaatatttttctaaaaaaggctttaaatatactttttaactttataatagttaattcatctatttgcacactcaaataacgaccacaaaattattgagctattcaaccgtttagcaattcagaaaaaaaaattgcaggtaccactactactagtaatggtagtactaagatcatgccttgcacacagctggaagcctggaaggaagacaatgacgacttcgaccacgaactctactttgttttgattaatccatcagaaagtacgaattaaatttgaaaatatactgtttatccaaatttttttcagaaatattcgagatgaattttttttacaaatataacatcgatctcgcgcaaccgttatgcgaaaatgacgtagacatgacgtcaccagcggtatcgcacgataaaagcgcgagaccgtgcagtatcgcgcggtattgacacgagatcgcgcggtctcacggaagcaaagagcgagtccgctcggtatcgctggttgaagcagcgataccggcatggcagtcccggccgtcaatggttaattacctaattaactattaactaataataattatcttaattaacaattaattaatcacaaatcaagataattaattactaattaactggcatgtcaatgcggtatcgctctttcaatcagtgagaccgtttggtctcgctctttggttccgcgagaccgtgcggtcggcgcgagagaccgtgcgctctcgcgctttcaccgcgcgataccgttcgtgacattacgtccatgtcattttcgcgcaacgattacgcgaaatcgacggtatatttctataaaataatttgcatcccgactattcttaaaaaaattagataaacaatatatttttaaaatttaattccagaaagtactcgtagaggaaagttgttcttggagaaaggtgaaaaaagagagagaggaagagatggtgtgtaaaaagggaaacgattgaggggagaacgagaaagttggtgagactgtcagggtttcagaaacccttccgtgatcgcaaagtaaatgcaggcagccacgcacgaggggctctgactttacaaccttggcaaccctatctcaagaacgatccatggcgaattggcgatggcgcaatcgagaagcagcacatcgagatcgagtataacgagagggagagagaggtccccatcgtttgatttatttcctaataagtcaaaacggcttattagaaaataaaaatgaatttgtaggtaaaacttttataaatgtgttcttggtaacttaaaaaccaatattgaaaaaaaatatgttacaaatatctcaaaatcaatcttaaaattaagcttgaaaatttaatatttggctttttctttgactgattaggctatccgatgggagcagagagacgatttcagaggtgaccgaatcggctacttccgcggaatccttgggccaaatctgctgcgcccaaacttgcgatgggcccatcttgaatagcttgtgtttggtatgggccgtgtagcattaggccactatcagcctatatgggcttccaattcaacaggtagaaattagtagggccagttttaccaaatagaatttttttttgagggaatttcatcaaatatccagctcaccgaattgcgctatgttagcaaaccaatattgtataagaggtatctctagctttccaaagatttggtagtttatactcataatattcatctcatctcataaaagctctttcgaaacgatgggattgtgaaaacaaaagaatatgaaaaaacacatgatgttaacatgaatgcatgcataaaacggatgattgtaaacacataaaaaaacaggaataaataatcgttacgattagaccgccgaaaaaatacaaaaatcttaggagagataaagaccatcgttgaataaacttctgacagcaccatcgttgaataaacttccaacaacagcatttgtgtataaaaaaatgtatttttctatacaggtaaggtggatatgatgatgcaaatgaaattggagcgatgaaaagggaaatatggatttggttcaggttctcgagataggcaatgaccttacatcctgtttggctggggtgaaaatagtaatctagcctacacgactatgtcggcataaagtcatggtgaggtagttgggattagctgttggctcatgtggcttgtattgtctctcattctccccttttgagaggattgtatttatatccaactagaaaataggcgtgctagttggcgcgccgattaataaagcctgtggtggtattgttggtcatgttcgagatacataaattgatcatttttttttcttgagagatttgaagactatacaaatggaagcaaagagaccataaaaaaagaaaatattagaatgaaattcacctccagaacacatagttatatagttatagtacccactggaaaacatttagttagacatattccacaaagtcaagttggagtgagtagtgtaagataagtcaattggtcacatggatagacgaatatatttgaagttcatatacttaagagctagggagattgaatgtatggggttatctacataaatagttaattctaaaatatatatgaaatggaatatttgtgatattcctatttaaaaaaatattatggaaatgtataattctcaacaatatatgttataaagtggcaacaaatcctaagtgattactacagttggatcgctctttcaaataaaaaaagcttagggtctttaagtaaatacctctatacgcaagttttaagtggatcaacatattagaggggggggggagaaggggtacatccttttataaagtggcaacacatcctaagtgatttctactggatcgatcttccaaataaagaaaagcttagggtctttaagtatatacctctatatgcaagttttaagtgaatcggcatatgagggatgggggggggggtacatccttttaatcccatctaatcgaaatgttctagatgttgtgttgttaaggtattaccttttcttttaaaagctgttaaggtactacttgcttttagaattatcacataacattgtagttttctatttttcttgttcttatgtattttttctttagacaaaatccaagatttatttgataagacatgggcgtcacgtggcccaatcaaaagacgacgtaaccgccggctttagattagtagatatgggccttttgtctaagtataactcaaaagttaagttaggatacaaatccaaatagccctagtcattctgtcatagaactatgtttttcttttgcagttggggactcatttcttcttactaggttaagactatctttattttgaggttttgtttcataggaatcaatattcggtattcacatgtctgcagggcatctcaaatttagtaattcctttcgtctcaaatatagctacttcactgtacaaatttaaactatttagtaatccctctgtctcaaatattgctaactttatagtaaaaaattaaactaaaaaggtagccatactttaggatagaaagaccaaaaggaaattatccatgatattggatctcatgctaaaatttctccaaaactgacatggattgaggcattccaaatgaatttaataggattcactaacgttcaaaactttgttataaggggccatacaggggaaaaattctatgagattggaatcctaaaaaaaatcttatttcctttaaaggagccatataatgtatgcatcatgtggtttagtgagaaagaaaggagccatatagtttgactgtaaatcggaataagatctggaataatgatctacatatatgtttaaactaatttgacattttgagtgagcacccactccactttaaccagaagaatctggtcattgatctggtctctgattagatgggttataaagcatgacactgataatttgtattaaataaatagtaaaatatacgattggaaacatcacggactctttactgtcagttttttgttttcaaaatttaaatatcaaaattcggaacgaataagtatgaagctgtaagttgcaaccttcttgaactctcactttaatatactattattattaccaatttaatttaagaaattgtaactgccgaccggggcggactcatttttaatcttacgccaccacatttaaaaaataaccaacacatttaatacataccatcaataacacgggttaccgacatgcgtacaacgagccgtattttttttcccttgcatcatatactccgtatcaaattatttcgtttactatctgatgcgtgacgatcataaagttctaagcactatattaaactaaataaatcgagctattaatagtgccttggcctagggtgcaagctaagtttttctttattttttccttttctagttacgccaatcggttatattccgttacctttcccttcccttctttccagtagtttccacctttcccgcatcttccgccgtggggaagggagcaatcggcaagccaatccaatccggttgcttctcctccaatccaacctcgtcggcggcggcggcgacccgcgccgcgcaggtgaggcctcctcgcgctccccctcccgcttccgccgccgccgccgcttgggttgcccgtcgatcatgcgtcccgcggattgggggctcggtttttttgtatttgatctggtttgcgtggagattaggggcgatgtacggggtggatttttggttatgggttggattggatgggagagatcgtatttcgtatcgatgctccgtttggccttaggttttgtatttagtggatggctcgagtccaagcgtagaaaagagagaaagaagtgattcggaagttctatgttgttgtttcgatgtagatggaaaagtgtattgcgcatttattgttttgggattactagcaaaagtttcatgctcatttgtctcttgcttgtaaattttgatggaacaatagagagaagacacagggaccagctaagctgtgcatccttgttggtgatggttttttacaaatgatgaatagccgcctatcagcaaaattctttcattttacagttgctgcatttggaatttgattgaacaattatctccttttgttttggtcaagtcatggaactggtagtgccttgcattctgaaaaggggctctagattactgtacctcatttaagataatttggcagcagtacaatattatcctatatatattgtgatatgttcaattaatactgtaacacttatatgtacaatattatcctatatatattgtgactgttcatgcttgtacattgttcaattaatactgtcacacttatatgcatctctgtttgtgttcctcattaggctgttgagttatcacgtatttgattatggatctgccattgatggctgctaaagcctataagtacaaagcagaactacttgttaaggactacctgctagcagattcgtatgttccatacgcttctgtgcttggcggaattctgatgtgcaagttggtaatgtcacttctgactctcacttttctgttaattatcatcattctactgtgtacctgtgcaataacatgttcatagttgtgcgtatgtgtatactcaaagagaatgccaacatctatgccattgctcttttgcattggaatgtaagacctttttttttcattcactggttttatttgttccattaaaatcatggtcaatgatgatggcacataattaatatagcatattatttccaacatccatttcatagtccttgtaatggttttgttatcttgactattgtgttcttttgctagctcagtcatatgatttcacacgctttatcagttcattctacttcaaaggctatggttctctcacaaagatgcaaaaggttgaatggaataacaggtcagcagcattaaccaacttaattgccaagttcctacatcccactctattattataagcttctgatgatacatcttctgaccctttgttactataggggcatgtccaccgtccatgcaatattcattacacttatgtcagcatacttagtcttcttctcgggtttattctctgaccagcaggatggaccagtaacatttagaagttcgagcctctccaatttcacgctaggggtatacatatgcaattactttattgtcctgtgacttgtgatatttcattatacttagttacttgaatctcatgttttgctaggtctcagttgggtatttcattgcggaccttgccatgatactatggttttacccttcactcggtggaatggagtatgtaagtaaacatttttcatcttatttttaccctctcttcagtttccctcctaactgactaacctaggtccgttgccctccatttgactcctgcaaactgcattatttgtcattagccattaccaacttactcttggctgtcttttgtcagcttgtccaccatgtattgtcacttactgctgtaacgtatactatgctttctggggaaggacagttatacacatacatgagtctcatctcagagactactacacctggaatcaacctaagatggtaactgagtatacaaatatgttgcatagaattttgttttggtatcatcttcaatccatcagtccatctaaactgctattctctcccctttgtgttatcaaggttccttgatgttgctggaatgaaaagatccaaaagatacgttgttaatggagttgcaatgtttcttacttggctggtaagaataaagttctaaactagttgtgttgtggcagaatgtattgttctgcactgactataattaaatgggaattatgtgatctatgcatacattttcgtgaaagcattagtctttaattacatctgaacttttcaactgtaatattgttttatttaaatttttgtgatttcgaatttctgctagccttggaagcagttgtcttgctagttcggatttgtacatatgttcaaacaaatgcttgttttccagtgaggataatattggcacataggtttattggctaccaagtgagatatattgaattattctaagggaaaatgatccttcctaactatgggagttttaagactaaactaccaaagttgtatttgaacactcaggtttacttaaatctgtcgctaaatcgataatatggttttttactatattttggagcttcaagtaccttggtctgctaacaatgaaagaaactcctttgtgcaggttgcaaggataattttgttcatgtacttgttttatcagatctttttacattatgatcaggtacatggtaattcttctggattcaatgtacatgatggctatcaaacacatatttctgacttgatacttgttcgcatacagattaagcagatggagacctttggttatcttctggtttgtgttgtgcctgccatactgttcgtgatgaatatgatatggttttccaagatcttaaggggcctcaagaagacactggccaagaggcattgagtggggcaaggggtatgcatgtacagccacgacaaaccacctatctgtaaattcactcagcaggccagcagcctatagcttctcattagtcacgatggctaatcctggtaatatcagcttggccattaagatccagatttatgattgaatgcccagctttttatgcatggatgatatattaatttgtatatatgttccgctatggctgtatgttcttaatacccatcttctttttctcggtataaatgattatatcttagttttaacttaaacaactatttgccccaatttcagtcacattgtcaacacattgctgtaatttgccatcagctttggccatcattcccaagaatagtttgatcatcaacttttagtctccctggactaaactgcctttctttagatctggcttcacaatgatgcccgagtttttaaaacatgtataggctgaagaattttggaatttggaatttggaatcaagaaagttttcaaaaggttatcttttgtagacatgttccatataactctttatattctactgatcctatgtgggttccaacaaggaaagcaaaaagtaagagatggagcctgaaatataacacaatttctagtacaatcaacaaaaccaagtgcctgtaggattaacattccttcaattaactaactcaaacagatgaacaaaaagggtgcaggtgtcacaagtaaatcaaatgatcccatgagataccagctaatgagatgctggggaagtgctccttgcaattcaacttccatcatgtgggatatgtaggacatacaaactgccagaaacattgaagcagttaaatagctccattttaattagtatcacaatatgagtacattagcttatgcacctcccatagtcccttccccttttatttggcaccttcaccatgataataatatttcattatctgcaccattaagtgccttccatcagatagcatatagctcaagcaagtttccaactaagaatgcctttaaatttattttcttgagtacagctttctaaagcttatataagtagtcctaattctcctcttcctgatctatcacacacaatatgcattctttcattcacttgtccattcttctttgcctcctatccacaaccctcatttcctatgcaaaagatagcaaagcccatagcagtgtggtccttggccttagccatgttaggtctctatctgctccatccatggtgataataaactccacaagatttgacttcttggacatcatagaaccagtaacaacatatacagatggctaccttctttccctaaacctgggcatgcccccacaggtttttcaggtgtacttggacacagggagtgacctcacttgggttccttgtggcaccaactccagctaccagtgtttggagtgtggcaatgagcatagcacctccaagccaattccatccttctccccatctcagtcctcttcaaacatgaaggaactatgcggcagccgcttctgtgtcgacatccatagctccgataactcccatgacccctgcgctgcagtgggttgcgccattccttccttcatgagtgatctatgcactagaccctgccctcctttctcctacacctatggtggtggagcactggtccttggctcccttgcaaaggacattgtaacactccatggaagcatatttggcattgccatcctcttggatgtccctggcttctgctttggctgtgttggtagctccataagggagcctattggcattgcagggtttggcaagggcatactctccctgccatcccagctagggtttcttgacaaaggattctctcattgcttcctaggattccggttcgcgaggaacccgaacttcaccagctcgttgatcatgggtgacctcgcgctgtctgcgaaggacgacttcctcttcaccccaatgctgaagagcatcactaacccaaacttctactacattgggctagagggtgtcagcattggagatggtgccgccattgctgctcctcccagcttgagcagcatcgattccgaaggcaatggcgggatgatcgtcgacactgggacgacatacactcacctccctgatccattctacaccgcaatcctatcatcccttgcctctgtcatactctatgaaagatcttacgacctcgagatgaggacggggtttgatctctgcttcaagatcccttgcacacacaccccatgcacacaggatgagctgcctctgataaactttcacttcctcggcgatgtgaagctcacgctgcctaaggacagctgctactacgcggtcaccgcgcccaagaactcggtggtggtgaagtgcttgctgttccagaggatggacaacgatgacgacgacgacgatgttggtggcgcgaataatgggccaggagcagttcttggaagcttccagatgcagaatgttgaggtcgtctacgatatggaggcagggaggattgggtttcagcccaaggattgtgcccttcactcctagtgacgacgtcgttggagaaatctattcgtgatacttttcattctatccctttagcgcacgatcgaacggggtttcaggtgttcttggccatttttatttcagtcgagctgctttgtgtgtgttaatggtacgagtggccgtacgaagtcactagcaaagagaaattgttagtggggagttgatgacgagaaagcaaagggatcacactcatgtaatgcgaaactgccacttctgttttaagttcaaaataaaggcgtgctttatgtgttggaataacggtcgagctagtgtgtacatcacagttgtttcagaagtgtatatgctttcgacgtttgatgatagacggctcaatgtgcaactgataatcaatattttctcccttagcttccggtacgtgatgattcgtgtgcatctgaatatcatcacaccttgtgtttgtgatcatctggttgtatcagacggcttacggaagatatgttctgctgttggattgggttggggtcttggggaatggatgctgagtgccactctgtgtttgtttcactatcctaatgtgttccgtttagttctctgtcttccacgtgacgatcaatgtttttctcccttagcttttgttcggtgattcgtgtgtatgtcaagtatacgcctatcccggtgtgaactttgggattcaaaaccctgtgtctcaacctgaacaccagcaagtcgttgtagtatagtggtgagtattcccgcctgtcacgcgggtgacccgggttcgatccccggcaacggcgaactgttttttttttagcctccgtgcagaacgaacggcagaaacgtgtctctaccagtctaccttcgccgcgggtaaagactgccagtagtagagttgtcttgcccgtggcgtgtgggtgagtccgcgttccgtaatccgtgggtgcccctcgtcgtcgtcggcacgtcgggaactagcgaatcgctgtgcgcgagggccacgcgaaccgtgtgcgtgcgtgttgcgtggtgctgtgcatgcgcgcggcgcggaggtatgtgggggtgggtgggagaagggcgggggcgggcatgggcatttggcagacagcgcgtgcgtgccgcgcaacagaggggtcgttggcggcgggcccgcgctttcttcccacgacccacaacctgagtgcgctgccgctgctgggagcctggcctaacatacatatgctttgtgcaagggtgcccggtggcactgtggcggcgccagtacagtcgttagtcgacacccttggctactgatgacgcgcgaggtggggtcgttgcgggatgacaccggaccggacatcccccatagcaacgataaccctggtggtatacgtactctctccgtttaaaaaaaaacaacgggatttgatccctcctaatataacgaaaatgtttttttataaagggagtatactggtatgtatctttccgaacttatcatagcgctttttttttctcttctttagcttctttagagtgcgtttggttccaagctatactttaccatcatttgtttttttaataatggaatataatatctcggcttttactcaaaagagctacaaccaattattacatagtagctttcaagaacatagtgtaactctaaatgaatagaacataccgaagagaaaaacaaagaaaccagcctaacgtaaggagatcacaattattaaagtctatttgtaaatctccaaccataattggtaaaaagttgcataaccttagtctccaactttcggcatgcaacattcagaaactcttcatcttcatcacacctttgtagttgtgcccaaaatcgaagccaatgagttgccctgaaaatgacctgcatataaaaaaatgatggtgatttgtcaaaaaccatatcgtttctactcagccatattaacatcatttgttaataaatattatcacactcacttaaggtgattaaatttttttatcacacttcaacaagtttaagggaatcttgtcacagagtcatagatgtgtgggacttagcttattggaagagtctcttgtcacagttgtagctacaactaacaactggcaagataatcaaacttgtctaactttaagtgtagcaaactgtaataaaatatggcttgtaaccgaacactccccaatagtgtcttgccttcaagcaccaagcttcacttcactgcagtgattggcttaattgctcagtccggtcagccagctctcgtgcgtggatcggaggaagctcgtgatgcgggaagaagcaccgccggagatgagccagcggctcctccttgccatccatcgcacatttgcgcgcgttgctcgatatttgggtgattttcacgattagctaccttgttaattacactatgcttttgttgtccgtgaaccctttgttctagtgccatgctaagagcatgccaatacttccccaccttagtgttggactacacaaactttttccccctgcttggtcaataatttgttacatattataccaaaataaaaatgatatgttagatatgccaagtctgtgcttgtttggatattggagataatgatgccttgcagtcttgcacgtatactgctactccctcttgatattccacgatcggactgacaggacaacgttatggtttagtagaggttttgccaattgccgtacatggggaaaataagaatgtattgccttattcaagaaatgaagcacctaagtcgttgtagtatagtggtgagtattcccgcctgtcacgcgggtgacccgggttcgatccccggcaacggcgaactctttttttttttttttggctcttgtagagctcagggcctcaggctctccgttcaacggagggagtatgatctaacctctttttagtagcagaaaaactataaatcgaaaattatcgtataacaaagaaattagtgatatctagtagagcctctcgtaggcaaaattgctatcgcaaattcgcagctacaccagtgaaggcaataacaaagaaattaacagtatacaatacagtccaaaaaagttgagctctttgatttgccgtttactaattcagtgtcattgtacagttcgaacacgtaccatcgaacttattaatataccttagtgctcccattggccaattgatatacatcgaactggaacagtttttccctgtgccattcaaatgttttggcagacggagattggttttatcgcagtaatggaacgcatgcactatcaatctatccatatagtttcatatcatggtgaaaaatggtggcgtgaattggatcatccgtattgtccgtctccaaatctgataggcatcaccatagaatgactgaaatttgatctatagccagtaagcctgtgccaaccgttccaaacagagtatctccacctcactggtgtttttgagcttttgatcgagatgcattcttcctcatcgtccaaaatgctgcgcggtaccgattctgcaactcaacaacagtataaataagaccattattaccaaatatcaagaagattggcaaaatgcacaaacaattcatgggtattgaactagtgatgttagacgtccaacagaattcagtacagctgaaatctcaagtattggaagctggcagctttgaaatattgcatactagcattgtgaacatccgctgagagtactgagtcaggcagaggcagagccctcgctgggaccaaagagggcattggtctcccctttcttagcaaaaaagagcatttaactgctcgaatagtcagatgcaggttgaactggtcctgtgtcgtagtaattctgtaaattgtatcctttagattggcctttcatgtattttggctcacgctccaccactaactgatacattcaacaactgaatttggacaactagtctcctagcactcctaatacacctgttgaatttactatgcaacagttgaacactatatgagcctacaagggattgaggaacaagtggacatctagaagtccaaatgaccaagtttccaactgcagcaaacaggactatcacctttaagctttcactgtgccattctaaatatttgccataaattcaatcacttcctagatatttgaagattaaaccacagtgaagactgttgagattaaaagattacctgcatcattgatttcatatttgcagtgtatgtggtatctatcattttctccacctgaaaaccacaaatcaaagtaatccattcacatatttttgcagtgaggtgatgcactttctgtctaatcataacccttcactcttttttttttacaacaatgcatatatataataaacatgtattgcacttttttttgcaagatacaagtgtacaaatccaacgtattggtgcactatgcatatgcatatgcatagtttggagtttcctcaattatagcccaaaacttttttttttttgcaaaacactcacctccatcacaaatccataatggtaagcaactcttttcacatcttccaaactcagttcaatagacatatcctgtgtttaaggagataaattaagttcctcaagacatagtagcaccttcaaggattcaattagcatagcattcattcatttaactagtataataaggggagagaactaattacatcatctggtccataggagtcagcgaagtgatacagaagcggacccaaatttatccagacctgttggttgaaattgcataattatcaatgacagataagaaacagtaaataaacaacatataccgaattataaatttccccgtaaactgactcaaaaaaacattagcactgattcatcaagaatagtttatcagagtttaatcctataaaaagagactcaccccaccatccttgagaacttttgatatgatctctatatattcaacgatattgtgtgccgtatccaagaagaagcatgttacaacagcatcccatgaagctggagcaaaatatgagtattgtgagaatgtcaagaaggcaaaaaacccgtagttaccaatcatacatatctgaactaaaagcagaacaaattaacacatcaaggtcagaattaaagtattagacttcaaaatgacttcaaccaataatcatcagtttcagagttattgcattgcatgcctcaatagcctacaatattaatttgaggagctcattccttctccataatacataaaatcaaggacctggcttgcaactgcctcctacttcatttctaagaaaatgcctatcgtttgcaatttagtttttgacgaacgttaaagcaatactctcaccttgatttatttaatgagcattacaaaataaatccaagcaagctaacaaatgaacaataacagtaattaatatccccccttaaaaaatgtacttcgtatgtatgacaagaaacaagaccaccacaaaagaacaactcttttcccttgttggccatgatttaaaatcgaaacaatctgacagaaacaaaaccagcacaaaattgtcctctttttctggggttccatcagaacacatccattctcattgtgaattggttctgtacaattgtcactctatttatatatgctttagactaaccccaatgcaaaaaatctgttcgaaacgtatctgtgtttttgaattgttatttaatcccaccgcttccagtttctggcatgctttcattgggccacacaagattcaaagggcaaatggtactacaatattacaatttaacaaaaagagctaagttgagtgatgcatatccctttataaggaagccaggttaaaattaattaactcattttgattagtttataaggaaaccaggtcatcttacattcttggctttcttcattgtagacctctacaaaatcaccagcacacatagaaaatccttctgtgatccctgagctgtcaaaagaaaagaaggcaaacataagataaatatgtagcataacaagagataacggacagtttctctccttttgcaaggaacataagtaaacatttctacctacagcacaaatagtactgaatgactgaaacaagctgaagcatcaaacttgaattctagaattgaatgaagtttagattcaggattcaaacgaaactgcacaattaactaatcattcaaatattacaacatccaaacatagaatatttgtaggttctgcaaatagtccagatttaaatagggtgtttcaatttctctaatcaaatgctcttacatagccatttttgttgatttcatatgaagctcttgtaaatatagaatcataaatggtaaattacctataaatgtaatcaatatatttatgttttcatcaaccgtgacgtcctatatgcacattatattatacaaaactaaggtcatacgctatcaagtgtacagagcgatgaattttaacacagcatttgcaagcatactggtgcttatgagaaaaaacaaggtgctttattaccttgaggggtgaatatcaggaaatgaaacagggcgaagttgatcattgtctgaaagagaattgcagttgctgtgtatccaaggatatatagtccactcattggtttcttgcgtgctgataaaacatgaccaaatattattgtgtgatgaacaacttgataatgtaaggtgctagttttttttttaaaaaaaatatgtatagcttagattgacctactggtttagaatgaaacttgaacaaatcatcatgtaatacgagaactcgtttccctggctcacaaaacctgttcaagagttaaaacaagggtaattttcaagaatatatgatatcagctcattcacaatttatttgagctttttttcttttacccagagtggatatctccagagccaatctcccaagcccagcaccaggaactaagcatgaaggaggcctatgaagttcaacaaatacacaagtcaatgattgatcaagaatgaagcttcaagcaacttccatttgtatatgaggttaaaggaaatgcttgcataaactatccacagtaaatgtgtggtgtgagaggggacgagatgtcctaatatttatccaattcagaatcacagggcatgggcatggcaggcggccatagccgcagcggtttttctttcatcacagcccctcgcatcgtgtatagccatggaatggaaggcaagtcgttcgaaaacagcaggtaggaagcatcaggtgggcccactggtcggacggcaggggcgagtggtgaacagcggaggaaagtcgctgcagctgaggaaagcgtgtggtaaacagctgcgccggcccacaccacagtgagacgtggtaaaaatgaggatgacgtggataacagcgggatcaaacacgccatgctgaagtcacgtgaatcgctctcgtgcgagaagaatgcccttgtctttaattaccccgattttgaaaacaagatcactacccagaacaaggtaaaaaagtatggtagttctaaattattgtcataacacagggataagtcaagtttacctctccttgcttcggttaggaaatagacgattaagctcctccaggatgggcttatagcactcatcacgttccttttgaccctacaacaatttaagtaacaaaaggtaatatttcctttcggattatatcattactttcagacagaagttccacttcaagccaacccaaaattgcacagaaaatacctcctgagcccaatccctgacaatatttcttatgatgcatctaacctgaataaaccagaataaaatggattatagaagctataaaccagacagcatccaaaaacatgcaagctgaaaaacatgtaaaatgtaggcaaaggtgcaagaaactacatcagcaaaatatagcatgattgagcacttcccattatgaggccaaggggaaaaaaatgacaggaaaaattaacatatgatagaaatcagtaacaccacatatcaggaaagatgccagctttggtaacaaggccaaggtgcaagaaactacacacatgcatacaacatcagcaaaatatggcatgattgagcacttgctattaagaagttaaagggaaaaaagaaaaatcagcatataatgaaaatcagtaacatccccatatcagaaaagatgtcagctttggtaacaactgtggcggtcaaccaacatgaacctttggctatcttcttgacgcattgcagtatgctttctgttcgaaatgtgtcaaatgagaagttgatagaaacacttaccttgtcaacatcaattggaggaacattcaactgcaaggatggagccatgaattgctgcggtatcacctaaaataagataacaagaattaaatagttcacatttatttatacatatcgttatctccttaaaagtatgagaagaacagataaacagagaaaaatcaatgcttgttagactgaaaattatgtgtaaatattgtgtgatgtactttttttctcaaaaacacaggagggttgcatttcatttcattaagaaggaagaaaacacttattgcattctgccctttattgcaaccagaagataaccgaacgaacagctagagatagcgaagaacaaatgcattctgccatttattgcaaccagaagataacaagaatgccacatccatgtattactcctttagattcatagtgataaaattcaagcatgaaagctaaactatgttctgcatcatgcaattataaattataaggaatacacaacagcttacatcttgcaggtggagcttacattctcatcagcagaacatgcaacacaatctgtatcttgacagttagctgctgcatccatggctttatcaccattacatgatttatcttcaacctgagatgcccccaatttgtcaccaaccggccgggagcaactttccatgtcaactacctcgtcctgtttgatacttacatcagtcaaaacgtgtgatatcaccaattttgtactccctccaggctgataatacttgtcgttttagataagggtgaggtcaaactttagaatctttgattatgaatcatttttaaaatatttgtctttcaaatatggtgactacatgtatagattagtcttgaaaagtactttaataaaatcatatatttattaacacttttatacatattataatagaaaataatggtcaaagttgttttttggagaccgtgtccttgtccaaaacgacaagtattatcaacccggagggagtagtgtatatggcttcaacatggaagcagccattatttttaaaattgaacaaaaaggatcaagacaagacataaggcctaccttgttgtcagtttctcttgagagttcatgagtcttgtcgtctttcctggggcaaccgtctggttcatgcaactcggaattgcttacagagatagaacttctaaagcaatcacccctatcgacagaatgagcacaatctgcatgacaatgtccatgcatgttctctgcgcaatcatgaccatccatatctacatgctgactcatgtcgaaaggaggctcaaatgcctgcagtaatataccttttaaggatagcatcatgtacattaaagttttcacctaacgtacaatcttcccaccccgacaacccaaaccacatatacacaataacacaaacatacctcaagcatgtccatgatgaatgatgcattcatggatatacacctgtgaagtaataaacaattacaaaacaataataaagtccatcacagtaagcaaaaggagtggccataactagtttaagcagcatgcattgatttttcagaaaaatccggcggagaatttaagatagaacatcattggtagaactaaaaaatgttgactaaataaataaagtacagtgcatcagatatacaaaatgctttagatgatttcaaacatgacaaatagatctactgcaaaactgtatttcacaatatttaagcacaagcagtggaactaataagtattggccactactacaagcattaagcccataacattacttaccatctcagcctttggtacttcagaccaaggttaaaaagaagttcctacacaagaaaagacataagatatgtgaatgaacatacagagtaagataacctattacaagtcaaaatgaaatccaaaagtgattagccaagaggaagtggtggttgaatataaaaaggtaaaacgggtatggtgactcaaatacaaaccttgtgggcaggaggaagccttttgaatgatcgctcatatctcttgacatccctttctgcagcatcgtggtagctatcacaatagccatacaaaatattattatttaattagaaaaacactaatataagttaaatggttcccatgtagctatgttccacatacaccatttcacatttagattttccataccaataaatgttcaaattcagaagccattgtattgcctgcattcttttcttatactccctccgtttcaaaatgtttgacaccgttgactttttagtacgtgtttgacccttggtcttattcaaaaaatttaagtaattatttattcttttcgtatcatttgattcattgttaaatatactttcatgtacacatatagttttacatatttcacaaatttttttaataagacgaacggtcaaacacgtactaataagtcaacagtgccaaacattttgaaacggggggagtaagtcatttcaacactggcacagtcttcgctacacttgttttgtccccatggcccccaccttttccaattgtgttcatatgttggacgaaaatttcaaaatacaattttatgttagaagttttgaaggtaaatctacccataccattgccatgtaccaagtcctaactattttagagtgtactagggcaatagcactgcgtcccggctcatcaaggagcccaagcatccacatagggaaaaagtaaatgaggctccatctctcccagtacgcatagctttagatggggtccaccattaattttttttcaggcaggccccaccacaaaaaatcgtcatttcctccttcggagaaaaatcgcttgcacctcccattttccgccgctccttccccatctctctctctctcctctccctcaatcggctcccatggcgccaaacccccaccctcctcttcgtcctctcccacggcggcgcacggcgacgactcctccgcccccctcctctcccacggcggcgcacagcggcgactcccccaccccctcctctcccaccggcggcacagatctggctccccctccccattccccaaacaccgccggcgccgcttgggagaaggcggtggtggaagcagctcgacagcatcgggcacctctcccctccctctccggcctcctccctcggctaccccaagcccaagcagcggcggcggcatccccgagcccacgcagtggcagcgagctccctgagcgcccctactccggcgaacttctctcttcactcttcagtcatccaccgttcttctcctttctcactctcgctcttactttcttgttacgcgtggaggagcattttttctgacaaagttgctgcgaggttcttgtgaccaactctgatcacgcgaagctggtgagggaacagtctccactcccctctctcctccacacaagcgatttgcctacgtggaccaacattgccatacgccacgtgtgtgcactgtgaatggccttagtggtaaatgttttcaaatgttaactgcaagcgttctaaagaagataggtaaaacatagggagtacttctgcaatatcaatgctaaaacttgaaaagaaaacaagatttgacaaaagtacaagtgttgatgcaataatactttgattatggaatttctaaataaaaaatagcaattccaggagatatcacttgctcacatcacatatagtaacttttaagggtcacgcctatgagttggtttatcaagattttcgtaaagacttcaacggggaaaaaagaaatgttctctcactccaatcaacaacgttcatagcatggttgtagtgtagaactccccaagtcccaacgaagcctaccgcccttcgcggatgggtaatccccgtaaccacagatcaactctatccagaacctcacaccaccctcgaatcggcgactactcctaaaccctacaactgagaaacaacaccaactcgaactaagttgtaacccacacacacccccacaagcctcggaacaaagcggggggagcctgtagaacggagctacgcgcctctacgcgaccaaccaaccgccgccccggcgagcaaggagagtggcgtggcagacgagacgagctgggaggggaggggagggggacgggatgggggttgacgtacttggcgtaggcggcgatgatgcggcggagtgagctgatctcgagcgcctcctcctgctcggtgtaccgccgttcggccatcctccccggcggcggcggcggcgaggcggaggagcgcagctttctccagatgaattggtgggcctccgaatgatgggtcgcgtctcgcgtcgcgtgggggaggtctttgcttcagttatgctcaggggcaaagcccactaggaattttgccgggtgaaccaagccaatatggaaaagaagaaatggaatttcataactcaaatattcgtctcagaaattaactactcctatgatgataagtctcatcggtaagcgatgatattaactactcctatcacatcaaactaagcatggatcatcatattttgatatttatatgctggcctaaactcttgaagatcttcatagaaatagagttcatggatttggatttgaaaggatgagtgcgcatgtgtataaaagagtttgcatttgcaatgtgttttgaaggggaaaaaaaggatagatcatcccattgtttcatatcataagacttgtcttgagttaaaattttttagtttgaccaagttcataacaacatagcaacatgccaacatctaacattaaaaaatccacaattaattataattttgaagtatattttcttgtgttgaaaatgctgaaacattttaaacttgaatttgacttggcacaaaccgatggagtagcttcatccgatttatatactatgaaacatattgacacagcgatttatatatctcgatcttcatttcgccctattttagtataaaatataggttgcaggtttatatctatttgatttttgtagacgcatataaagctaacacgaacacacgatgcaccgagaacgatatgtatggcttttccgatgagatgaaacactatatacgctgctaaccatcgaacgatgttacttgatacggtctgtgacgaccatttcagttagtactccttccgttttaagtttttgtttgtattgtttgaccactcgtcttattcaaaaaatttgtgcaaatataaaaaaaaaaagttatgcttaaagtactttgaataataaagtaagtaaaaaaataaataataattctaaaattttttgaataagacaagtggttaaacagtgtaggtaaaaactcaaaatccctttatattatgggacggagggagtatgttacaagctaattaagagccctgggaaggcagaacaaaagaggggtgaatttaattgcaatacacatgcccgtcagaaatggtagcaagtatacactagctgtaacctgagacccatcatcaccgaagctgtaacccaaacacacggcgaaccaaacaaacatcgccgcgtacagcaaacaccactctttggacagaggagggatttttgtatgaagaatttgagaagagaaagcatcggttagaatttacaaagcttggacgggaaacaagatcaaaaggaaccaatttttttcttgttttaattatctgtgttttacttttgaaaacctccttatcctatttatgtcgaggttggtattgttctggtggaatggtggagtgagatgaaggttgcccctccttatggggcaacatatttaagaaacttccttgaacaggctcatcttcatccatgctctctgttttaaggataaaagcaagttaaacatatcatgaaaaacggtacatggtgtataaggaaccaataggtaataatagtgctcaataccaaataatgtcttgatagttggccgctttgacttggaactcttcttcttcaactcagctgttccataagcacaacattttttttcaaacaaaagacactaaaaatgcataatctaaagaaaggcatcatcatttacaatttcattagagagagagagagagtgctaaccaattcctgcaacctcatcatcatttacaatttcaaaattcttatatgtatagccaacaaagtttgcatccttggacggaagcatctgcaaaaatagcagtgctcttcgttttagttcattggctaagaggcaatacgaaaatgaaacatctctaattaagcatgttaatttctgcctcctaaaagcaatagttggaaattttggaaatgttcctaatacatactagttttttatatatttttatggctacagactagctagcagtgaatcacaagcttcatgcccatggtccatcactagtcaagctatgtatgttccctatctacattctacagatagcagaaaatagagtcgcacaggcgacacacgtgctgccgtaaagtatatatgatataacagttgtttgaccaacacatatgcagcttcattattaggaatgtgtttccaactactcagtaattagcatttcatggtgaagtcacacatacctttctccatggacctgacttagatgaactttgaatttgtgctccggtctgcaaaatagtaagaaaggtaagtacaggtgtcataacttcagctttctatacagtttaccaaaatagcatactcgtagttttaggtttcactctcaaaagaccagaaataaacatgttaccatggagacgatgtaaaacgtggctaagttgtcatgcatattagaaaatcataatgctaaatgcagcaaggtttaagatcacaacctaataaaacaaggtgaaacgaaatccctcctcaaattatcacatgaatcagaccaatgggaaaacgactgaaatttacctcctcaaatttctcaaaattctgagtatccaactcgctgttaacttctggtatgaaagcagctttcatctgatacaatctttcccatgggagacctctaaaccatggatgtgcctaaagtagagcatatgacgataataattaagcacacagttgagagcaataaagatattgtacatatagaagagagcgcacttttatctcatgggctccttttgttccaagtctctgctcaacattacatagaagtttgctgatgagatccttagcttcaggagaaagctttgcctcttcagggaatttcaagtgacttctccagtttacaatctgcaaatgaagaatagaaaataaaattggatgaaacacatgctcatgaagctacatgagtatttcctgtactggagtaaacaagcttagctgaaagcattgggaaatacagccttccacaaaattttcccactatagggcacttcataaggaaaaaccaaggtcatgcgtgattattggagtccacaaactgtataggctgagctccgaggaccagttgctaccatcatcatctagccactgacccacataataatttgattacatgcaggtcactagtacattactatggcaaatactgcattctgctgtgttgattgtgcgataaaatttggcataaggttgtcttcttgcaagttgggtgaggtttgcttagactgaatatagaaaattccaaacaattaccctctagataacaaattaaaaaaaactgtgggcaaagtacatgcctttctgcaggttgacattggatcctccgaatagaatggaggataaccaacaagcatttcatacataattgcaccaagggaccacctaagatcaaaataaaatgtgagaacaagaacgaagcacatggatgaggaaaaataacatgacttaacaattatggacaattacaagataagagactaaccagtcacattccattccatatcctttcttcagcagaacctctggagcaatgtaatcaggagtaccaaccgttgaatatgcctgcatgccaaaaaaaaaagagtataactaagcatactaccatatattgatgagagcctagaaaactagactcatgtacatattcacttgccaacgtggcaaaacgtagtcagagagcaaaatgtgaaaaattcaagataaacgttaaatgatttttcatataataaataccaagtttcatcaacagctaaataatgcatgatttacacaatccactaaaactttgaagcttagagcatgaaattttttatttccttggaatcgtgcactgtaacactgcacattgtacacaaatgcctgaattaagtctgtccaggaatagcatcatttatgcttctgcacgcaaatattctttattcagaaatattcaatgttcaccgactctaaaaaccttgtcttgaggaagcacaaatgaatcttgaaaatccatcgtagcaaaataattttcatgtggttttatgccaggtaaaagaccaaagtattattagcccagatgttcaaacaaaagctcacaactagtgtgaatttactataaaaactattaaatgcatcaacttgatgtgggcatgtggcatcaggcatcacaacattggcaaggttctatcaaatatcaattagttgattcagtttcagatatgctacttaccagcattcgtcggttcttttgccaatgcgacaattgctcctgctgtgtgcgctttagagcagaagagcttaaccggctgctactatcaggtaaaggcttggtgccctttgtagatgtataatctggctcattcaaatttggaaaattactgctatccaaaggtttacacaatccaaagtcagaaagcttcaagtgaccactgcgatctaacaatagattgtctggtttgatatccctgaaaaaaaaacaccaaggttatctttggaatcatcaaatttcttaccaaaacttgggaacacttatttgataccggtgaatgtagctgtgcttgtgaatagattctattgctaatacggtttctgcaatgtaaaatctggcctcatcttctgtcagtgtgtccttgcgcataagcaaagtcatcatgtcaccaccaggaaggtactccatgatgagatacaagtattcttcatcttgaaaagaatagtagagcttgactataaaagcactatcaacttctgcaagaaggtttctttcagctttgacatgctcaacctgaaatttgtacaaccatgtcaaagcatacgtgtaaatcagaaatagaaactacaaaataatgcagccagaccatacatggtacctggcccctacgaagcatctcagatttcttaagctttttcattgcatatacattcttagacgccttctctctacaaagacgcacctgcataattacaatttacagtgacatcaagagcgatgcacatttaaatggcctcaaaagtaagtacatataattgatgacgattagatatagtagtttcagaactgcatagatctaccacactaagcaaatagacatatttatactattctcttgttgaaaaggaagaaacataagaatcttctatttaaaaagggttaaatctggaataaaaataataaatacaaagtcttgttggacactaagcacatgccttttttatttgtcttaagtttaatggtagattataggcataaaaagacatgaccctatttctcactcaaataaatttatgtggaagacactgaagattgacgaggcagggcataaaagtctagaccaggtttcatctagacttgaggagggattacatgtttcttttctctcgaatacacaagaaaggagggattacatgtagacttgagcctatgataaagtggtatactatattaggtccttaagcagaacataagctgggaaaatcagagttccttgacttccttccttttattttccttttacaatatgtatcgggagaatgattagaattcagaagacaaatgaatggcctaggaccacttgacgaattgaatgccatcattacaggggaccaaagtgtgacccatcaggaaaccagatataacaaataaactaaaaaaactcacattttccctttttcatgaaagcagccctttttcaaacaattaaaaaaactcccattttccccattttttttcagtcagaacacttccatgttaaatggcatcatgcaaaaaggagcagcaaggcagcacatttttctaagcataaaagagatccaaatttatactacagacattgcataagcaaaaaatggcaagtcgaccatgattctaactgaacctactgttaacaggatgtaaatagaaggccacaaagaaatcttagcacatctagtgttcttgtgctccaaaagaaatttgctaaggtcctgtgtatggaattgagatcagaagtacctcgccaaatgcacctcttccaataattgtcaaaagttcaaaatcttcaacccccatcttatgtctctgcaaccgcatatattcggtctcctttttctccaaatgctttagaatattattttgctcttctacaggaacctctgcatcctgtagtttcctctccaacatccagcgcctaaaagcaaatgaacacatcagagaggactggcaacaaaatgtcatccattgaatgggcataaaaggaagtgaattacccataataggaacaaagcaggttgatatgattttctagtgatgcaaaaagaagtaatagtgcgcaaagacaataagaaattcaaattgagtatgagcagaaaaagctcatcatggattattaaaataaactgttagagcataaaaatcaaaagcggtggcgtcaaaatcaaaaaccctgaaaaggggaaagcaaccaaaatgggtatacccacacaaattgcgtgagttcaatgaaccatttaaaagtcatgtgcgagttacagcttttacaacgtgtgcgagatacaatcttcagaattgagtttttcaagttgggtggtgcaaggctattaaagggattcataaagattcatggaaggggctgaattctttgatcattttagtagcttgggaggtttggaagcatcgcaatgattgtgtgttcaatgaggcctctcccaatgtcacagtggttttgcaagcggtgtcaaatgagagtagcctatggtgcttaactggggctcgtgcgcttcaggagtttctttctaagatatttgcgccgaacgcctaggtagtctaggaggggtttttttttctgggttcagcatcacctcggtgtgatgtgttttgggcttgttgcgacttgcggggctttttggcccctcctttgtatatatgtttctctcttaatgaaatgaaatgcaactgtccagcgtttttgagaaaaagaagccgcttgtgtaaccctacaagataaccaatatactcctttcagtcgcatcaagcatcactttggataaggcaaataaactcatatcactttcaaataactaatttaaatattgatgaatatattttcttttctaaattaaatttgtttggctgaacaaatctactaggacaacatttatttgttactaacacgagcgctagtcaggaaagctacccaatcaatcaagcttcctttttttggcagtgtcaagggcacacatgcacacacacgcgcaatcttgttcaattacccagaaatgtatttaccattgaaatcacaacctacaaagtgtgatatgtgttgtcaggtgccctaccaaacaacaacaaaaggtggcctttgctggtctaatttctcttctttgtatggtacagtacaacggtaataacaaattccgttacatatacgcaaaatgccaaaaatatatttttgcgagaaatacaaccaggcaaaagtagcaagaaatataattatgtcgcctacctttctttcctatcttgcagggacttcatctgggtcttgtaatgattctcaatgtactgttttgccgcggcaaccctctgttttgttgcactagatggcgcgtcatcaattggtggctttcctggatcctttccatgactggcagccaccgctggactcttcgatttgtccctcggctggaacttctggaaccaacttctcgcggaatccatttccactcacaatggcatcatctccgaaaccaacggttttcttatattgaccaatccagcagccaactgcaggcactctgaaacggtcaatccaactaacaattggatcagatatccaaattggcaattctccgtggaacccaatgctgggaacgatgcctctatctgaaatttgaggagataaatattctcaatcagaatcgttacacccagttgccatctgtcacacgactgaatgaaaattcaaataaaatattcacaagttacaagttcctgccatgttttgccccgccatatatgaacctactccatacttgaaatcaaaccacgcctactccatgtttgaaattaaaccatggtgagagctcgaactatatcccatcgaaaggggtagctagaacactgcttacgattgagggagaacacctcaagatctcaatttccaagcgaaacaaaatctcgagagaaaaaaaaaactctccggcaccggaagtagcagaattcgatccagaaatcacattgcctccacccgggagacccccagaaaccacccacgaaaagcagcaccagaaaccccccatcgcctcacaaacgcccccaaccccccaactcccaaagctcacaaccacgcgccacagcgacgagtcaccaattcgccaccggaatcccaccaagccgcaatccacacacacacacacacacacccctccctcccctgagcacacagccgcagctcatcccaaagtcccctccactgcacccccgctccaaacaaacaaaaaaaaccttacacaccgcagacagcgaaaccaccggccggagccgcgtcgtccggggaagcgcgcgctcacctcggcggcggcgggaggcaacgcggagcggatctcgggcgggcgacgaggcggcggggcggggggcggcgattggagcaggcaaaagtggggaacgaacgaactgccttaattttattttttttcctcctcctcctctttctctctctactctgctacgactcgccgggttgggttgtcttttcgtgggcaaagcaggcagcgggcagcaaaaggcaaagcgtgtgagagaaaagaaaagagagaagggaagggaagaggagtggagagaggcgtagtagagagaggctttggggctttggcttggctttgactcgccggaacgaaacttcgtgctgccttccctctctcctcctcctccgcctcgcgtctcccggcccccacctgccgcgcacaacgcgacctcccagctataaaatcacgcccgtccatttcgccccccgcccccgcgctttgtaaactttgttttattcagtgttgtggaagatagaatacggacgtgggacgaagaaggtaccgccaaatgattagttgttatgcggacgattaattagaatttgacgaaaatttgacgttttgtaaaaggacaaagttgataatagcttgccaattttttaggtaaatgtatgaaactacaaatattgaacatattactatattagaatagagcaagcgtgacatggcattaactcaacatatattaaagttcataatccattccatagttgtgcatgaaacagtgagatttaggctgggatagatttggatgggcaaacaacgtacggccaactatgggtcaggatagttgtgtgatcatgcccgattatacggatgatgattagttaaaaacggacgatttatcggtaattacgttgattacgcgttcaggacaaccaagaagaccgtttcgtgaaaacgtgacgggcagcttgccgcatacgttttaacgggcgtataaacggccgtatcaaccgttttccacaacactggttttattgttaatgtattttttaaacacgatgttcatataaatgcatgcatactcatcattacaaacgtacacattgtataacttgttcatataaacatctccgaagactatgtcgataaatatatactggtacttccgaatttaaatatacgatacaatccaattttgcttctataactttgattattatttttattctgaatataatagaggggtaattgcaaaagtacctatgaagaaaattctgtgcatataattttatgtagaagtacctctaaacagaaaaccaccatggttttaagtgtcattggtggtttaaattttaaaagtttgatgggataaaattatcagtgccccatatatttaaatacgaaaggagtacatctttagtccctagacatccatatcactatcacatgtatacatccgtcgttacctcttggagtatttgggcgtttgattagtgacaaatccacagcctacctagtaccctatattactggtaaaagaatatgtgaaagtgtgtatatttgtatgtaatatttgtagatattagagcttattatacatattggcgctcacggatgctcccatttttgctttgagaggacatgagaaaataaatacccttgcccctgcagtttgcaggctggagttgttgagaagaaatcaagtaatgctccagggttttgacaattgctgcgtttgacatgagagcaattgttaatgcgacgtgaggtacaaaagataatggctttgttaatcgaactcccgtttaataatggttcggaccgtgttaataattgttgatcaagttcaggtagataagactgcggtttaggacagaaagtatattgatgatgtgtcaggtttgcttctagctggccaaatgcaatttctttctgatactaaaagccacgtaattacaacttttattgaactacacttatctggttaagttaacctaaccccagcattataggaccaaactactactcccaactgaagtatcaccagggacatgtccttatgccttgttcctatgtccccaagagaatatatccttcctgcggttttggtagcaaccacaacacttgccaaagagcagagctaagctagcatatcccaaaaggcgcttttattctcaccaccattggtgcctgaaccacatgagcttgacagtgacacacatgttctgaatcttaacaacctgaatgtgtgatgtggaagctctaaaccgtgcagactcacagtcccaccatttcacctatgccgatgcttattcatacggcttattagcaaccaaaataatatattcacgttctccgtgattcaaatgcaaatgatgtcacaaattcagcttaaaaattaggtttcaaaattcaaattttggcatataagcacaaacgaaataataggggccaaagtgcaatgaaaaaggatcacagcttgagatagattattcatcggattattttgatatacaaaattaataaacatctagcaatgtagagcaaataattcgcgacagttattctgtgaagtagctgaaaagatatggaattggagtaattaaccacctgtacttatgtaccatgatggttaccattgagctttctttcaccgaccattggggagcaggtacacccaccgcagcgtgtacccgatgatggtatggctgaaggctgaagctgcacatttcttcaagccaaattctcaaatagaggcgtatagcatattggaatacccaaaagtcaagccatgatccggtcatcgtccggactccttcattttggacaaagaaaaatggctccgtttctaccatcattggcgtgtgtattgattcttggttaacagattaaaccgtgattagttggacattgtcaaaggggaaaatgattgtgttgctctagattcagatatggatgtcatttagataagaacaataccaagaagatatagatggacattgtaagagatggaagccatttggcttgtccagtagtctagattgggggcatgaagaaagttattcaggagagggttttaccttgtctgatcacatatgaggtaccgctgattccaagataaaaagctcaacttcgtggcaatagtttttaagataaggagaatgattacatcccaacatatgtatggcgaaagtttgaatagcttacatcccaacatatgtatcccaacatatggctcgtttaatttgttaaaaaaacatctactaaattttggtagggcaatgaactaaataagactttacaatcacaagcttaccaatctctatcaatatttagtaattatagtcacgaacatattgacaaaaaaaaaaggcaccgaataagccttaagtgatcttggactgtatgtttattgccaaagtactaggctcctcttcagataaaaaataatgtcctcaaaaaactttttttctattgtattacttataagatttgttttaagctatttgttaagtttattttttaaaacctttaatctatccctatgatcacatggataatctgtcgtaataatatgcttaataatctaatcaaatggtacattagtctcccaattcaaagtttaaactcaaaagacgtttagttttgcataattatgaccatagttcatttatttcaatgataaacctgaatgatcgagaaaatgacatagaaacacacgagaaatatcaatacgtatatatggctgtcccgacgagttatcaatatataagaacactcatattgatatttatttatttatttgcgaggaaaaacagccatatttatgtgaaaacattgataaaatcaatactgtaaaatgccttggtgaaaataacaagactaagctaaaatttcacaaatatcatcagccagaagcccacaactcataggtttcatttgcctgtgctcccatctcaactcaaaatgctaaacgttgtattttttaaaatattcctttcttaaaaaatcatattaatcaatttttaaagttagttttagctaacacttaattaatattaatgtgctaatgagctgttccgttatttgtgccggagagggttcccaaccaacgcaaataaacgcagccgtagcagtacacatttcgtttcaataggaacaaaatttaaatacaacaaaactgcacattgaaacagttccccactaataaatactgtaggatttaaacaagtgaccccgactgtgcacttgttccgctgccccaccagtcgccgtcgtcacggcgtcacctgtgcaccataactggcgggggctttgggtgccatccccgtctcccgtaaattcaccatcctacccacgcagtccacgtttcccagcccccaaatcccaggggcaaaatcgtaaaaccacactccgtcttcctccactgggaaccccgtctcctccgcggcctacactgcgcagcgcagcaatggcggcctactgctctagggtttaccaccaccacccggtctcgccttccacaatgcagggatcgctcgcgaggccttcgatccacgcgggatccgcaagcctgaccttccgtgctcggcccaattccgtgtccatcgtgcgatgcgacgcggactcgccgccggagggaagtgctgtggcgggatgggcgcctccggggccgtacacggggagggacccggcggcgaggaagccggcgtggctgagacagcgtgcggcgcagggggagaagtacgcgaggctgagggagtcgctcggggagctcaagctcaacaccgtctgcgtcgaggcccaatgccccaacatcggtgaggtaaaatagaatcaaacatgtaaaaatcttaaatccaaatgcattatttttttttgcggggaaaatccaaatgcattgtggtgtgacaaagttgtaactctctttttttgggtttgattttgcgatattgtggtatatttcagtgttgggatggcggcggcggtgcaggtggggacggggacggcattgcgacggcgacgatcatgctcctcggcgacacttgtacccgtggttgtcgattctgtgccgtgaaaaccagtaacaagcctccgccgcccgatgccctggagcctctcaggacagcagtggcagttgcaagttgggggtacgatccaccgacgattattgcattattggcatgttgagatgataatgcaaaagactttagaaccgatgcttctttttttttttttgcagcgtagactatgttgtgctgacaagtgttgatagagatgaccttcctgatggtggaagtggccattttgcgcaaacagtgaaggctctaaaggtttgtcggtcgccattcagttgtgccactaaattggtggttgtactgtactgaagaaacttttagcttatcttcaggaattgaaacctggtatactggtggagtgtctaacttcagactttcgaggtgacctggaggcagtttcatccttggcaagctctggtttggatgtgtttgcacacaacattgaaactgtgaggagtctgcagagaatagtcagagatccccgagcagcgtaattctctctgtgtttttcattacagccacaaaacactgtatggttgcctagatgttaaatctgaagtacttcgtcattaatacgccctccagagctcatgacacccatacagaggtcctgaggtccaggattgtcttaggcagttaggctatccaataataatgactgttaacctaccacatctaattttgaaaactgaggttgagggataatccttgaagaaactatgtaaaatctctaatgtcatcatattgactcttggcaatgtagttattatcttatttccagtttattatctcgtttccacagatacgatcagagtttagctgttctgaaacatgcgaaaaattgcaaagatggtatggtaacgaagtcctctatcatgcttggtctaggtgagacagatgaagaggtgaagcaaaccatgtgtgatttgagggccattgacgttgatattctgaccttgggacaatatttacaggtttgatctttgagcaactttgccagcgctttttatatcctcctggacttcctttgttcttgttgttgtatcatccaatgctccttgcttatacagccaacagaaagacacttgcgggtcagagaatatgtgactcctgagaagtttgatttctggaaggagtatggggaatctctgggttttctttatgttgctagtggacctctggtaagcttcacataaagtctgctattcttatagataaaatctaataatatgagcaacagtatttaaagaaaatgataactctactaatggcccttgttttgaaaggaatattgctaccgtcgtatttgaaccatctagatcatgtatttcctggttatccagacaatcttcaaaagagaaaaggcccttctcttttgttggttgttaacttggtagtagaattttatgcatatttatccttgctactgttgatgacttctcaggttcggtcttcgtatcgtgcgggagagctctttgtgcaaaatttggtcagacgtaaaaaagccgagcttgcacctactttgcagtaaccaaataggagtattactactatacatctgatggcctggtgcagttctttgatgaaagttttgcattgaagttgtgtgctgatgacaggagtaaggaggtggcacaatcgggaccaaaggcctagagtgacatgcctataggcgctcgttgttctagccatgctgtgatatctgctgtagcctgtaaaaaaaattgtttttcactttcttactcgggctgtcaaaaaagtgtatggaaaccagataaaataataccgaatgctaaaattcatgttactgcccatgacgcttcgttataacgctaatgtattcgcgtccattttttggtgtatgcgaaaacaactcaagttaaaaactgaaaaagaaaaaaaaaagggcgcggtcttttggctgatgatgactgaattaaagtctgtaatttcttcagatctagccgttactctcctgaaaggagctgattggttcgcgatcctgaattatacaatcatcgtagtgtttcctggtgagttgctatcaagatgtagtagcaactagcaactggctggcttgcacgatggacaatttgtaatgagatttctatcattccgccagatgtatagcttcggttttcttactcagcacaacggggtggtggcgcagttggctagcgcgtaggtctcatagctaaaacgtgagtaatcctgaggtcgagagttcgagcctctctcaccccacaaaatttggccgagtgatgatgaaatgctccgtgaccgattgggtcgtcacgaaaccatctatttcccagatgtcaagagctatactgagctccggcctcttatttttattccattttaatttacgcgccgcaacgcaacttccatggacgcatctggaccaccgatttccaatccaacgaacactctcgctgccgcggccgccgcctcctcgccccatccagcactccacgcccctagaatccatccgccgccgccgcgatgccgcctccgccgcacgccgctttcctcctccggtcccggggtctactgcctcctctcctccgacgaagccccagctccggcccgccgcctccgctcctccgcccgaccaggcagcgccgcggcctctccgtccgcgcctccgctgcggagctcgccgccggaggtttgtctgcgcgttctcctttctaagccgtgtgtttgtcgtgagtagactcggtgtttgcgtgtgagctttgatgttacaacacagtggaatggctggggttcgttgcagttgcaggggtggaggatgcggtggtgggcttcgtcaccggcaagcggaaggccaccgagttagcccacgcgtaggtactaaacccccattgttgcgtagcgtgtaaattatctcttgtttttacctttgagcctaaaaagtaattgctactcctatactgcgttagttacaatttacagtgtgtactgggcaagtatgaaatgggaattttcttttcttttgacagaatatggaatgaaagttctgttaacgggaaatgctctctaggattcagcgggagatgtgtaaaagaatacgtgtacacattagctattcacattttgtcttttggttttctcattagggtgtggagaagtattgttcggaaaggggatactgtggttgatgccacatgcgggaacggcaatgatacattcgctatgcttaaaatggtagctgatgaaagagtacaagggcgtgtatatgggttggacattcaggagtccgcgatagccagcacttcctcttttctgaaaatggccgtcaatagccatgaggtatgcatttgaaataacttcaagggaagtggaaacaaagattttgctgctacattgtgttagaaattaactctcctagataggggatacatttaattttctttctcgtttccaaagattagcttatttataaatgagaataaaaatggacagataatgttgttgatagatagcagagaaagatctaacaatactcatatatgctgagtctttttggttttttttatctctttgtggtgttatggtcagatcttagtatatagaaacaaagcatcattgccatattcccaggaaatatctgcagttttggggttgttgcaataacttatcttggctgcagctcgaacttgtcaagttgtttacaatctgtcacagtagaatggaggaggtcgtcccaaaagatttccctgtcaggtgagttctgattcacatttattcctagttaccaactcatctgttgacaggattcagtaacagtttattgttgaaattattggatcaagtaattaagatctttgaagtgttgattgaattattaatggttcttttattttctaggcttgtagcattcaacttgggctatcttccaggaggagataaaacaataatcactgtacctaagacgactgagctggctttgcaagctgccagtagcattgtcagttctgggggactcataagtgtccttgtctacattggacatccaggtggaaggtacatgcgaatgctaacaatgtgtccatgtacaatacataggggctatcaactgcttgctcgttgtaatttcatacatattctagatgtgcagttatatatgctagattgaactgtagtatatgatgaattaagttaacaaaaagaatgtctttgatgataattttcgcatgtttttaacacatcagaaaatctttttttacagtattgtattcaaataattttaagacttgattaatttatcttcttttgttatgatccttaggaatgaacttgatgttgttgaatcatttgcatcaagcttgcctattgatacctggatgagctgcaagtttgaaatgctcaatagaccagcggctccagtactcattctcctgtacaagaaatgatcacaccttctatgacctacttgtggggaatgacggagttagtgagcgaccacatgcttacttgcatgccaagtgccacaatgaccaaggattcaagatttgaagttacaaggcatttccataggattttactgggtggacagctgtgggtattgataacaacttttgagagcttctttttcgccaggccaacttttgagagcttcacaactatatatatgtttcaagcactgcagtttaaacgaagggcaattgctttgagccacactcgtgactttactcctttttagggttgtgttgatgttttgtattggcaacaataaaggggtagcacacgagacattaaagtggatggatgcaaggagacaagggtttagacatgtttaggcataccctactcttgtttcgtggattggatctgccggattgtattgatcatggtgttattggttgtgttgatctcgtggatctcttgcctcatgcctgtggattggatctgtcgaattgtattgatcatggtgttcttggttgtgtctatcttgtggatctcttgcctcatgcctttgaagggactccctgttcaccttacatatgaaggttaacaaggaggaaaaacacaactttaattttgtaatctatacaacgtaatattcagccgaagctctataccctgccttgagacataaggtaacatggcaacaaagtcctactctatctaatattacatggatgcattccacctatctgtagtcggatatgtaggctgtgtgggaacatgataccaataacctccacaatagtccccgagatcttcacagttgagttgcggtcttctttgtgattcttgacgaatactgagtgcttcaatcttttctatgaaggcttcccaagtgtcaaagaggttgtagagagctttccaaagaattgacaaaataggtgcatcaaatagatgcatctattaggtgtagcccatgactatgtgcttagttgagtaaagaataataatcattgttagcaaagtggcttacacctggacgcaatatatatggtgtgaatccccgattgatatgacccgagtgatataccgattacataaaatgtgatgtgggcagctctggaccaaccgcgtcttgagaatatgatgcgcgtaactctgaaccaaccgcgacttaaatcatgtgtttttcaatcaacatctgacttacataaaaagctagtcgcgatgcttcatgagcatgctaatacccttagaaaataatattaccacacggtaatgcttaacgaaagaggcattgggtaaaatagcacgtgggccgtcggaacaacaccacccaagacccaatagggcatgcttaattcaccactcctggttgtaattgggttatgaacgcaataggctcttggcagtgacacgataccgagtcagtcggtcctgcatgaccaatccactagaccacccctcttgtcagtttcacgcctttgagctatgatgacggtgtggtgcggatctaacccgcgagaaatgtatatttctacaaatattttaaaacatgtatatgtatgcaaaattatgaaaaataatgtatactttaaatttcaattccaaaaaacactaccaggaataacaaagattaacatgattaatcttaacttattgaaaccatcatcatcgtcatcgttataggagtactgttaagcattaaaccaaccacaacaacacgatcgagagatttttgttccagttccttcagcactgacgcgcaccatcaatgaagaagcatatcaatggagcaatgggttgacgacttgaccg

SEQ ID NO: 25909 - DNA, 8758 bp, Oryza sativa
gcaggtcgactctagaggatccccggggtcttcccaagatttgtttcttcccatgagcactcaattagcaaaaatcatctaatctcgcgagccttcgatgcctcctcgactgcaagctcgcgagccaaacgagctggacattctccgagaccgagaaatttggcctgtgtcttgatcggaagctggttgagctgcggcggcgggggcgagggatagctatccttttcctaggttaaaaaagtgtcagcttaagtatgatactcccttcgtttcaaaatatttgacaccgttgactttttagcatatgtttaaccgtttgtcttattaaaaaaattatgaaatatgtaaaactaaatatgtacatgaaagtatatttaacaatgaatcaaatgatatgaaaataataaataattacttaaattttttaaataagacgaatggtcaaacacgtacttaaaaagacaatagtgttaaatattttgaaacggagggagtagcaactggctggcttgcacgatggacggacggacagtttgtaatgggacggccgaaaaaacgacgaatccagccaccgaaaatcattcgacaaatgtacagcaatttcgtttctgttatgcgtgagatatttacctttcagcctaaaagtaagcactactactacattagtgcaatttacagtgtactgggcaactatgaaatgggattcttttttgacagagtatgggatggaaattccattaatgggaaatgctctctaggatttaaccggagatgtgtaaaagaatacatgtacgctttagctattcatatctttgtcttttggttgtatgattagggtgtggagaagtattgttcggaaaggggatactgtggttgatgccacatgcaggaacagcaatgatacattcgctatgcttaaaatggtagctgatgaaagagacaaagagtacaaggtcgtgtatatgggttggacattcaggagtccgcgatagccagcacttcctcttttctgaaaatggccgtcaatagccatgaggtatgcatttgcagcaacttcaggggaagtgggaacaatgattttgctgctacattgtgttagaaattaactatcctagatacgggatacatttatttttctctctcattttcaaatatttttattgttctttagaaatgagaaatgaaaatgaaaatgaacagataatgttgttgatatacagtaaagaaaggtctaactatactcatatgtgttgagtttttttgggtactctatatgctttttgtggtgttatgctcagaccttagtatatagaaacaaagcatcattgcctcatgaaatgtctgcagttttgtggtcgttgcaataacttttcttggttgcagctagaacttgtcaagttgtttacaatctgtcaaagtagaatggaggaggttgtccctaaagatttccctgtcaggtgagctagccattctgattcattggtattagaagctacctactcatttgttaacagggttcataacagattattgttgaaattattggatcaagtaattaagatcttttatgttttgattgaattattaaggactctttattttctaggcttgtagcattcaacttgggctatcttctaggatgagataaatcaatgatcactgtagctaagacaactgagctggctttgcaagctgccagcagaattgtcagttcggggggtctcataagtgtccttgtctacattggacatctgggtgagaggtaaatgcgaatgctaataatgtgcccatgtactgtaaggctacgctgattgctcgttgtaattttttatgttattctaggtttatagatatacatgctagattgaactgtggtatatgatgaattatcaaaaagaatgtctttgatgatgattttcgcatgttttaaacacgtcagcaaattcttgttttttgacagcattctattcaaataattctaaggctagatgtatttatcttttgtttatgatccttagggatgaacttgatgttgttgaatcatttgcatcaagcttgccaatgaagacttggatgagctgcaagtttgaaatgatgaatagaccgtttgaaatgatgaatagaccaatggttccggtactcattatcctgcataagaaataatcatagcttctatgaatctacacattgttttgagtgactgagcgaccacatgctcacttgcagtagcggatctaaaaaattttattgaccccgggcaagccactgacagatgactagtactacaaatgaaaatgaacttgtacaactctacggaccattttaccattgacacaagtaaaattaacagtacgagctaattggtgtaagagttaaaatcgatatgacgattattgtgtattatcaaagctgtacgcttgtatatgagctgtgatggcatatatagaatgcaaacatgtgatggcatgagccttaattatatgctttgctaattttctcaactaatcaaacattcattagggtaattagttaaaaaatattctattgttgcatgattaatgaagtgctaatctactacagcatcttaggcggagcctggccgggccttggctccgctgctggtcacttgcatgcttatagtgtcgtatggcgggatgttaagaacaatcacataaaatatattgaacaaccaggatgttttggaatggaaaattttgaagcatggcctggattgttgtttcactttccctagtaaaaatatactatatttaacttttatagttcaactttgaaaaccttgtctaataatatattcaaatatattatatataggagggagtacgagagaccaagaccgttgattttaccgtcgtatgaggcttggttgattttcccgtcgtatgagatagcttttttggtcgtgggggacatatgccccctccccgttctctcgagtgagaattggagagcatcaccatggaactcaacaagttgaggtgttacgctgccatggtcaccatattgaaacaagttgaggtaccacgttgccacgatcaccatattggagtgtactactccaatgttgtactccatcattcacaaatttttggaatacaactttgatgatcaatttttctttaaatattctgatccaactttcaaaaataatatggttagatttatattaaataaaattttaaaatattataataaaacaagtgcattggtgaccgtgtagttgtctaaaacattacttattttgtgacaggaggtactattaaccattaaccataggcatttatgaactatcttttgtttaacttgtgacccttaatattttactctgacatgtgatgtggagtatcatatcactagtaactatatgcttttgtagttagcgtttgaaattttagttcaaaatttccaaattttcggacccctggcatgaaactatttcgcttgaaattttctataaaaatttgaatatggtcaaaatttattcaaactcaatcaaaatctatctaaatttcaaattttgtgtcctgaaatttctaagatttcaaaattttagccccaatataaatatgtaaaacgaaatggcaaaccttgcatgtgcttacaccatgagtcttattggtgattatgaaataaacaataaattttatgtaagtggattatgggtgtgtttagttcacgccaaaattggaagtttgattgaaattggaatgatttgacggaaaagttggaagtttgcgtgtgtatgaaagttttgatgtgatggaaaaattagaaatttgaagaaaaagttggtaactaaaccaggcctatgtataagttggacaatatggattcgtgttgggccttcgtggccatggcaactgtggagagcgcccactacatcaagacagagcacctcgtccctctatctgagcagcaactggtggactacgccgacatcgccttgaaccacacatctaggagggcattggagtggattgccgagaatgacgggatcaccatgcagttagactatccataggcaaggaatgcaactgtgatgcctccaagctcgcccaccacaccacatcgatcacaagttacaagcagagcgacaacagcagtgagctcgcgctgatggtagcggtggcacatcggcccgtcgtggtggatccgacatcgttcatatcatacaaggttggctctatttacgacaatccatgcttaacggagaaaaccattgtctaattcgtagtaggttatggtgaacaaggggccgacaaggatagcgaaaaattcttacgatgcagatgcaaaacaatgggataacagatacatgttgctccgtagctactgaaagatggggactatgcaatatagcagttctccttatttgtccatcccatttgtccattgggcggatacaatgtggatgttggggggctggagcccccacaaaaacttttctattaaaaatctgaagtggggaacttggacattagaacatggcctaaagaccgataatgggtatgttagatcaccattgaactaactgtgtaatgtgaatagtgtggcaactaatagtaaaataaagagtaaattgcagtcacagtataagtactccatccgtcctaaaatataagtatttttagagttggacacggttattaataaagttggtaggattaaatagaggaatgttgtgcttggaggagaagtggaggcaggtgggaaaattgaatggtggagggctgtgattggttgagaagagaatgttggtggagaagttattatattttaggatggagggagtaattgacaagttgagagtagttactatcagaacaacaagttgaaatttacacgctttggtacaaataactttggcatagtttttgtttggcgacgccatgtttttggcacgtgagtcctaagtgggccgagttagttgtgaaagattgtaaaggtggatgggccaagtgtttgggtctaaagagtttaacttataaggctatgttccgacttttccccgtgcatggaaaacggggttgattattaacatataattaagtattataaaaaaaactttaaaatagattaatatgatttttttacaacaactttttctattgaaaatctgaagttgggaacttggacattagaacacagcctaaagactgataatgggtctgtttggggagcttccggtaactacaacttcctgtagaatctacaactctccaaacaatacaaattgtcacctatattataagaacaacctagcttctccatcaaattctcagaatctttaactctcccaaatagggccaatgtcacttgatccagctcgccaagcctactcaagttctgttttcaataagctactaagaattatcttgttaatctttgttattgttgctaaacgtttttggtgcctgatgccatcattcttgtatgtttgtgttgtgcactaacggattacaaaaggaggccaggaaaaccatctggcgcatgactatccagtcaacttccatagaaatgcagtctagtttcttttgcaacgcatagtaaacttattttcaaataatttaagtctcattacaaagccctgtgcatcttagatttctatcttgtttcttactctatcgaactcgcattttggcaccaggcagtcttctagattcaaagaggttgcagattgcaggctgcaattgagtcaatcacccatgcactgctcacaactctgcctccagaagcgcaagcaagagcctgagcatcagcctgcctgcgatcagcagccttggtttcggccttggattttgccctatcttgattctcgaagctgtaaacgatgaggaggtcagagctgtcatcaaaaagcttttgctggtctcttgatacgggcttcctctgaagaactattccacctgctgcaaccacgagatcttgcaggtagcctctgtaggattttgtgtagtccccatggaggtagaacctcatgctgtcgaacagcttaggttgctgcaagggtaaaaaagaacaaaaaacaatgtgattgttaggcgtaaaaaatacccacgtgagattgcttagaagttagaacacatccaaaattccaaatgtgtggaattgtcaacaccaggtctatgaatttattctatggcatgcataagtgcagggctgcatgaagtattacggcctgtttcttttaattcatagcaacatatcatgttggtggtactttctgcttgtcctcttttatatcaagctaaaattgttccaacggacaagtagatttggcactgttttcaggttaacaccaattttgttctatcaaaagatttttttagtgatccttgcaagaaaatgaggtacataacaatggcaagaaatgtttaccctgtcaataaccctgcatcttcctaacctaggaccatcagtgatcccatgaacatcagtagcgacttcaaatttgtgctcatcaattggttccatgcactccatgcaagttttaacccctatgacacaaagttgtcagttagcaacaaggggcaccagatcaatatgaatataggctgttcagcacagttatattagtagcacatggccttacaatctatggagacaatccatctgccattcaagattgccatgagaaacttcagcgtccgtttgcaagcaccagagagatcagttgatgcaataacatgggtaacatttggactccaagttgccgaaataggcacgccagctaactttgcaaattctgatacaagttcctgagtaatttattcattttgtttcagttgtaatgcatatgaaggaaatgccattaattcgatcagggtcaggaaaataagactaattttcgaaagcaccttctcagaactagaaagtgatgagcagcagagaacccacttctgtggtgatccagatggccatttccagttattaccacaatcttgattggatcctatttgagatgacctggaaaagccggttattctacagtaagtgctcgtacatgtcaatgttcaaccattaagaaacatgtttcaaacaacaggttcaaaagataccctttgagtgttgttttccttttaggttgcttttgctgttcagaattttcattgggtaactttgtagaccgatgtagagggcataacatcacaaaattttcctgccaatgaaaaaattgaaacaaaacaataaggtacagatttatggctgtcaaacgttcagaaatgattctggtatagttgaaaccactgcctcaaaatatatataaagaacaccatatggacttacattatcccatctgcattctgggattagtttagcacaggtgaagtggaaacttctccgacaactcatctcaaagcatccaagtgcagctcctttaattccacagcaagcacatttgatccgtctgcttctcgccaattcagttgtaagattaaaggcagaatcatcttcgaagtagacatcaggagcccttcaagaaaataataaaaaatattcagattaatattgcatactgaaatcttttttttttctgatattatcttgcactagaaaggataacaaaccactcaaggcagttcttgtgagagtgcaccacattggctcctccattgaactctgcagggacttgtttcccattttgataatgaaccatctctccagactcctaaaagagaaaaggagggagatttggttatcttctaggagtatgttcattagcagggaatatgttagatttggagaaaaggacatttgcatataaacacggcagaagtcagaagatacctctgtgatgacatcggtctggcagaaagcacaggaaaccttcaaagtagatacctcacacttcttcagtaaaacattacgtgcagggcatgcttgaaggtttccaaagttctccgttccaaaacaatctggttgttcgctaaattttgcttgcttgtacttaacagatgcagtccttactgaaggagctgtacatactgcctctttattttggcatttcccatgtaaaataataggtgtcattgtcgtgttctcaagtttattcttaccttcctgttctccacaaactttgctatgtcttctagcgttggaggatttgcgttgaatgctgccttttgtgagggtgtgaagctgtggtatttctgtttcatttccagatcctgaaggaacttcaaccggtttagctatagcgtggtcagacattcttctgactctcttacttcttggctcactattcttctctgtagtatctgaaatagttttccctgccatttccagcttccttgcacttccctttcgtcgactagttttctccaagttttggatcctttcagaaaggggtttgtcaggtgcttcaacatccaaaccctccttaggaagatatgactctggggagttatcactagagccatgaattggcttgctgttgctagaggccttgtttcttctacctgaagtattcctccctacagcactgctgcttttctgacaagattttagggcagcacttttacgtctatttgaaccttgttgattggcatcagacttttttatgcagggctcagcacgattggacaattttgcactgttttttgtactgggacttgttttctttctcttctgctttgttgcttttgtattgacaagctgagctgcattacttgcattacccagcttatcaaatgaaccaccaatatgcacatcttcttcatcacccttctcttcaatttga

SEQ ID NO: 25910 - DNA, 9348 bp, Oryza sativa
tgtcaaagagttctgtagccgcagctttgctctgaaactcatgtagcaaaatgagaagccaaaagaaaaattcaaaaagaacggtagaggtggtcagaagaacttacatttggagttgtatttaaagggatttcgtcatcagaatctttaatatcgctaaaagagggtgcattatgacgcaagggtgtgtctaaagattgcgtttcacttaacgtctcagcggtacagccttcttgttcttcttgttcccttagccaaaaaaagggtgacaatgaaggacttccaggttgacccgatgccactgctttattctttccttcaacatcattattcagattattttttggctcttcaggcttcataatcttctcagctcttattggtgtctcagattcagggaatggtttcacttgtattcttttgttagtagagaaggaaggctttgtagtaggttgggatgcagaagctgtagcatcctttgctgtatttttttccatctcggatgttaccttcctttttcgtgtcaatgatttttgtgaccttttggaatttttcccgctgttgacacaatctgatccatcttcaaacatgaacaagatagtgagctaaagattgacaactatccatcttctctaagcatagattttttttcatagagagccaattatccagcaagcattatgttgaaatgaattcaataatggggtacagacaaagaagcacagaacaatcactgttaacttatgttgacaatgtagcacagaagagatgcaaaacaaacattgtaactgaattgaacagtgtagtacaaaaaaggagttacaaaaaaatcactttaactaaatcaatcaatgaggttgctactttgcacatatgctagaaaatagaataagaacatgctacaacacaattacctgcaagttttaccacaggagcctcctgtgttgagacaacattggtacctgctgcagcctccatgcttttgaaaatgctgaccagattgtccatgtgaggtgctggtcgcatttctgcaagcaaaccaagcccttgagtgtcagttttggaccttgtagatatcaagctgaagccatttaaggtatcatatccaagtttccactaaaggtcaagttcatcaaatacagtacttcatatcaaattttgaaatattgctgaatgaggtgtgctgcccatgctcagcgaaaagcaaatttatcaccggcagtccgataagcactactccttcagtcccataaaaacgaatctaggaccggacgtgacatattctattactacgaatttggagtacataagaaactctaatagttcaatgtccgatccatgagtgacactaaacctaggcagttagtttaattcgtgtgtttttcatgcctatcacgtgattaagtagacacaattcagcaagagcacaacactaacctcgtcgtcggaacgggaccttgcacacggggcagctcgacgtggatttcatcgattccgtgaggcaatcactgcagaatggggaaaatttcagcatataagcccgaaatggagaagaccatccaggacgctgtgaattttaactgcattacgacgaggcggaatagtgagagatgaagacttacttgcagaagacgtggttgcaggagatggataccgccgaactgagaaggctcaggctgccaagaacaagatttctaatcaatacaaagcacaacaaatcgcaagccacacgaacgaaaagaaaatcgcccgtgagaaatagttcaggaccacggagagaatcaaccaacaaaacatcaggagaaaacaagatggccgagaaaaaagagagatgaacccaagaaccaaaaatcgtcctagaacgcgaatccaaagacgaagcgcaaaaaaggaaatcgaatcgatcgagcggggaatcaaacattcaccagatggggcacttgagctctcgccccatcttctccaggctccccgtgtccgccattgccgatccctcgatttctccctctcgggcgtggagtccttgcaagatttcagatttgggaggaatgattgcgaggagaaggaggagggatttgggggaagattttatcttggcgggagttttccctccagagttttcgttcaagttcaatctgggcggtagcttgtttgggaaggaggctgaccgctggagggagtagaggcgacgcggcggcgccaaaatctgccacgtgggtcctgcttgtcggtgacactggctcgtgtgaaacgagttgaaacttggaacattgcaggagtttagttccaaacttctttaaacttctaacttttccatcatatcaaaatttttctacacgcacgaacttccaatttttccatcacatcattccaatttcaaccaaacttctagttttaacgtgaactaaacacacccttaggtaataacgtaatcttattttctctaataagagttggataaagattaagatttttatgtcacgtttttcaaactgctaaacgatacgtttcgtacgaaaactttttatatgaaagttgctctaaaatatcatactaatctatttttcaaatttataataattaaaactcaatcaattatacgttaataccaccccgtttttacgtaaaaaaaacttcatctacatattaggagaaaataacaccacctagtctgttgcccaagttttctaatgagctaaaatgtttcattagaaaataaaaaataaattttaggtaaaacatttaaacgtgtgttctttaacaacttagaagtaaatttaaaaatatattaataatattttgaaatcaacttcaaaattaaatttgaaaatttaaattttggttgtttttcttttcatgagttggctcctatacgtgggaaagtgggagaggtgcttggactaggccacttgggccacagagattttacacatttttaatggttgtaggagttagtattattttcggttgtggggtatggatcggctcaatatatatttaagagagttaaagtgcacttgggatggttagattagtatgtgtttggtttaagggacggagtgggttggattggatcgaactcactttttaaggtgtttggtttgggaataggtgagaggggatgatccctgaaatggatattctcctgagatttggattggactggttcctcaaaaactagcggatcaatccaacccacttttctttgacatatgggtcatcctctttaaagtaagaccatcacatccctcgtgctaaatagacagacgagataatcgcatccgaaactaaggatgagtccaacccatcttacctcatcccaaaacaaaacacatacttagattatgggagtatctagatcctaaaaaattttggccaaaaatatcaaataaaatgtttggacacatgcatggaatattaaatatggacgaaaaataaatcaattgtacagtttgcatgtaaattgcgagacgaatctttgagcttaattgtgttatgatttgacaatgtgatgctacagtaaacatttgctaataacggattaattaggcttaatagattcatctcgcagtttacagacgaaatctgtaatttgttttggtattagtctacatttaatactttaaatgtgcctatatacttaaaaaaattggccagcgaactaagcaagccctatctttgggcacttcgggtatttggtcctttgagacagacgactgaagacacctaaaaaaatgttcggtctttatcaaaagatgaccgaactagaaacataagattagtgttccggttttttaaatcggttttcggtctcgttttattttgtccatctctgtgcacccacccacacatgtatcacatatcaccacacacgtactaatagtagttaataaaccatattttggtattcttttaccatctaatcttattttccacgcgcgctcttctcaaaatgctaaatgtccttgttttctgcatttatatttttcaaactgctaaacagcgttttcaaaaaattctaaaaaaatatgctttaaaaaaatcatattaatctattttcaagtttattttagctaattaattatgcgttagtaaatcgctccgttttacatacggggaggtaaagtttctcacctcacttctgaacgcaatcttacacgcctacaaaatattttctagcatgcatttaaataaatggagaccaatgataattcatagcctcgctaaatttctatagaattggtattggaatttaaaccctaataaggtcatacacccacgactctcgtaacaccccggtgcatttacttccacaaacttttgccggtctctgtgcctccatttgatttggataaaaatgagtgacgtttttagccgaacagttcttgagtcccatggtcagaacaaattccgtcactgggcattacatttgccgatgaaatgaaataataaagggttgggtaggatcgtgcatggaaacaacaccattaatcaagtaaaaaaatcgaaacaacaccaagatcacgtacacaatccggctagcttcgaaaggaagttcaaaagttggggagaaaacgagactgtgacggacactttcgtgttttttccttgtcccaagaaagatggggcaacttgatgatcatgggttgataatttggtgaattaatcgcgcactcgcatgcaaatggtgccggtcggtacatcggttgtagacttatagctgttaccgtgtgtggtgagtcttaatcaatttgcatattagtagatgggtgaagaaattgtgcgattacactaaactagctagctgcattgaaccatggctctgttgatcggtttgctgttgcatcatacacctgacgccttagggtgtgtttgagaaggaggggattgaggagattgggaaaatacgtaaaatgaggtgagccattagcacatgattaattgagtattaattattttaaactttaaaaatagattaatatgattttttaaatcaactttcctataattttttttgcaaaaaacacaccgtttagtagttcgggaagcgtgcgcgcggaaaacaaaactatctttctctctttctcctgcgctcgaacgcagccttaaactccatttttcgagtcatcagatcaactctagcattagaacaagtttaatagtacagcaattactaactttaaaaattaatattttagctaatcaaatagtttactcatataatagtaacatataaatatgtactacatcatgaatacatggctcatctcttgtgcatacaacgcatttcctttctttctttcttctccatctaaacacttagacctatccactttttaatactcgctcctaccgtcgattggggcggatccagcgtgggtgctgggaggactcgagtccccctaccccgctagatcaccattgatagaaggggagacgaaagggcaataataaagagaaaatgagagtaggggagattgaagaaggaagaaggagataagtcccctcttaaatcttcttctggatccgcccatgatcgtcggagaagatatatagaccctgtttggatccagggactaatgtttagtccctgtcacatcggatgtttgaacactaattagaagtattaaacgtagactaatgacaaaacccattccatatccctagactaattcgcaagacaaatctattgagcctaattaatctatgattggcctatgtgatgctacagtaaacatgtgctaattatggattaactaggcttaaaaattttgtctcacgaattagctctcatttatgcaattagttttattattagtctacgtttaatacttctaattagtgtcaaacatctaatatgacatggactaaaatttagtccttggatccaaacaccaccataagcatccagtagtagactacggtgatgatatccacactgcaagttccaagaatcaatcctgccaagtggtacacaaaaccataaaaccaacgtgcacgttaaacgttttgtgtgtgtgaaacccagtttcgtttttataatccctcctggtgagcagctgcacatgcaaaaatcaaaatacagttgtctctgctctatacttgtactacaacccggtcggccaggctaagggcacgtacagcgggtctttttgccccgtctctgtgatgtcttttatgcaaaaaaccccccggttgagtcaagcgacgggagctgcgtcctctcgcgaggcgatggcgacgacccgtgctccgaggcggaagaggcaagctcagcaccgttgtacgagctcgtcgtcccgaggcgacggcgcggcaggatcccgcgcggagagcgcgcgcgcgggaaatttccccgcgaaatccaggttcgtccaactcccctcccactcccccaatccgggaaatttgctccagcatatagcgcagcaatctctcccaatctcccactcccccaatctccaactcccctcgcttgatttgggtgctgctgagatgtccacggcggctgcaggtaggaagaagaagggaggcacacctgaggcctcggatgcggcggcggcagccccagctcgtttggaaaaggcattctacaatttaattacttgactctaaatttttttgcatcatgcagcattttatcctaatgatattgaggttatattcaacttttgagagaaataaaaatctgatggttgtttatattatgaattgattgtggattggatgaagctatctctagatgttactctgtttatactacctgattattaatgtcagtaatcccttcctttgttatatggttacagtagttagctagaaccctgtaactgaaatgaactagctgccatgagataattcgcaaaagcgagccaaactcaaatgcagagatttagttagctagaaccctgtaactgaaatgaactagcttgttcagtgatacactatactactgatatggagtatatataatctagggaaaaagatgagcatattagccttttattgcattccttttctttttgtactctctctatacatatatgtctctatacatatataatctagggaaaaagatgagtatatataatctttcagcaggttcagtgtatgtctctatacatatactttgatgagaatctgcaaatgatcagaaaggggaaatttaggaaataaattcagagcttgatcattggaggtatatactgggagctaaatattgatttgattgtggtcatggctgggaggtatacatcctggtagatatatacatcctgtgaggtcagttggaatgccgagaggtctcattcagtttcagtttctgaattaatgtgaatgtgatttgtaaatgcgaatgtgcacttcagtttctgttggaatgtgaatgtgcatgcttcaggttcagttgttgcaatgtgaatgtgcatgcttcagtttcagtttctgttggagtgccgagaggactaatttgcttatgtgaatgtgaatgtacccttcagtttctttctggaatgtgaatgtgcatgcttcagttacaggcattatgtatatgtgctcctttattatgtgaatgcttcagttatgtgcatgcccgtttctgtgaatgtgaacgtgaattcaagcctcaattttatactataaaatggaaccatctactccttttcattatgtatatgtgctcctttccactaccgtaccctctactccttttcattctgtaaatggagccgcatgaagatgatgacttcctagaagccgacaattttgaagtgttcaccgtagaagagttgctggcagaggatgagatcatcgaagagttgctagcagaagaattcaaggctgcaggtgatggagaagcttcgtccgtatctcgccgtcgtcgacagagtggaccaaggaggtacataccaagaaatcgagaacgaggtcatgatgatcttgtcgctaattacttttccgcaaatcctatctacaccgatgaaatgtttcgtaggagatttaggatgagacggccgttgtttctgcgtatcgtacatgaacttagtgagtggtctccttatttcacccaacgagttgatgcaactggtaggaatagtctttcaccgcttcaaaagtgtatagcagctatcaggatgttaggttatggaaccgcggctgatcaacttgatgaagtcttgaggattgctgcaagcacttgtttggaatgtttgggaaaatttgctgaaggggtgattgaaaagtttggtgacgaatatctacgcctgccaagagccgatgaattggaaaaaatcttacaagaaaatgaggctcgtggttttcctggaatgtacggaagcatcgattgtatgcattggccatggaagaattgtccgaaaggttgggcaggcatgttcactagtggtaacaaaggcgttcctactatgattcttgaagcagtggcaactaaagatcttcgtatatggcatgctttttttggtactgccgggtctcagaatgacataaacgttctaaacaagtcgccactatttattcaagcaataaaaggggaagctccaacggtacactacaacgtaaacggaacacaatatgacatgggttactatcttgccgatagaatatatccagaatgggcagtattcgtgaagacagtgacggcccctcagttggcggaagacaaattatttgcattaaagcaagaaggggcgaggaaagatgtcgagtgcgcatttggtgtgctgcaatcacgctttgatattattcgtcgaccagcaaggttatggaagcagggggacgttatcaacataatgcaagcttgtgttatccttcacaatatgatagtggaagatgagaaggaagcaattagagatgtcttggatttgaattataatccaagtgcaacgatagtgctcccgcctgaagtgcaaagaagcgacaacccagatgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaagggggaacacaaggacggtttgtggctatttgcataaaggcggt

SEQ ID NO: 25911 - DNA, 6564 bp, Oryza sativa
  unsure (1)..(6564): unsure at all n locations
tccacgccggttggaacgagggaaggtgcgggatcgccgaagggagtggcggcgttggcggccggttgnaactgnccggaggttgggaatgacaggtggggtccacgggtcccacctgtcggcctgagtgagaggggaggccgggagggaggaaaagcagacttgcgccaaaaaggggaggcaagccgggccgcgggaggggaaggagagaggattttggcccgagcccgaaagggaggaaggggaagtttattttgttttctttttatttaaattgatgcaatgacctttgtgctattaaaactatttctcgagctccgaaaattcacggaaaattccggagagtacattagggcacaaagaatattacaaaatattcccggccaatgatttttaagggaaaattttaattctcccaacatttcacttggataaattgatttaacttttatttaatttctagaaaatgtattattaattgatttttaaacccgaacgaaaatcggggcgttacaaatctaccccccttacaggaatctcgtcccgagattctgggatggctagaaagaaagccggtgctggtgggcggtctgactgatctgcacattgaactgccacattctgcttcgaactgattgattgactggttgatcaaacctgcacgattgcactggctggattcgacctttctgttcctttgctttgccaaaactggaccgactggttctgcttgaactgacctaggccagaactgcggatactcctgaaacttacttatcttggactgaactgttgaggttggcaattttggtaacctgagaattcaccacgctggctataagaggatgaaaattgaatctggcatttgtaaatcatttaccctatgtccgcttggactggtcccaactcaaatgacaagtaaatccaggaaacctgcttgacctgtctaagctaagcggttgaactggcctcatgggtgtaccttagaattcaatcggttgcccggggatcggcttaattcttctgataccttgcaacttgcttcttcaagtgctaccctgattgcggcactggttgaaccttcaactaaaacagcgacgaagtgaggcaaaactcttctccgagacctacccccttacagggagtagtcttacttccgcgtggctgggatcagttgaactgttgtccttcaaatatagccaacacttctctgatttacaaagagccctgactttgaaaactgaaaacttcatcggtccatcaaattgaagcaatggcgatgcactttcaccccgacaagatttggaacttaacccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgttatgttgtgagtagacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttcacaaagaaatgccgaagggcgagaggagacaatttgcaagtagggttttcagaaaacttgtccttacggtttgaccatttggctcaacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaagggggaacacaaggacggtttgtggctatttgcataaaggcggttgtaaaacattttattgagcaaaacagtaaaactgttgagtaattaaagtaatattaaatctccactgatcaacgctacaccacgttgaacaggcccaaccaacccacctgtactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgctatgggtgcgactcgcaaaaccatgcatccacagcccaccattcagtcgcattttagttggataattacgaccataaaacatggccagatgtctcgagcacgcagctcaacaagatactagaatgtctaatactgcaattatcccatcgactgagctagtggtaattaagcatggctaagcatatagttctagctaggtcacataagtaacacaagctagtcaatttattacccaaggttgacaaagaacagatatcaagtaaacatggcgcaagcgagcagataggaaaaccctgatcccatgtaattagcaaaacatgcatatttatttgtaaacggtaaaacatttataaattgggatcaacatgctcaaggagaatgtgtgacttgccttgcttcttcactttgatcttctgaactcttttcctcgcgaccgcggacttccgaaacgacggaaactacacgctggcacgcaaaacgaggaaaaactctaataaacaccaagaaaacagtacataaaaagtaaacaaacatgtagagctcaattttagatgaattttgcaagttgaatggctcaattcggagttcgaatgaattagatatgaattttagaaggttttgagccattttaatgaatttctagaattattaccgatttattgcgcaatttaaatcaattatgacgtcatccgacgggggagaggtggcgccggcaagcgggccccacctgacggtgactcacgggtggcgggcgcaccgtggaccgagtccacgcatgcgctggtccgcgggcgcaccacgtggcagacacgtggcggccacgacggacggctagcggaggtggcgccgacgtggcgccacagaggcaccgacgcgggcggcacgggaaggccacgtggacggcccagatcgccccgaaggaggatcgggcggccacgggcgagcgggagccagctcaccggtcggccggccgggagcgacggcgcacggcccgatggtcgccggcgacgaccaccggcgcgacggcacgcacgggaggcgacgaaaagaggggaaagggaaaggagatgaagggggtcctcaccgaggagcgccggcgacgggacgaccatggggaggcgaccggcggcggaaaggatggcggcggccgacacgggaggcgacgggaacggcggtccgacgacgcccgaccatggcggagccgcggccgagggccggcaagacctagggaaattattggagcggttagggagggaaataggcgaccggagcggcgagaataccacgccagagaggagaggaatggtggggctcaccggcgaccgagaggtaccacgttccggtgggtttccggcgatgaacaacggtgaccgaggtgctgcacggcgctgcgaggcgagaggtgaagacggagcgacgcggcggcggctaaggcgacggtggcacacggctggaggcggcgtatggtggaggtggctcgggatgcacggtggaagggtggttgcggtggtggaatggggaaacggagcggaggccggggtagagcttggcacggcgttgccgacggcgcaagcggcgaggtgcggcgacgactaacgcagcggcagcggccggctgaaggcggtgtgtggcggtagtggctcggcctcgcgatgggaaggtggttccggcggtggaggagggagatggagtggatgccggggtgcggtggggtggtgtgatgctataggtggtggcggcgcagcgcggcagcgacgggagcggcggtggcgggcggctggagatcgccggcgagcggcggcgaaggggatcggcgtggagagctcggtagagggcgtgggggactcgggaaaacggggaaaaaggaagaggagtccacggggattgatttgatagctcaagggggcgaggagagggccggggagcggcggatttcgaggggaagtggggcggcgtcgtgggggtgtggcggctcggcgtggcgttgattcccgcggggagagagggggagtggggcgggatgtggtcgcgaggtggaaggggtctcgggtccacgccggttgggacgaggggaggtgcgggatcggcggagggagtgggcggcgtgggcggcggttggagctggccggaggttggggatgacaggtggggtccacgggtcccacctgtcggcctgagtgagaggggaggccgggagggaggaaaagcagacttgcgccaaaaaggggaggcaagccgggccgcgggaggggaaggagagaggattttgggccgagcccgaaagggaggaaggggaagtttattttgttttctttttatttaaattgatgcaatgacctttgtgctattaaaactatttctcgagctccgaaaattcacggaaaattccggagagtacattagggcacaaagaatattacaaaatattcccggccaatgatttttaagggaaaattttaattctcccaacatttcacttggataaattgatttaacttttatttaatttctagaaaatgtattattaattgatttttaaacccgaacgaaaatcggggcgttacaccagatccatgcttcacagaggtacttcgtagaaattccgctatcaaagctcggccaacacataggaagctaaaaaaggatctaatcgagcacatatggcaacgctatggaaacaaagaaaattagactaaaggcattgtaatataattattatatttatggttcctaaaaaatattgtaatcgtgtatcttattcatgcttgatagtattatatcaaatatatagccacacaatggtatacacaaatgcatttgtagtttatcaaagctacatgcaaagcattaaatagcttacagacagaccctctgtctgtgggttgtatgagctgtctttatatccgtctggatgataacttcgaggttcttgaagacacacccctgtatgtgggttgtacatgccctaacactcctactactaccactacacgaatagcaagttgcccccaatccgagacgtgcatctctaccagcaaaactgcgtgcgactttgacgaattctgcctcagcgagtatgcccattggctgcaacaatataattcgcttcacggtcgctgaatttttccttcccggtttccattgaccttgtactggtttgtgtgtgtcggtatttcccttacaaaatgatgagttggtgtgtgcgcgcaggcgcagcgcgctactggttcaaagcaagcagccacaccttccgcgaaccgatcgttcgatcggtccagccgcgtccggtttaatataaaccggcacccgtaaagcgattggcaattcaatcggtattggattgatcaatcatcgccacctcgatatgcttgtctacttcgatcgccgtctccgcagccgtcgtcggagaggaggaggaggaggaggaatatgaa

SEQ ID NO: 25912 - DNA, 6746 bp, Oryza sativa
  unsure (1)..(6746): unsure at all n locations
nnnnnnnnnnnnnnnnnnnnnnnnnnnnnnnnnnnnnnnnnnaattatctatccaatgatccgtacgttaagtttgaccttctgggatgagccgatgtgtgcacctgtcgaagtttgggcgcgtccgacttttgcatggctacacgctgtggcaacatcaggaattcaggatcgtcccagtacctctcactgtcccagtgatactcagaccctgtttagatcacaccaaacttgctttaaactcccaacttttcaaatcacatcacatcacatccaaaactttcctattcacgtaaactcctaacttttttttcaaagtaccaactttttccaaacttctcctcaattttagaaactaaacacaactttatactacagaggatcttacggctttgtatagggagctaaaaatatgagaaaacaactggggaacatatgaaaaaaaatggacgtcagagctttggttattggagtagtttatttttctaaattttgtagctaaaattatttagggtgtgttcgctggagctagatcctaactagcacagtgcacacggaaaacagagcggtcagttagcacgtgattaattaagtgttagctttttttttcaaaaatggaacaatatgatttttaagcaactttcgtatagaaactttttacaaaaaaatgcatcgtttagtagtttggaaagcgtgcgcgcgaaaaacgaagtggagggagccaggaaccagccctcctgaacaaacccttagattcgtccaaaacagatattgttgatgagcttattctggtacgtgaaacatgacggatcatttggatataaataataaactattataatcttgaaaactatatttatttgattttacaaaaattctacatataaagttttttaagaaacacattgtttagtaacgaagtagcatagttgagatcaattttagaaataattctatatataaagttttttaagaaacacattgtttagtaacgaagtagccaagtcaagatcaatccgatccgaacgcagcctaagaaactagagattatagtagaaactacatgcgcacttactaaaactatcctaaacttgacctatgcgacagggatggactcccttcgacgagtttcctccgacaatatcgatccagcaaccaggtcagctcttttcttcaccactaccctcctccatgttgccgttcgccctcgtcggcgccgaaaggcataaacctgtcagcgtggcccgtctagttttgtcccagtcccagcaccagctcaccacttgctatcaaccgcgcgtctcttgcgatcacggtgtagtctcgccaaccacccctcctccgccttccagaccatttctctaagcccaattctccatgtggtgtttttttctcctgaagataaagataaagataacgatgaagattaactgttttatgtagaacgtggtggtattaacgtataattaattgagttttaattattacaaacttaaaaaataaattaatctgatattttagagcaactttcatatatagagttttcgcacgaaacgtactgtttagtattttgaaaagcgtgatacgaatatccaaaattttattcagtttttgcagtgaaaactaacgggtttgtctcctcattcacatccggaatcctaaaccttgaacctaatcccacagctggtcgcgacgtggtctgaaaacgttcacgcgcgcgatggacgcgctcacgcgcattcgttagttagttagtttggatttccggtggaatgcgatcgggagacgggcaggccaggcttccgaccgagacgccgccgaggccctagagcgcaactcccaaggctgtagaacaatccgtggaccgcagcgtctctcagccactcaccacggcgacgtgtcatcccatccagccatccgtcgtaccccacgtccaaatcccagagcaccaccacatctcccccaattttcccagccgcgaactcctccgagttggttggcctacgcgcctagccagctagcgacaatggccgcgtccgccgccgccgtggcatccaccgcgccgccgcagccgctgcggccgcgccgggggatagccgtgccgtcgtcatactcacaccgcgcggcgacgcggccgcgcctcgccgtctcggcgtcctccaccaccaccggcaccaccgagacgacgagcgaacgcggcggtgccgagcggttctacttcaacttcaccgggttccccttcccgctcgggccgttcctcaaccgccgcaccatccgcaccgaggtaattaaccccgcctgaatccttctgctctccggcggcggcggcggcgcgtgtctaatggcgtcgaacgaagcaggcggtgaaggggaggatatgtctgttcgagcaggagcaggcactggggttcagcagcgtctccaccaacacccgcatgaccgtcatcaagctcaagtccggcggcctctgggtgcacgcccccatcgcgccgaccaaggagtgcatccaggcaagcaatccccgatctcccccgtctcctccgattcagcctcgtctcatgtcgccgccgtgcagcttctcaaggagctcgacgcgccggtggagcacatcgtgctgccgaccttcgcctacgagcacaaggtcttcttcgggccattcaccaggaaattccccagggcgcagatatgggtggcgcccaggcagtggagctggccgatcaacctgccgctggagttcttcgggatcttccgggccaagcccctccaagacgaggacgacgacaccccatgggcgggcgagatcgagcagaagatgctcagctcgcctgaagttggtagcgtcactgtcaccaaccaattcgagcttctatttcatcagcaaatggatgcaatttttttttatagctgtgtgcaatggtgtgaatttggtgatttcagggattggaccctatgtggaggtggcattctaccacaagccttcgcggacattgttggtgacggatgccgtcatttttgttcctcggcagccacctgagtgtatcagcaaagagtcgttgctggcatctgccaagaacggcttggcagtgaagattttgagcaaaggaaaagaggtcccagatgaaccagttgtggacaataagctgaaccgtcagaaaggtgattgtagtgagtttgatctgtactgtctaattgcggctatgagtgccatgccatatacaagaatcactttatttttaatgtaacctctgaaaagggtggggagttcctgcttttcattaagaagaagagagtagtgctcattaagaaacaaaaatgactgaaactagtgaaatatagtgctcatggtttagcagaaatagtgttgtagcacactagatcggtatgcaccagcctctgtttatcttttttgggtctggagtgcataacgatctttgttaaacaaaatcgtaatgttcactgctttgtttctgtttctttggtttgctgcatgacattctaaaaaaaatccttgcgaagctcatttggcaattccattctctgtgaagcttcagtgtaagggcttgaggtattcccatggactccatatgcctactatatcgccatatcggttatgaggtctttactctgtattatcctcaatgctgatattcagtttttttcgtcttcgctgtaatgccaaagattattgcctgtcctcagacatttaattttctgctcaaagcataagcatctgatgaaaattacagcataatgttttcttttcatagaatagggtcatatatcttccgcattgaattgataatactagaacattgcagtaaccttgttggtgtaacaacaggatgggagcgaatggtactgcaaatattgtttcttggtccctcaaatcttctggagccaaacgcaagttttgctcaaatgtctcagaagttgattgtctccccaattgtgaagacacttgttttcagcaaagttccagagaaggtatgttcatgtggtgaatggaaactataatacactagtatctgctgaacctggctgaacattaccttctgtgcttttgatctataggattcataaaacttagaattacaacttgaatgttttccacgggacgctacgaccacacattttatcctttgggtgtcaatatcttcagcttgtcattacaagctgcctctagtcagaagcatttcctttttcagttgcaaacctgcaatgtgtatgtaaatgagtcaatcatgaaaagttgcatgcccagactagaatatgaagcagctttaggcatccttcctatgtgctaccataatttatgcactgtctgactcattatctaaaaaaattgcactggctgacttgcaagttttatataccattgaagtgctgaagtggaatgacctgagatcccaccaagtagtatttctgatatttctattttgaaaaaataaaaaaaatcttaattttttgaactagcattttggtatttcacacttcccatacatttctcccaatgtcaagccattgaaaatttgaaatcgtctgcctctgcaggtgagagactgggtcgacaggatcgctgcagactggccattcaggaggataatcccagctcacttcgcagctccgattaacgcgaaccggtccgacttcttggctgcctttgctttcctagatgagttcctccccgagcgatctccagcatcgcccggcctctcactcctctttgcctcgctcatgggcaaggcggcgagctacttcccccctgatgacatgaagaccctgtcatccctggacgagttcttggtttcagttggtgctgtcaagaagacagtttcaggcagaaagcgatgatacggagagatactggcagatgtgttgttcatagttttgtgttgagatgagcttgttgctgctgtacatggttaacactactaaactgtactccctccatttcacaatttaagtcattctagcatttcccacattcatattgaagttaatgaatctagacatatatatctatctagattcattaacatcaatatgaatgtggaaaatgctaaaatgacttacattgtgaaatggaggaagtatgtagttagcctttatccaggattatattgtatataccttactgcagtctatagaagaggccaaaatgtttacaactcagctgaacatctgatgattctctatgactgggtctgggtctggtctatttggcatgactccggctacaacttcagaaaagtccaactaacggtttcagttctatctaaaaaagagtgaagttgctgaagtgattaaaaaattaactagtgatgtggagcaggtttaaatcgctcactatgtagcatctatgtcgataattcaagcattgtatacgtcattagttcaattcttcgtaggaactacccgtgagcttgcaaaatatatctgtttattataaagagatttgttgttcctgaccctgcttcacctccacaattttattacagactacgctcttttgtagttagattgagaaggccctatgagaatttctcttgcccgggctagcagagaggcattcatgtttgtcattttaatgggggtggtggggttcagtttagcatttagagagcacaagattagaatgctgtgcacggtgtctgtgaagtaataattccttgttcagatcgagccaagttcagttaatgcagaaggtctgcatccatgagccgtcacaagccaaagtacatcatcttctgtatcctcacgcgtcagacattaaccccattataaccactaaccaacgcgttatacaacttctgatctaagtgcccactccatcactttcctcagatagtacacgcttttgcactactaacagcgacttgtacatgattttttcttaaagacacatagttagatccacatcaactctgaaaatgtgaagaaatagtagttcaaagctgcacacaatcacttatcactgtattttacatgcctttgcactactaattgtgacttatacatgttcttttccctaaacaaacatgattagctccacatcaattctgaacttgtgaagaaatagtagtacaaagctgcacacgatcactactactacaactgtattttttcagactgagaatgtgtaaacctcgattcctactccactttcctagtgagcaaaaccatcaaaacgtccccaaaattagcacagctcattgcacacgctcgctggacttgtctgaactctgaactcagaagtcagaactgacatccttgtcaggcaaaggtagttaagtcagttaccatcaaaagatctgaagaacggtaacataacgaccaacagtgacaaattttactggagtacgttaactccctgtaactgaagaagggttcagattgcaggctgtaaaataaaaactggagcagtaaatacgaaggcaggtcaaaaccgtgagagttaatgcgaaggggtgaaactgacgacgagccgccattaatttctccaaccttttctccgtcacaggatgaggcagagcaccatttactcctcggcgccgcgacgccaacggcgacgccgaccacagggtgatcatcatcagatcagaagcaaaagagcaggatatatacacacgcatgacctcatgaactactctcatgtacagggtaaagagatgaaaaaaagaagatgatatgcctttggcttctcattgatgatgtccagcccatcagccacagggagaaagagatgg

SEQ ID NO: 25913 - DNA, 3384 bp, Oryza sativa
ttgttcttttaaactttttttaaaaaaataacgaatagcacgagatagtatgtttcatatcgatatgccgggaaaaaattacaaagactacaactcgaaaaggttattgttagaaaaagggaaaacaaaacacaccaccacttgctttaaactttgagataatccaaaaaatgtcactgacaggcgtccaaatccaagaaataatatcgacaagtttgagttccaaaaaataccattgtacaagcgattttatccaaaaataccattgttgttaggattccatccataccgcaccattaagtgctacaggatgaacaatgtatttatcgacgtggaatggatagaaccctaacgacgatgacatttttagacaaagtcgtttgtacggtaacatttcttagaactcacgcttgttgatggcatttcttatatttggacgcttgtcaataacatttctttaattatctcttaaactctaacttttggtgagctgaaactgaggactgaaatacattgcaaataattcagtttaagaccggggaatttgatttttggttagctcggtttagtcttcagtcatgactgaaacatctggtagttttatgagaaaaaaaaacagataaatcacaatcgtacatgatacttcataggcttctagctattatttcgatcagttcaattaagtagttaaccgagtgtaatgaccgaactgatcgtatctatttatcttagtaagaatcacagaccgggatcagtttggttaggttttcggtcattttgcttgctccttccctatgctgagctaattacgaaaggctaaccaacatcaagaaaagagtaaattaggttcttgccctgtgtaagagcaaagctaataatacagccgacctgttaactataagattcttttgtagcattctcttagcctacccatataatagtgaactctttacaattaatatagggcctacttgtctctctcatagagttttttggttctagtgtccaagccagctgtaagtttacagctcgcttctcctctctctcctctcttctctctttcatctcagcatttagccggtttatagcctactattatacttgctctaactgacgagagatgagtgtaaatatgtacgaaaacatgtaaaacgttcgttcaagtgtctccaggacaacatgttattaatcttaacgaatcagagctaaaacagccaagcaagcaaaattagcgttgttattgaatatagtaccatttttattgattcaccggcggttcaaacttcaaagagccacctatcctccgcaattgcccccgcaaaaaacaatatcaaaccatacctaattcccaccatttttttcttttctgtatttaaagatcgcataaaaagttcaccacctttactacaaggtaaaattcacacgtcctaactgtaacaggcacttttcaattcactgttctatcaaacctgtacagagtacggccattggagttgcctgttggaaaggcctagaactgatacaatatgtggtgtctgacactttagcccggcaacacgcatgttccttttgccggtccagccaaagtgatccaaccctgtacagcaaataagcaatccaggacctgtaaatcaagctaaaataggcatggcctggatggaacagtcaccaatcacccgtggcatcacagccacaggacagtcaaaagcgaggagcaatcagttgggttagtactgaattaatatgacagctccaggacattgtaaactttgtgcccacagcaaccattattgattttctttcaggtcctccataaccactaatttacaagtaatgtatgctgaaatttgtggtgtaaccaaaacaacagaaggcaatagcaagccccaaatgaaattcacttgaagatctgaaatgtgaagtatggcttcattcatcaaacagataccaaaagacagggaaaacaacattgactgaagaaataaattggtggatggctcaaattctggggaaacaattaaagaagccacgttgtaataaacttaaaacaaccaagacagccgaatggtaatcaacatgagttatccaacgaacaaagatagaaactcagtcaaggtagtattaatgtgtgattttcttcatgagttagctgccaaacaaagatacaaactcagtcaaagtagtactgaagagtggtcttcttcagctagaaataacatctgaagttcaaactgcagcacagggaatttcgattaatcaaaatggacatgattgacagattaatccaagatcccacatgatgacatcaagcagggtatctttagtgcacaaaatgatccaagctagaattatcgatgctaaagctaacagtgcaattgtataacccagcaacaaaggcaatgaacacacagggaatttgagcatacagcaggctaaggctcctagttccaaagatcatagctgcagcacaaactctaccatctgaaaagttctaaactcttctcaggaaatatcagtgaaaaaacaacggtaggaatgtaacaacaccatgacaatccacataattctaaacctcaaattgcatcgcaggatgcgaaccacaggttatctcctctcctcgtcaatccttctcggctccatgtacacaggcattggcgccgcaagcccgggcttggcatgagcacccctcttactgtttgagcgcttcctcgcctcagcttcagcagagctcgaggtctcagagctctcatcagcatcactgccatgctcttgctcagcctcatcatgcagctcttggactttaccattaccacagaaacctaccttcttcttgttcatcgctgacggattagccgcaaatgcggcattgcaaccttcatggtagtctttacaatccaattcgccattcattgccatctccccatgctctttgactagcaccttatcaacaaactccaagatccgggtaagctcccggctcaccgcgcgctttccctcacggatcatcgggtcaccgccctaatcagaaaacccaagatcagaacaccgttccaatggaatgcctacctaattgaatatgcccatggtacgggttctcatcacctggatcgagtcgagatggaagaggagggccatggcggcctcagaaatggcggcggggtcgcccaccctgcctcgcccggagagggagccccggagcgcggcggccttggaccggaggacggcgagctccttgaggtggcgcagcgtgcgggaccgccgcgccaggaagcggcggaagtgcgcctggatcgtccgcgccgcccgctccctcgctggtgaaggcggagcccgcgcacggcgtggcggcggcggcagcgaggccggtgcatcctcgtcgtcgtc

SEQ ID NO: 25914 - DNA, 19861 bp, Oryza sativa
ctgcgggggagtcggggccgggggcgggggcgcggagccgaggaggagatgggccgcgatggcgtggaggaggtggtcggaggcggaggttggcgcgggcgggggcgggggcggcacggggtagtagtagctggtcggcgcggggtagcagccgccgtcgcagccgcagcagcaggagcagcaggcgggcggaggcggaggcgggtcgtggtggtggtgacgaggcatttctgcggatcagatcggcgcggcggcagcggcggcggggaaaatcacatcggggagcggaggggagaggggggaagggaaagggagagtgcgctgcgccccacgtgctccggcctgtctcagcacgtcgcggcgccgcggtttcgctcgctgacgggtggggccgccttgggtttccgctcggggtttatcgactggttggtcggcatccgtggacttcatcggcggctggccctgccgtgggttccaatgggtttggccttttttttttccggcagaattacgtgccgtgctggactcgcatctcatcactagacccacccgaagctgcccagccatggtacgatggttgctccatttttcagcaacggaaaggcacgattgcaacgcagcatcaaaatctcatcgcaacggaaaaacggattaaatggtagtagagcgaagaaacggcactgatagttaacgggtactgagatcccgtaccattgactgcatatcctaagtcaacagaagctgtacaagtcacagtaagcactaacacaaagacccggccgagcaaaatgtgttctttcagttcgaagtgtgccgtcaagagatgtctacgcaagagaatcattggaaacatcataagattcgtagtccctgcaatgcggaaattcatatagtatgtaagtcaaaaccaacagcctactactacctccaacccaaaatatataacaatctaatctagtaacagacaagatacctatccagattcgaaggttgctatatttttgggagtacaaaatttggcaggacaagtgagcgacaatgtatggtgcctagtgcttaccctctgttaaattacgaaggatgttgcgctgcagggttactgggctatcattcgtccttgttaaagaaactttcaggtaaggaaaattcttctccttgagtgaagttatccttctcgtcgtcctctggcttctgcatttttttcagaccgcatcaaaagtgtgtccagactccataaacaagtcgtaaacttatccatagatcgaaatctaattaattccgtgtaaatagaaaacacaaattcatagttagtagagacatagaaatgagaaagagattattggtatttcaaattaccagcatttctaggttgaagaatcggtccagtagttgtaaaacttcatcagcagagaattgtctatcaagactgaaggaatttaaagatggtcagttcagatcagagatttcatagaacagaaattaaattgaacatatagtcacctttttctcaagtattccattagaccatagataacaaagtgacgatgaatgcctacaaaataaagtacagcagatttattagcatataacagcaaaaggcatccttcacaagacatatcaagctgtatgcagcaaggttcacaaaagacaaaacaattttagtaaaaaatgccaaaaccaataaaggccagccatcacttcaaactaaagcccaaaaatatacaacaaagaactactaagttcacaaaaaacacaagacatgagatgcatatgatatcacagggcatcatgacatagagatgactttgcatttggttatcaaagacaagcaagcacttgccgccagaaaacactataataacgaccagtataactgcaagaccactaaacaccatggttcatcctccaattcaattaacattttgagttttttttttaagttatgtagcctacatgttgttttacattttatgatttattcctaatttacagtatcgtctggtgaaataagatctcttaaatttaggaaattcctaaaatgtggaccataccccacagtaatggtgtggaagctatgcacgtgccacaacaaaaagtcattgtggaaaactggaaattcaatttatgtaatatgtaacctaaattacttatcattcaactgatcgagtttcgttacatagaatgctacaaagatttgcagatactaatgagatttgaggtgacaataaacggataatcaacatggatacattaaaacaattagccataaatggaattgcttgaatcaagtgtgtgcattagcaacctgacttgcagagcgtaatttctcagccccatgaaagaaacagaaaactcaagctgcagacttagtattacattctagcctattcaactcagaaatgctttgctcttataaccttcattgcattctattaaacttagtatttgatggtacacttaaggttactcattcccagactggtcatcattactaaagaacctaaataagcactcctataactagctgtgcagtagagctcaaatataatcatgtgttaatattagattatactccctctatcccaaattattgggacccttgtagttcgagcaacaaaggtccccatattttgggacggatggagtagttgattagcaatttctagccatacaaggattttatagtaaactcaaaatctaattgatcaaagacgacttaattgatcaaagatgacctgattatggcatttatcagcaaaaccaacgaaacaagcaacttcatgaatttttggttttcaaaatagaagcgaggcatggtttcctaaaaagaggacgaggcccacaaaaattatgcataacccacttaattaatacttccatgaatcggtgtagaggtccaaattattctcactatatgaaggggggacccactctacctaccttagttgaatatcaacaataaactcctacctatgtaattcattgaacagtaacattgagaaaaaaggggatttgtaagtgcggtgcagtgggcgggagcgaactagatattccttcatatgtacaaatgtacaaaacttgtagccgtaaacccaaattgtgttatgtgcaggaacagaaatgatagagtactaaggatgccatattcattgttttgctcttttaggtgttattacaactgttgtcaagactatccaaactgacagtggcaggcttataattccaaaactaattaatcacgtatcctcgcacactcttaaccacggtaaatgtgttaatgcgatttcaaaacggaagatccaacctccaacctcacacatagtcacatagagctgttctctctttctctaagaaaaaaaggcatcatgtcagcaaacaaaagatcaagcaaaaactaaatacacatcagagcacgcgaaacaacatatcaccagaatgggaagctaaaggaaataacacggcgaagcatttttaacctttcagtttggacggagggtagaactcgagagcctgaagcacccgcagctccagctccacctgcgattgctcctgtacaccaacaagcgcacacacgacaaggacaagaaagcatcaacctcagataacagtcatgcgcatcccttgttcgtaagaaaaaacaaaagggggggagggcggggcgggaccttgggaagggacgaggcggaggagggcggcgcctgggccggcgactgggcggagatcccctcctgctcctcgtcggcggccgcctccatccccgagctccctttcgccttcgccaccgcggccgagccctagcacgccggaaacccgaggggaggggaaagctggaccacgcaggctatgggagacgagcagcattcggccaccaacgataaaaatcgagcaggaggagtggaggcccaccaccaccggcccaccactgctcccggcctggatgaattttggggccttatgggtgttgtcaaacggaagcccatttaagaatggacttcacaatataaagggtcatgttgggcagagtaggcccagatctaacgttttcacaagattactcagaaatattctgatgaagattaatagccaaaataaaccttaccaaattttggcattaccaaaattttaacagaatttcttatatagtaccaaagtttggcaacaaactaaatgtatgcacatttaacaactttgccaaaaaaaaagtatagttagaaatgacatcaatctaaacagctcctgctcattagacttgagattttactacgggatgggcttgaccaaaggtttctacaaatcctaaaaattacatgtgggatggtctaattcatagtaattttgcaagaatgtagcgtgggctcaaatctcatgcagatcttcgtttgtgttcattctctctctagatttgtatattgttttacctcaagtatcaaaataactaagtttaggaattatgtgtgtggaattctaaaaattcaagttaactacaatcctgcttttacacctttccaaaaccacccacacagtttttaaagaaatccacacactctaaaatcttactattttaaaagcagagtggacattctggccatgtgatccgaggtggcatggttggagaacactcccacaccatgagaccactccacctcgcatgattttttcttacgacgcacttccaaattttacgccctgttatattgaaagtttaaacatctatttaaaatattaaatataggctaaaaaataactaattgcatggattgcgactaatttacgagatgaatcttttaagcctaattgctccatgatttaacaatgtggtgttacagtaaacatttgttaatgacagattaattaggcttaataaattcgtcgagcggtttattgatagattctgtaattagtttttttattagtgcttgaacaccctatataatatctgatgtgacacgttaaaactttagaaccctggatctaaacaccctctgacatagtaacattacgttgttcaactggttgggttgtgcgtgaatagtttctcaagtacaaagagacagttgtgggctgcaactgcatccctctgtcctaaaaaagacaaaccccgagtttgtgtgtccaattttaactgtccgtcttatacgaaatttttttataatccgtattttcattgttgttacatgataaaacatgattaatattttatgcgtaacttgtctttttaaattttttcatatttttttcaaataagacggacggtcaaacgttggacacggaaatcagggtttgtctttttttttttttttgacggagggagtactgccttgccacgttaactaatatagtgtggtaaaaaaaaatgcaaatttggaagtaaaatatttcattgtgcacgtaagacgattctaaaaaatgagacagtttgctatagttaaaaactgtgttactactagaacgtttaatctaagagactgttgggggaatctatatagatataaaatttagaaaacgaactataaatcagaatatatgaaagttcagttttttctattcttatatgcttttactaccagccaactaattcagaatcttaaactctttcaaagaagtttatgtaattttcaacccattagcatactgccttctggaacactgaagtagagttaagtaaaacaaaactgtcaaaaagatataaaagatataagagcatgtatagtagcagactattagccagctataaacatattttagtgagataaattatgagagagaagagcaacaggctacagccagctgcagtacggactctaaaacacagtgtgtgtatgactgatgagaccatatattaatagtatagtaagcaactattgtataaattgattattaggttaactataggtaaataaaagctagcagtgaactatactattaaactttctctaagtagccgacctcctagtggcccatcatctccatcatcacctctctagaacacacatcccttttgcctttcctcccggatcgaacctatccgttatttaatccgacactgggtaagttttgtcggaatgatacacgaatatacacaacttctagaatatacttcttcgtctcattaaaaaaatattttttagtttttatacaacttttctttttcatttaacttcctgtaattattatttttaattatttgatgataaaatataaataatattttatatgtgattattttaaattttctaataaaacagacgatcgaatgttgaatacataagccatgtttagttctttggccaattttttttaagtatacgaacacatatttgacgtattaaacgtagactaataacaaaacaaattacaaaattcgcatgtaaaccgtgagacaaatttattaagtctaattaatctatcactagcaaatgtttactgtagcaccatattatcaaattatggagcaattaggcttaaaagattcgtctcgcaatttacacgcaatctttgtaattagttattttttattttatatttaatattccatgcatatgtcaaacatttgatatgacatggtgaaaaattttaccaatggatctaaggctgtgtttagttcctttcaaagttgaaaatttaggttaaaattggtacgatgttactgaaaagttatgtgtatacgacaggttgatgagataaaaaaaattaaaagtttggatataaacacaggctaaatagtcctgaatataaagtcccccagaatccgaacgttagccccctctccttttcctgtccaaaaggccatctcctccccaacactgggccgcgccgcatcgtctcccatgccatgccacgccaaagctggacagcgcgctgtaccgtgcgcgcattgtgcgcacaccgtctctctctcccctttccccctgagacagaggacgatgagtcaccacctcaccgccttggcttggctagcactagcagtagcccaacacagcagcgaaggggagaagaaagaaaaataaagccgttggcatgcggacacggcggcgcctcgcccaagggggggggctctcctgcacggtcacgcacgcaccactgtgacacacaaacgctgccacgctgacgaggtgttcagagagaggagagaaaaataaaagaaagaaagggaaaaaaaagggtctcgtctcatggtcggtcggtgtggctggctgatggctgtgctcgccgataaaaaggacaccgaggctcggtgaggttgacagcactgcacttcacagttcacaccaccttccttccttcccgactccccacaccggccggtctccttctcgctgcagggagagagagctcgagctcttctctgctgctgctgctgccatggcgattccgttgctgctgctgctcttgctggccatgtccacaggctcaggtacgtgaggccccagcccaaaacctgcatcctctgcgagaaagggacaagcaaatcgaactcgtgtctgttcagttgttcttgagtttcttgcccatttttgttattaccaccgtgcacgtagttgctcgtaggaatctttgcctggagcaatggctcaatgtttatcttgcaatttcttgcgcatagcctctttcccccttttgttcgtgtgcacagtagaaacatcgaagaggagagattcactccgagcctctgctagctagtgctagatttgaatcagatttgagacatgcatgcattcagttctgaacttttgagctaccgatttgagctaacctgtgttcccgtttggcggcggcggcgagcagatggggcgttctgcgtgtgcaagcccgaccagagcccggcggcgatgcagaaggccatcgactacgcgtgctggcgcggcgccgactgcacccagatcatgcagtccggcgcgtgctaccagccgagcaccatcgtcgcgcactgctcctacgccaccaactcctacttccagaagaacagccccatcggcgccacctgcgacttcggcggcgtcgccaccctcaccaacaccgaccccagctccggcacctgcaagtacccggccaccgctaggtacattcccccaaaaaacctccccttctttcacatccttttttcttgtgttcttgttcagattaatggactatggttaatgtttgtggttagtgagttcttggacctggaaaagaaatgagagtatcttaggcaatctgcagttttggcctgatgctttgcatcaatctagattcttttatgtgagcacgcacggccgtactgactgcagttagatttgtttaatttaccgagaactcactgatctagaagagtatatactgtttctgcgtctaccaatacgtatattcagagccgtgtatcatgctgcgagttgcaaatttgcaagttggcagcgccgaacctggaataatatactagttgaaagttgaaacaatgttcggtactaccaaaaggttgcatctttccatgcaaaagtagtgttacttgtagttcatagctggtttgctgctttgcatatggttcttgtccatgtgaaattaaaaggcattcttaacggatcttctaatcggagcttaaagcaacgtcttttgtggatgaaagcggcttgccggggtctgccggccgccgcgctaccctatctcaaagtacattgcacctacacaccagctcatcagtatctgcatatacactccactcagactacctttcttcagtctaagcatgtccagaattttcagtgcacaatgtcttcaagaatttataaaggaggtttcttactttctttgctcactactacgtctgattttttgtgtgcagcggcgtaggcaccggaatgggaaccggaaccagcaccggcactggcactggagttggcaccggcggcaccggcactggtggcgcaggcgtcggcgcaggcaccggcacaggcgttggcacaggaaccggcaccggcgcaggcatgggcaccggtgctggtgccggcaccgggatcacgaccccgggatcgaccaccggcactcagggaggcgccctgagcccaccgtttggcggcgcatatggcccgtcggccggcgccatgaaccccgactacaacgaggccgcgccggcgcgctcccagctggccgccgccacctccgtcctcctcgccgccgcaccattcctgttccatctcatctagagccacacaagggggcagtggattccgtctcgtcggtggtgggggcgcacggcgccggccggagtttggtgggcattgcaatgcagcggcgttgccggcgttggtgctttgtctcgcccgcgctttccggcctgtgccgccacccctgctggttttgatcgatcatcagtgtattcagtagtggtactgggagtactccttcagtagtagcctactctctctgttattcaactgacgaactcttctccctcgtgtgccggtgactacccatcataccatgtggtgtgttgtttgtaccggtgcaaatgcgtaggtgaagagagatctagagatattctttcgtggtagtagcagtttgtgtgtgtttcggacatatctgtgttactgttcaccgtgtgtcgtgttttttatgctgctactagtactaatagtagttggtggtggccgcttttctagcttgttactcctcagtgcgtaccatgctaatatgttgggactcctcgttgtgaactcgtgctgctcccctgcgccgtcacgtgctctgcaccgcgctacgacgctgcgtcgcacgcctggggctcaggcgagcacatggacggtttgcacggacgtggtaggagcagcatccgatctgggagatgtgttgggtgcagtggtctggttcgatctggaggagtattttgtctcgcgagctttcgggagacgtggggttccatcgcggtgcgtgtgccgcgcgaaacatgccgacacggcgagaccgacacattggcctcgcgaggtggtggtgatctcttcgggactcggtgcggtgcgggaccaggccagatgcgcgcggtggcgactggatgcgtagacccggtgaccggcccatggctccgcgcagcccacgacgtcgcccgctgatggcatgggctcctcctcgcctcgcgatgtgcggctcggacaccggaaaactcgttccggcctgtcgctgcaatgggacgcgctccgcttgatgatagtcgagtctaacattcgttcctaaaccgaaatatcaggtgtatcccatcctcccactcactataccatgcctaagtgttagctttggtccctcgacagtatagtgaccggttttggctccctcctctccctctccttcttccctctcttccccatctctcagactctcaagcgtgcctcggacatcgtggccctgctcatcatcatcacctcgtcggcatcctccacctccaccgacctcgctgcccttctcgtgctcaagggcgtcatcccccacgaccacgactctgttctcaccacctagtcctcctccaccaccaactactaccttaggcgtggtgttccctgtcaccccaactacgccgcggtcgccgccatctacctccccatggactccctctttggcgccctccaggccttcctgcccccgcaccttcaccgcctcgaccaatccagtaacttattcgagctcatccctgccgtctttcttgcctccccgacaatttgctacctcaacctcttcagccacctcttagggcctctccccgctgcatgtcggagccagtcactcacctacctccgcctctccgccgccaatgttgtcaccgtccgaaatctccagggctcgtgcaatgccgctccctcggcctcatcaacctatcccacaacgtccatgaggggtccatcccttgctccctcgctatactcgccaccctccgtgtcctcgacgtccctcgcaacagcctcaccgacaggatccccacacacctcatcgcctatcaaaacctcgtcgtgctcctgctcacgaacatcatcgccaaatcacagagggaacaaccaaagttcaacgcctctccctcttccctctcttgccttgtcgttcctttccacacgcacacagtgtcgtcaagctcaagctcaatatacttgtggtcatcgtcgacgcgtcgtcacctccattcaccgatggccccagctgacgtcatatcccctcttgtcgggcatcctctagtagctgtggactgtcgtggcccctacttcgctgttgcgcgccgctggagcccccttcttgccggccgcctcgctccagggagaggggcaagagggaacgagttggtcgctaacatgtggggcccactcgcctcgttagtcaaaaccagccattatattgctgagagaacaaggttgacacgatagtgttagtagggaatgagctatacctggtattttgattcttgaatgaatttcagactcaacgacaaattgtgagggaataagttcaccagccgtccctccactttacgtcgagtctgtctgaggcccctaatctccaataccaaaaatcttcacccctaaactatataaaactgtgcaatttaggtcctataccagtatggatctctggtttcgctgacgtggcatcctagtcagcaaaataaataataaaaatatatagggctcacatgtaagtgatatgaaaaaagtgggatccacatatcttttttcttctctcttttctttttctctcttctcctcttctcttcaatgaaggaggccggcgatgggcggagcagcgacgggtgagcgcaaatgtgggtggcgggctgagcgctggcgggcctgcaaggccagcagcaggcgagcgcggcagcggtcagcgggcggagggcggcgagcggcaggcggagcggcggcggatagagcagcggtgggcgagcgcggaagtggacctgggaggccggcggctggcggcgctcttcttcaacaagcatgagaggctggcggcgggcggcggataaaacagtggtgggcgagcgtggtagcgtagtggcgatgggcgaacgcggtatcatgtggcgggtggaggagggagccgcaacggtggaggtagccggaggagaagccatccttctctacggcgacggcctactccgcccgccgcgtcgtttgtcgtcctcgtcgtcggccgagccatccttccctacggtgttcgcgcgagcgcgcacctatcctcggaggtgatccgctccttcatggagctacgtcgcctccggttcgagctcaccacggaagaaggcgtgctggccgccatcgtcgctccgcaccccgcttgccctgctcttgacggagagaggatagagagagagagaggagaaaaggagtgaggatgacatatgggccccacaattttttttattctgactaggatgccacgttatccaaacaacccatatgtactatcatgtaacctattttgcatagtttgaacatttaaggggtagacattcctggtatttcagttaagggaccttatatagactcgatgtaaagttgagggatgatatgtgaacttactccaattgtgaatatattcccccgttgaaatcatgtttaggtccaatcaacaatgaggccgtgctgggctggatgcggtcaagtgtcaactggtgggttgtgggccgctcggcggaagatgatggagaaagccagcaatgcgtacggggacgaactcactcccactcattattgattctggtggtactaataactcaagttgtcaaggtggccatcacagtcaagagcttcattatctgattcgaccactcattaattactcactcaactcatggtgtgatttgattcttgtaccaggaacatatactgtagaccgatagacgtacgatgaaaaagggccatgtagggggcctgatgccctgattgatatgatgtatatataggagcttaagggggtgtttagatggggctaaaactttttagcctatgtcacatcggatgtttggacgctaatttagagtattaaaccaaaaaaactaatttcataaatgagagctaatccgcgagacgaattttttaagcctaattaatccataattatcaaaagtttactgtagcatcacattgtcaaaatcatggcgtaattagactcaaaagattcgtctcgcgaattagtccaaggttatggaatgggttttgtaattagtgtatgtttaatactctaaattagtgtccaaacatccaatgtgacagagacttggaataagtctgcctaagccaaatggtacgttggcacaatcgctgtgatactgtgatatatagtcgtgtgacgtttgctcggcgtgtgcaggcatgtgacctttttactcctacagtgcttctactgtgtactcgccgaaacggcccgaaatgaaaaaactaatttcataactcgcctgtaaaccgcgagaattgcgagacgaatcttttgaacctaattaatccgttattagcacatgcgggttattgtagcacttatggctaatcatggattaattaggcttaaaagattcatctcgcgatttcctccctaactatgcaattagttttttaacctatatttaatactctatacatgtgtccaaaaatttaatgtgatgttttttggaaaaatttttgggaaactaaaccaggcctagatgtacgtacgtgttggctatcttaattagctagtggatcttggtgtgtgctgagcatgtgaagttaatgggggaccttgcaaagccaccttgcaacggccagcctttgtccctgtttgatgttcttgttttacataaatggtacagtagcttgtggcaaaatgcactgcaaagtggctctctctgtctctcctctctgcatttccctccctcgctgccggccggccggccggtcggacccatatgcatgcaaagcagaatggctctcgctgctgctgctgctgctgaaataatgaccggatgccgttgcaatatctatggtagttaattttggtacatggaccatgcaggcatgttgctctgtcgatcgatcgatcgatcgatggccggatcgatcggatgatatatgatccgttcatgggatcgatcgatcgagctgcagggcgccgtgtcctctctcgttcgatcgatcgccacccgttaattccaacatggtagtacgtagcatagtagcgcgcgagagcaatgcaaaagccatgtactcccctactggagtacgtgttttgcttcgtgcgcaagccgccattgctgcaccccctgcacacctgcactgcactaccgggaaaacgtgccgcgcttttggaatagagaataactgtgcaaagtgcgtcgcgacaagcggaacaagacaccgcacgcagcgcgagctttcgcggcggatctgcgctgcgtgccatcgcgctaattagctgcatcgcatggcatatcgcaagcggccggcgtttgtggtggcgatccggcgatccatcatcgttgacgtgtaattcttttatgcgttcattaaaaaaaaccaaacctggtgatctatctcgcgatagatcgatcggaatactactacatcgatcggtcgtgggggacatgattacgtgagcagcagaaataaagcaagcgggatcgatctaatcaattaagctattgtcgcatgataaatttatggaggatcgatctgcgtgtttgaaaattaaacctgatataaagtgtgcactggcagagaattaaacgggtgtacatagcagggaagaatgccggagatcgatgaatgcaggagtgtgtcaaaggggggacgtgaactgcaatgccaaaagaaggggaatgcaggttgcaagtggcaccgatcgatcgttggtggcctgtacgtgcagccgttcggtctgcaggtttgttggcaagatcactagcaaaggcgtacgatgcgacttaccaatctacagtcgcctgcacctacgatcagcgctgattaatttcgtcgatcacggtccggccaatgcccatgcaccttctgtcacgactgtttcagacttcaagaagaaggtgcccacatcccactgcacactgccgtagtctgcagtacgtacaccggccgcatagtaaaataacaataaaagcaattttatggttcttaggtaccatgaggtaacaaaaatttagtgtaatatttgatacctcatacctcatgatatctcttcaagaactataacacttgctctataaataacataggggcaaccacaatgtgagaataaaaaagtagtaaaaagtcctattacctggttcatcatcgtgaatgttgaaaataaaatactggtaatatcatctagcaatagcactgctaccataataaacacatgttccttcaatatatgtgagacaaagtttttaccttctcctcttcccccattctccatttcctccgccaactattcatcttttctctaatagctatctcatttttctattataatgtggctccaccttacctctttcatcaatatacactgtggcaaaattagtaactactagtgtcttatgttggccattttggcattgtcgcaattatatagttttcaataacaaataaatatctaaaacaatacatgttatcttcgtgtcttctagctggttctatatattcttggtccttgatgctttcatgggaggagtaggatattatgtgttctgaagctatactcttgaaatcggtagccagcagtctttaattccattttgaataatgtagtttctatagtatattgtcatagaatctacgtgttctttttttttttatcttctcttgactcgttggccatatacctgttgatagaagctggagacataaaccatttcaattagtaaaaaaaaggtaaagggtggttgagggtgacgcatggagaaatttgaatgagagatgattgataagacaaacactccataaatccttttctttatatataaaaagatcaaatgctagcggttcttatattttggaatggacacgagtatattactccctccgtcccacaaagactccattttttagtttttgatacaacgtttgactctttgtcttatttaaaaattttctatgattagtatttttattattagatgacacaacatgaatattactttatacatgacaacttttttaaaaaaaatttataaaattttcaaataagatggacggtcaaatgttgaaaaaaaacacaaaaataaagtttttgtgggaacatatgaagtagtaacttttgagtggtacggattgcttcaaaatctatacacaatctttaacacttcctgtcctttgtatcttctctcttagatctaattttatggtagctgcccttccctagctcctcatcggtgttggcaaggtcctatagccctaattatttgaataattcagataaacataattctaccaccatcatggtgctcctactggttgtaccaccacactaaatttagaagaagaagaagaagaagaagaagaagaagaagaagaaagggaagaagagcaaaacccatgttggctagtcatcaagaaacaaaaacagatgcgccgcctgaaaacccacaggagagcggctggctgagttgtgattatggatgggtgcacccagctgtatatggatgtgagtcataaatcaattaaaagcatccacctgtacaactactgtactatatacgactctaatttaaataaaaaaaatttacaaccgaagagtatggaatttaagatgctaaggtaatacaaaggagtacataattaagatgacttgtgaaaaatggtatatagagtaagttgtattgatatcagtcacacttttataataagacatgcaagttcaccgaacatccgtacatgggcatcctaggatgatcacgatttactacgaaccgtccatagctggatcaatgtgcaggtagggtacgtagtagcctccacctagatatggccaaattatgacctactcctatttccatttttaattaagcccttccgtgcaaccgtgcgtggttggaccttgtacaagttaactcacgagtcacaattgccaccagatgtgtgcacactacttgagagaccatttttgctgggtttaccaaaaaaccacaataatatagtttgaatagaaattaggactaaagatggtttttttcccggtttaaaactctatcggccctgaatgatcttcagtcctggttcatttactgtcagaggctatcagtgggccggtgatttttaggttcgaactaaaaatcgatctttagtcccggttaaatccatataccgtatataatccatatgacttatcctcccaaactcctcatctttctattcctgctccctctcttatccttttctttaatttctctcttctctctcttatatgcgccgatcttatcccctccttcttcctatcggtagatcgatgagttattgatagaggagcgaatgaggagcagccagcgagcgagcgaggccagcggagagccgtggcggcctgctcgcgcggagccgggagggcaggcggccgggcgagggcggggtcggcggcggtggcgtgaccgtgagcagagaggatttgtttttttaaggatttgtgatgaatttgtttttgagaatttgtgatgtatttgatctatgtgtgatgtgaatatgtgatgtatgttttaaaatttgtgatgtaatttttttagaatttgtgatgtatttggagatgatcgatttggggattgttctgtgatgatcgattcggggatttcacgatttagggatgatttggggatgtagtgaaatcaatattcaaagttaagaacaatggcaataaaaagaaaaaaagcctaccaaccggaccaggcttggctccatctttaatcccggttgataatccggttatttcagccgggactaaagatgggcatctttaatcccgaattcgtagtatatggggttacaaatcgggagtacaaaccctttttctagcggtggcatctactgtactgtgctcctttctttctaaaataaatagacgtatactacctccatctccaaatatacaggatttcggttgaaagtgatatatcataatactacgaatttaaacaggaatcgaagtttgtccagattcataatattggctagtatatatttcatccaaccaaaagctagctcttatatttaaggacagagggagtacatagtacgatatatgacacttcgttccatactaaatttatttattttgtgtgaagggagcgtaactcaactagttaggtttcttgtggtggaaccagcccagctggattcaaatcctagatttgacataggtattcacatttacgactatttattctttcagtggtagatgacgtacccttcattagcgaggtgtctgtacgtgttgacttcgtcaatctaaaaatattatgccggttcagttttctggagatgattatacgagtagggtgtacttatttttttttttgggtgaaaggagtatgtttatgtttttttccaaaaaagaaaggagctagtaagttgatctccaacgtcgtatatacggccccatgaaacaaacacttaattagttaccttgacttcctaggtagagcggcattgatcggtggaccaaaaccggcgagatctgtacgtacacggacgatgacccaccggcgccaaagtccagagagtcgctaggataatcaacgtcgtaacaacattgccttcaattcctggctccagtgtacgccatcgatctgctttccctgatagtacgtaccatgtttattactggatttttcacattttggtccttttgaaaaacttatttcgtaaatagactcctaaaaaaacttatcccaaaaatagtcctttttggggcgccagagtggctggcgccgtcgttcaacaggagggcgccagcctctttggcgccgtccccctgccgacgtggcggggcgatgctgaggtggctagggggagtgcgccagagtggctggcgccccccctcccgaaattttttatttttgttttatttgtttgatatttttttcacgcttagggacacacaagaaccaaccatagaaaaattgaactcaaatggacgtaatatgtgacatgtagaatttttcctctcctctcctctctctccgaactagtgcagaggagagagatgtgcaacttttttatttttattttatttttttgatatttttttcacacttaggaactcacaggaaccaaccatgtaaaaaataaactcaaacgaacgaaatatgtggcatgtggaattttccaaagctccaccgaaaaacttctctcctcgaaaacacaatcttgcaagcggaatttggaggttttaatatcgccgaacccggcgtagcgggggagaatcggatgtatcattttctgtagatgtccgtgcatatactatttgcctgattccgagtccgtatgagaaagttacgcctattttaatagatgacatattttgtccgtttcggtagagttttggaaaattctacatgtcacatattttatccgtttgagtttattttttatacacttggttcctatgttctccttagtgtgaaaaaaatataaaaaaatgaaataaaaataaaaaattgcatctctatgtactgtttaacttatatatatgtcatttcatgtggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaatttttttttgggttgg

SEQ ID NO: 25915 - DNA, 3622 bp, Oryza sativa
acccaaatccttccaaatcaaatccctccgcaaaagtctattttgcctccccaggggcgatgggccgaatccctctagggccatcttcccctccctcccccggggctctctttctctttcttccttttaccggtccgcccgcgcgccgcgcgcgcgtgcgcgagaagcgcgccgagcgctcccttcccctccgctctggccgcgcgcgtgcgcgtgagccgcccgcgccaaaccgagtcctccctctccggtccctcgctgccgcttcccgcgcgccgtgttcacgtgcgcgcgcccgcgtggtcccgcccttggcgcgcctggccgtctgggtcgcctggccctgggccccgctgccctgccgcgcagccgcccggccccgctagccagcgcgcgtgcccgagccgcgccgctcaaaccgccgcgccgcccgttgcttcccgcgtgcgcgtgccgtggtggccgaccgcctggtcgccgccgccgtcagcgcctgccgcgcctgtcgctcgtgtcgccgctccgctccacaccgtcccgccgtcatcgccgtcgtcatcgcctcggccccgcctctccgcgcgcaagccgccaagggacggaggcagagccctgccccctctgccgcgacgcccccgctcccctcctccttttcccaaagaagcaagggggcaagccccctttctctccccctttttcctccttttccctctcgccggcgtcacctctgtcgccgttttggccgctagccggagcgccagctcgcgccttgaccgccctaagtcggttcccaaaccgacattgccgcccttaaaacccaagcctccccctttcccttcatctcccattcgcctccgtgccattgccgccgcccccgtgctctgttcgccgtcgccgttcgtcgttgcgcgtgtcggaggagccggcacgagcaaggacgcggaagaggactgcgggcgcgccctcttcctcggcccgaggccggagagattactcccgcgccgtcggcctctcgtcactgcgcccgcccgcacggtagagcatctccccgttctcccttctcgctccatctcctccccttagactcgggtagtagcacgagtagcctccccgtagttagccggcgccacctggccgttgccgtcgctcgccgtgtgctcgccgccgtcgccgcccgagctcggaagcgccgctcgtcgccggcctcgctcggcgtagttccacccaatccgacgctagcaacggattcccgtggccgcgtagatactctcgccgccgggaattggccccccgtgacctcgtcgccgttttccccttttcccgccgccggttgccgccgccgcgattcgccgccgtcaagctccctccggcgaatccgagccgttggctcgtctccccttgtcctgtgcaaccacccggtgtgctcgctttcgcctgtatcgccgtggttcgtccgccgctcgccgcggtcgtccgctgtccgttctggccggcgtcgtcgtctacctcccgccggcccgcgtggcagccacgtaggcgccacgtcggcgccagctcagccaagaccgggtcgagccgaccccggtcagcccctccccgtgcgcgcgttccaccgcgagccgtgaggctgcgcgtgggcccgccgcatccgcatccaccgcgaaccgcgcgcgtgcaccacgtccctctcccaccctagcgccgcgccgcgtgctccctccgcacggtgagccgagccgctgacaagcgggtcccacccgggaccgcgcgtggtgagcccggtccaccggctctctctctcctccctcccgcgcgcgcgcgtcttgggccgctctgggccgccttcttgggccggccagcccgttaagctcggccgagccgccctttctctcgggtcgcgccctagccgcccggggaagtctattttccctccctccttccttttcttttcttttctttttcgaaaaggatttaattaaatccttttcctttagaccaaaaatccaataatcttagaaattcaatatcttcccaaccgtaagtccgtttgactccgttcaacttccaaaattcctcaaatctcgagatctatctaatggcatgcttagaggtcattaatagggctttattttcgctgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgaattgataggatcgcacttaatctgttgtcccgtctgcaaggcagattggtagacctacctaatttgttggatttgatccttcctttgttaattgtgataccatgtccccttgcaaccatctagttgcgtctcgatattcgtgcacccagtgcgagtatcgacggacgccttcaaacttaaaatctgaaaaaacaacttgggtaaaacttgagttttacaaaagacttggaaaacccgacacctgggtcggtgcttgcgaactaaataaatttccaaaaccgcggaccggggaacgtaccgggtgtatggtttcccgctcttgcacttaaggaccgtttccttggaatttcatccaaacataagacaagtacgaccacatgggtagaatgggacacccctggctgagtaactagcttatcaggggagccttgatgtcgagagacatgtggattcgccggggtggtgtcggggaggacccctgggcttcctggcacaatatggtctgggacctaacctgttgttggtctgggacccctctcgtcggcatatggtaaacctgtgtcagctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttaactactgcttgtgaaattgctgttgtggaaaggggttcgatgtttgaaaaatctgtagctgatggaatcagctaggcccgggtggccgtttgaaagttgttggcccgggtggccgtttgaaaagctgttggccgggtgccaacctcgtttcaaaatctaaagactgatacattgcacatactccgaccggacgagacgcactgtctcatccgtgtcgtttgagaagcactcatttagttgtttcagaaaagagttcaaataaaatcaattgcaaaaacaccagcctctccttgaagcctgcattaaacacttatttcccctggcttgctgagtactcccgtactcacccttgctctatataaataatccccccagttgctgaagaagatgaagcggatcctgctgatgaggagttcttccaggagcaagccggctacgatgagttttagggtttcggcctagttcccaagtcgcgcctgtgttgtttggtccaagtcctggcttccgtttcccttttgtatgcagttgtgagctcgggacctgtccacagcccaacatgactgtacctct

SEQ ID NO: 25916 - DNA, 4196 bp, Oryza sativa
ccactctggcgccccaaaaagaactatttctgggataagttttttcagaggtctatttgcgaaataagttttttaaaaggacaaaaatgtgaaaaatccagatgtttattactactccgtattacggatatctgagatcttaattttatagggtgtttgccagttatagtaggtactttattgttcaaatctatcgatcacaatcaaaggtacttaagaattgacagaggtacttaaatgaaggaagggtaaaaacttttgcatgcatgctaacataagcaataaattaaatacagaacagaaaaatatctttgcaatatgaatatataggtacttgtcggtgacatgggaccgggagtatcatgacttagagacttgaggcagacacgatcacccacgtggcctaaccccctcggggggggggggggggtcgggcccgagggtgatacggccgcccttctctttgtctccccgaggggtcggaccgctcccgtctcggccccgagggccgaggcgccccgaccccttatgggttttgcgccgcgtatatggggtaggttagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctggcgcacgcctcgccccatcccgtcaggacgagagcctccaagcactcgtccctagccggagcaggcgtgttagctcctggagatggcacgttggttccagtcagatgtatgtcaggcttcatcctaaccattacaggcaagatattgtatgaagaagggcgaacatgcagattgttaaactgacacgtggtggacaagaatgacccatttgtgaccggtctgacaatggtcatgtcgtcaagcagatagccatgttcccacgtcgcgcctgcttccggcggaagtggaggtaggtatgggtcgtcccatcagaaggtcattgggacggcagccatacaaatctctgtccattaatgaagagaagtcaagttggagggaagagaggatgagtccccacacaaaagaaagagagggagagatggtgcatgtggtatccccttgagatataaaaggaggaccttgcccacttagagagaagaaaaaaaggaaacgatcccagaacgatcgggggctggctcgcactttgtagcttcttcatacacagatccaccaaaacacaggagtagggtattacgcttctcagcggcccgaacctgtatacatcgcccgtgtcttgtgtgtttccactctcgcgaactttccacagaccaagagcttagaacctcacccagggcccccggccgaaccggcaaagggaggcctgcgcggtctcccggtgaggagccccaagctccgtcatctggcgcgccaggtagggggctctgcgagtgtttttctaagctctcgcactctttcgtgtgcgccaagcttttcctgttcagcccaatggctgaacaagcaaaggtgcacaacctctctccgagtgttagcggtgacgacggggagccaaacccacgccgtcgagctcgtactccaccgccccctccacaccaaagtcctaggagggaggaggtgctcgagaggatcgaaggatccgcgacttcgacatccacgggtgatggagaagggcgccgagatggggagcgtcgcctcctcgtctacggcgacggcagcacgccccagggcgcgctccaagctgcgggcgcgctcctgcgtcacccgcctgtcgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttctggcccaccatcgccgaaaaatatgacgggagcgtcaaccccgccgagtttctccaggtctacacgaccgggatcgaggcccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcatatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaactgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcgagggcgcttcgcgggccacccgaaaggggaggcctgcgggcgacaaaaagaaggaggccggcgctctgggagcgcccaaccggcaagtggtgcatcgtccacaacacttcccttcacgacctcgcggactgccgcgcagtcaaaagtttggctgagcggacgaggaaatgggaggaggagaggaggcaggagcgccgagagggcaagtccccggcggttccttccggcaatcggcgaagtgaggccaaacagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggaggtttcccccactttttgcaacgtgaagctggggcgtgtcctcattgatgggggagcagccctcaacatcctttcccccgcagcctttgacgctatcaaggccccggggatggtgctccggccgtcccagccgattatcggtgtgacgccggatcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggtaggccccggaacgtcaagccttcatccgcgaggaggtggcgcgacttctggaggccggattcatccgcgaggtcatccatccggagtggctg

SEQ ID NO: 25917 - DNA, 610 bp, Oryza sativa
  unsure (1)..(610): unsure at all n locations
nnnnnnnnnnnnnnnnnnnnnnnnnnnnnnnnnnnnnnnnnnnnnnnnnnnnnnnntatttcttgatttctagtagtagtttatacttcatcaaaagaaaaattaacctaaaaagaaatataacctcctatagtataataaatctagacaaacctctatttaaatttgttgtactatgtgaggtcaaattttcttttatattggtttttttgaacgggggagtatgtactatttgaaaattataaatcgttgcaaggcatctgtctccaaccaagtggtcgatcgatcatagaaccaacctactccaattatctatccaatgatccgtacgttaagtttgaccttctgggatgagccgatgtgtgcacctgtcgaagtttgggcgcgtccgacttttgcatggctacacgctgtggcaacatcaggaattcaggatcgtcccagtacctctcactgtcccagtgatactcagaccctgtttagatcacaccaaacttgctttaaacttcccaaacttttcaaatcacatacatcacatccaaaactttcctattcacgtaaactcctaacttttttttcaaagtaccaactttttccaaacttctcctca

SEQ ID NO: 25918 - DNA, 480 bp, Oryza sativa
gaggtcaaggaagaggacgaccttggcgacgacggggttagggttggaaccggcggcgtcggagaagaacacggcgccctgccaggcgtgcgagacgaccggggggcacttcatcagccacacggagcgctcggcccgcgccgtctcgaggtacttggcctcctcgcccatcccgccgccccacgctggtggctccgcgctcgcagtctgcccggcgattccggtgtcggcggcggcggcggcggcgctagggcacggagcggcgggcgatctggcttaacgacggagcgagcgggcgaaggggaggcacacgcggagggcgtgacgtgcagttagatgaacgaacgataatccggccggatcggatcaaacgctgtttgcagatgcaccgggctttcaggaatgaatcggttaccgacgaaagttgatagaattcgaataaattttactacaaattgactcagatgttgttgtgaatat

SEQ ID NO: 25919 - DNA, 463 bp, Oryza sativa
  unsure (1)..(463): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgagaaatgcaggccaagaaagctacaagaaacatggtactagatgttgccaagaattgggaggaggaagaagaagaactagcctatacatgcaattctatctatgttattgttgccatgctgatgtagtaagcatcgatcctccattgtaagtcctttccgagctccaagaaagtgcacccggaaagcaagatcaagagaggacgacgtcgacgnnnnnnnnnnnnnnnnnnnnnnnnnnnnnnnnnnnnnnnnnnn

SEQ ID NO: 25920 - DNA, 391 bp, Oryza sativa
ctctctctctctctctctgtatgtggaaagatcacccgtccgcaagacacacaagacgcggcgatgtatcagggtcgggccgctgccaagcgtaataccctactcgtgtgtttttgtggatttgtgtatgcacaagttacaaaagattaacttcctttcccctctcagcctttcaaaagggaagaagtctcctctctaaatgggcaaggtcctccttttatatctcaaggggataccacatgcacctttctctttccaaactggactgttctttttctctttaatgggcggagatcagtacggtttccatccgggagcccttctgatgggacagcccacacctacctccactcctgccgggggcaggcgcgtcgtgggaacgtggccgtgc

SEQ ID NO: 25921 - DNA, 825 bp, Oryza sativa
  unsure (1)..(825): unsure at all n locations
nnnnnnnnnnnnnnnnnnnnnnnnnnnnnnnnnnnnnnnnnnnnnnnnnnnnnnnnctataaatataaaaccaaacaagtggcatctattggcataacaggaagcatccaagaacccccaaaatgtggtacaagtctctagtcattgccagtaaattgaacgtagactggacgttttgcaaagaatgcagtatgctgaagttcaattgtccttccaattgttctgaagcatttagattaagttttgagatcaattttagttcgatctaacaaattattgaccacgacaaatcaagatcacttacaaatgtcctcttcaaattaacagaacagataagaaattggccatacatacctctgcaatatactttgagtaatcgtcttccacagggtatttctcgctagcatagaaaagcatatgctctataaaagaagaaccaagcataagtgaatcaaacaatacagagacacatacatgttaattactgcaaaacacatgccatgaagctctctacatgcgatagtacaatccaaccaagataaaaaaacaattcaatgaggtttgaacagtgcctggtgatgcattaaaactctttaaaggtacacactagaaaatatataaaagagcaacatacaaaacaaggcaaattaaacatacactaagcacatcgatagcatgacacacagtgacacaagaaagttgtgcttactttatctgtccaaggaaaaatagttacaatgactagtgagtaaattaaatttctaattgaataacagtgtctccttagatttttacaatcaccttaagtatccaaataatatgttc

SEQ ID NO: 25922 - DNA, 612 bp, Oryza sativa
tacccgcgcttgtcgttgcggggcctggtgatctccgcgtcgccctccgccgccgccgccgccgagggtgcggccgcgaccgcgccgtcgaacgacggctcggcgggggcgtcggtcgtcgtctcgcgcgctggcctcgaacccgccattgcggccgccgcggattcgccaccgctgacggtgggtggtgttgaagttggagtggactgcgtccgcgaagacgcgaagttggcttggcagttggaacggcgagtaacaagttgtccccggagacaacgcgagagagggtggcacggcagcagtgggtggacctgcagcgcgggttggtggacttggtagttgggcacgtcaggagtgggcaaatgggctgggccggaatgccggatttgtgcacggcggcgtgcaccgggacatctttctgtttgaagtccggcgtgtaccgggacatcttactgtttgaagttcgaagtcaagtaaacgtctactcgaacgttcggaatttttacggaatgggaaaaaaactactccctccgtttcataatataagccattctaacatttttcacattcatatggatgttatatgcggggtaccgagctcgaattcgccgt

SEQ ID NO: 25923 - DNA, 1758 bp, Oryza sativa
tagtgagcaaaaccatcaaaacgtccccaaaattagcacagctcattgcacacgctcgctggacttgtctgaactctgaactcagaagtcagaactgacatccttgtcaggcaaaggtagttaagtcagttaccatcaaaagatctgaagaccggtaacataacgaccaacagtgacaaattttactggagtacgttaactccctgtaactgaagaagggttcagattgcaggctgtaaaataaaaactggagcagtaaatacgaaggcaggtccgaaaaaaaaccgtgagagttaatgcgaaggggtgaaactgacgacgagccgccattaatttctccaaccttttctccgtcacaggatgaggcagagcaccatttactcctcggcgccgcgacgccaacggcgacgccgaccacagggtgatcatcatcagatcagaagcaaaagagcaggatatatacacacgcatgacctcatgaactactctcatgtacagggtaaagagatgaaaaaaagaagatgatatgcctttggcttctcattgatgatgtccagcccatcagccacagggagaaagagatggattatggaaatgacaaattgtatacagacgtcactgctgccagaaaagaacttccaattttttttctttttttctgcattgagaaatgcaggccaagaaagctacaagaaacatggtactagatgttgccaagaattgggaggaggaagaagaagaactagcctatacatgcaattctatctatgttattgttgccatgctgatgtagtaagcatcgatcctccattgtaagtccttttcgagctccaagaaagtgcacccggaaagcatgaacaagagaggacgacgtcgacggatgatgagcccggctgcatgccgatgtgtccaagaaagcaagaactgaccaacgcctcgccgtcgccggcgtcctcagttgtgcagcgggttcggccccgtcgggacgagccgcttggcgacgccgtagcgcaggtcgacctcctcgtcgcgtcccggcggcggcgccggcctgcggtggtggcgcctgaccccgccgcggtggcgcatgagctcgtggcacaggggcagcggcggcacgggcgccgcctgcctggacgagccgccgccgcacaccctggcgaggatcgcgtcgacgtcgacggcggacatctccggggcccgcggcgggcgcggctgctgctgcgcggaggcgaggacgagcagcgacgccaagaagacggcgcgggcgacgctccagctccaccgccacggcgcggacggcgccaatccccccatggccacggcgccccttcttggtcaggggagagagagagaggaagaaagaagccaagctcaagaagacgacggcgcgcggcgatggcttggctggtggccgcgggcgatgatgatgatgagatgagacggggacgcgcggcgcgggggaggtgggctttaaaggcagcggtgtgaggtgcatgaggaagctggaaaaacaagcaacggctgctagctgctgtgctgaggtgatgggcgggctgatggggtgatggctcggtcgctcgcggagtcgcgggatccccgatttcccaactaaatttcgggtggaaaaaacgaagcgagacgggcagttttccccgtgcgcgcgcgtgtacgggggttagtacgtacgcggagaggaggaacccaacacccgtgacgccgtgaggacgcggaactcgaccggggccgggatgacac

SEQ ID NO: 25924 - DNA, 823 bp, Oryza sativa
  unsure (1)..(823): unsure at all n locations
gctcggtacccggtcgaacaccctgcgcagccgcagcgcgttcaggctgccgttccggaggcggaacgacggcgagggctttcctcgacagcgacggctttgcggcgacgccagctgcgtccatctcgcgcgcttcccctggcgattacacttgtcttctcgaggggtttattaggctgtgtgaacttatttctgatcgaggcgcgtaaaacgtatatgatggcgtagagagttgcccgggttcttatagacgacgaaagtgacccaaaaaaaaaagagagaacatgtcgtcgttatcacgttattactgtatattagtattaagcaaagttcaatggactggaattctgctagaccaaattgaaagaaattaattatgttcggacacacttatctaacacaagttggctgtacgatcaatcagatatatatccacgtcaacaaactcttccaacatgcagcccactttttatttttttgacaggcgagagaggtttggcaggattgtcccaaaaatgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25925 - DNA, 618 bp, Oryza sativa
gagctcggtacccttctagcttgaattattatagtttttccctggaaagatacatctaatagacattactatcctgtaacaatgtttccattgcgcagattcatcaggatgatctcaaaaaaaatgttatactccagttgcttgctcttgttgctaagcaaccagcttttcaccaattacgttcagttgagcaacttggctacataacactgcttagacaaaagtacgtacaaccttcacgtaattgataggatgtacagtggtctttttgccttggttggcaagaatggtgttctatatgtagactatgcaattcctgtaaaatcattgacactgatcctgtttacccagaaatgattcaagtgtccgtggtttgcaatttataatccagtcaaccgtgaaggtagatatatttctcaatgcagtttcaaacccgctgaaacaatcattctcctattctaatatattgatttgacaggatccagccaacttggatgctagagttgaagctttccttaccatgtttgaaggaactctataccaaatgcctgatacagaattcaaggttggacagatgatgtcactgactcactgttaatcattggcttctattacagc

SEQ ID NO: 25926 - DNA, 615 bp, Oryza sativa
agggcgaattcgagctcggtaccctatgagcaagattcatgtgacattaaggaaacttactgatatatctcctaagtatggcttcaaagtttttaggagcaaatcttccttttataaccaatctttgttgcccatcaagggatccacttgttcccatctcagcaagtaaaaacatcatcacatgttcaggttgcctatgcattctggaagtgtaaacgatgatttcagttagctcatggtaatttatcttctctgaaataaaagcaggcctagagcatatggtatggagtggtaaaaaagtgagatcatacgttttgcacaaatccatgaagttcacaaaaactgtcttctttgtgccttccctaagaacttgaggaggcctcataacagttcttcgtctatcaccagcaagatcaggattattctcacgcaggatattaaatactctgccaagcagctgtcaccaaatagattgaaagggttcattaacagaaacacaattgaatactagttgaagctgagctgagcactacatgagatactaataccatatcaatagcaacaaaaacataagaagatcaaaataaaaaaaaatacttaaaagggagcaatgct

SEQ ID NO: 25927 - DNA, 787 bp, Oryza sativa
  unsure (1)..(787): unsure at all n locations
ccggattatcgttcgttcatctaactgcacgtcacgccctccgcgtgtgcctccccttcgcccgctcgctccgtcgttaagccagatcgcccgccgctccgtgccctagcgccgccgccgccgccgccgacaccggaatcgccgggcagactgcgagcgcggagccaccagcgtggggcggcgggatgggcgaggaggccaagtacctcgagacggcgcgggccgagcgctccgtgtggctgatgaagtgccccccggtcgtctcgcacgcctggcagggcgccgtgtcctcctccgacgccgccggctccaaccctaaccccgtcgtcgccaaggtcgtcctctcccttgacctcctccgctccgaggagccctccctccaggcaagcctcccccgcccactccctctcccttgcggattcgaatggtagtacattctcttcgagcaaaatgatatgaccctatggccgtgggggttggtaatgtatgaacctcaaatgtagatttcatgcattatgcttgggaaaaatgggacaaaattctgcaccgaccgtaacatagatgtagtggtggagggtttgactgccgaatgtgataatacgattgattggatgggtaacatttcagttgatttcccatttgcgaattgctagacagaatcagatgcattgaagagtgcagaggtttaattagagcgggatacgtcatactgctctgctctgtttnnnnnnnnnnnnnnnnnnnnnnnnnnnnnnnnnnnnnnnnnnnnnnnnnnnnnnnnnnnnnn

SEQ ID NO: 25928 - DNA, 560 bp, Oryza sativa
ataaaccagtggtgggcgagcgtggtagcgtagtggcgatgggcgaacgcggtatcatgtggcgggtggaggagggagccgcaacggtggaggtagccggaggagaagccatccttctctacggcgacggcctactccgcccgccgcgtcgtttgtcgtcctcgtcgtcggccgagccatccttccctacggtgttcgcgcgagcgcgcacctatcctcggaggtgatccgctccttcatggagctacgtcgcctccggttcgagctcaccacggaagaaggcgtgctgcccgccattgtcgctccgcaccccgcttgccctgctcttgacggagagaggatagagagagagagaggagaaaaggagtgaggatgacatatgggccccacaattttttttattctgactaggatgccacgttatccaaacaacccatatgtactatcatgtaacctattttgcatagtttgaacatttaaggggtagacattcctggtatttcagttaagggaccttatatagactcgatgtaaagttgagggatgatatgtgaacttac

SEQ ID NO: 25929 - DNA, 754 bp, Oryza sativa
  unsure (1)..(754): unsure at all n locations
nnnnnnnnnnnnnnnnnnnnnnnnnnnnnnnnnnnnnnnnnnnnnnnnnnnnnnnnnnnnnncagtaagtgacaatacatggtggacaagctgacaaaagacagccaagagtaagttggtaatggctaatgacaaataatgcagtttgcaggagtcaaatggagggcaacggacctaggttagtcagttaggagggaaactgaagagagggtaaaaataagatgaaaaatgtttacttacatactccattccaccgagtgaagggtaaaaccatagtatcatggcaaggtccgcaatgaaatacccaactgagacctagcaaaacatgagattcaagtaactaagtataatgaaatatcacaagtcacaggacaataaagtaattgcatatgtatacccctagcgtgaaattggagaggctcgaacttctaaatgttactggtccatcctgctggtcagagaataaacccgagaagaagactaagtatgctgacataagtgtaatgaatattgcatggacggtggacatgcccctatagtaacaaagggtcagaagatgtatcatcagaagcttataataatagagtgggatgtaggaacttggcaattaagttggttaatgctgctgacctgttattccattcaaccttttgcatctttgtgagagaaccatagcctttgaagtagaatgaactgataaagcgtgtgaaatcatatgactgagctagcaaaagaacacaatagtcaagataac

SEQ ID NO: 25930 - DNA, 757 bp, Oryza sativa
  unsure (1)..(757): unsure at all n locations
nnnnnnnnnnnnnnnnnnnnnnnnnnnnnnnnnnnnnnnnnnnnnnnnnnnnnnnnnnnnnnnnttactagtgatatgatactccacatcacatgtcagagtaaaatattaagggtcacaagttaaacaaaagatagttcataaatgcctatggttaatggttaatagtacctcctgtcacaaaataagtaatgttttagacaactacacggtcaccaatgcacttgttttattataatattttaaaattttatttaatataaatctaaccatattatttttgaaagttggatcagaatatttaaagaaaaattgatcatcaaagttgtattccaaaaatttgtgaatgatggagtacaacattggagtagtacactccaatatggtgatcgtggcaacgtggtacctcaacttgtttcaatatggtgaccatggcagcgtaacacctcaacttgttgagttccatggtgatgctctccaattctcactcgagagaacggggagggggcatatgtcccccacgaccaaaaaagctatctcatacgacgggaaaatcaaccaagcctcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25931 - DNA, 550 bp, Oryza sativa
tttccttagttttctctattagatgaaaatcgattaaacttccgaaattcataactaaatcatcgtaactcggattcgagtggttcaagttgctaaattcatctaaaatcaagatctacatgttaaaaatatccacatgtactgtttttgcttgtttttgtactattttgttgattttgttctttcgctttagtttccgatgttccgaggagagcgttttcgttgaggaaggttcagaagtgtttgcggaagatcaaggcaagtcacacagatctcaaacaaccctttgagcatgttgaacccgtttaaagctaatgttttatttcaacttatgcattattttcgaatgtcatcgggaggtgagcctttcccgattaattaatggccgaatatgactttattttcctatgggttataatttgactagcatggaccttatatattggattggttcagctagatgttatttatagttgctcctagccatgcttagaaacaatagctcattaaagggatgaatcatactatattattaattatggttatattt

SEQ ID NO: 25932 - DNA, 571 bp, Oryza sativa
ctacttctacctcaccatgtcacttttggcccatagaagacaagagatcaagttatacacgttttggattcggattcaggcctcctgatagcatcaacttcaaacggacctagccgctgttctagaaggaatttcagggcccatgagtacttgttggaaagcttatggagtctactttctgatggatttggttccacatcaaaattcctactaagttgccgggaaactgcaaaacaagccacgtatctcatccagtccgaatctgatttgtgttttgggccttgtaattgtgtcgtgggcttagctcaagggggtgtgcgccctagggcaaccctaggacatccttaatcatatttattcagtagccgtcaccatttagagtcgggttttgcttagattattctgtcaagaacagtttcgccgctagatcggtttgtggaaccccaaattcgagtgcttaatcattcatatgcaatttggttgcaatctatcttattctcgcttgtgttcttcgattcgcatgcagggattagccttctcggtgaggtcaaccgggtttcggcacggttga

SEQ ID NO: 25933 - DNA, 553 bp, Oryza sativa
ttcgcgctgattttattattgactcccgtcaagcaattaacctgtgctctttctaattactgacaacgtgtttctataggactgctagtgttaattcctatgtaattcctttgcatcacaaattcttatatattccggataaaactacatgaacatcagaaatgatgcggaggagtgagtcaaggagctttttttcgaagttccaagctccaaaagccttttctcctttctcaaatttattaccagaaacaaaaaaaaaaaaggagacaacgaattaataagcagcaaatgaagcttgaggagcaagttaaatatagatcactaacccagttgtttgtgcgagggtgatgacggtgagactccagaagtccttctcgagcatggagacgaagccaccgaggaggatgaaggtagtccacaaaaccaccaggaagcccatccctctgatggccatggacaagtaccccataaatagggcataactattgatcatcaccacttccacccattgagagtcatcatcgacattgtcagccattgtgtatcacttctt

SEQ ID NO: 25934 - DNA, 769 bp, Oryza sativa
  unsure (1)..(769): unsure at all n locations
nnnnnnnnnnnnnnnnnnnnnnnnnnnnnnnnnnnnnnnnnnnnnnnnnnnnnnnnnnnnntggaggccgtacgtctgtaaaatatttgatgatcagcgtaaacgttttgcacgagcttataaacaatgggcggaaacaaaaataaggcaattgggtgattgttgggcatgctcttagtagtaatggccactttgaatcaaaggaattataaaggaatttcataggattgaaatcctataggaaattttcctatgtagccatttgattcaaaggattgaagttttctaaatcctacaaaatttttatggaatggcttattgcatataggttttgaaggaaacttagcaagaggtccaacctcttggtaaaaatcctttgagtccatctctgacggagcgtggggctcctcaccgggagaccgcgcaggcccccctttgccggttcggccggggactcaaggtgagatttaagctctctgtatgtggaaggttcgcgagaccggaaacacacaagacacgggcgatgtatacaggttcgggccgctgagaagcgtaataccctactcctgtgttttgggagatctgtgtctgaaggagctacaaagtatgagccaacctctcccttgttctgggttcccaatctggaaaagttcagtccccgatcgttctcggatcgttccccttttctaagtgggcaaggccctccttttatatctcaaggggataccacatgcaccatttttcttttttgtggggggacttatcctat

SEQ ID NO: 25935 - DNA, 484 bp, Oryza sativa
cagttgcacattgagccgtctatcatcaaacgtcgaaagcatatacacttctgaaacaactgtgatgtacacactagctcgaccgttattccaacacataaagcacgcctttattttgaacttaaaacagaagtggcagtttcgcattacatgagtgtgatccctttgctttctcgtcatcaactccccactaacaatttctctttgctagtgacttcgtacggccactcgtaccattaacacacacaaagcagctcgactgaaataaaaatggccaagaacacctgaaaccccgttcgatcgtgcgctaaagggatagaatgaaaagtatcacgaatagatttctccaacgacgtcgtcactaggagtgaagggcacaatccttgggctgaaacccaatcctccctgcctccatatcgtagacgacctcaacattctgcatctggaagcttccaagaactgctcctggcccattattcgcgcc

SEQ ID NO: 25936 - DNA, 742 bp, Oryza sativa
  unsure (1)..(742): unsure at all n locations
nnnnnnnnnnnnnnnnnnnnnnnnnnnnnnnnnnnnnnnnnnnnnnnnnnnnnnnnnnnnnnnnncatgagccttaattatatgctttgctaattttctcaactaatcaaacattcattagggtaattagttaaaaaatattctattgttgcatgattaatgaagtgctaatctactacagcatcttaggcggagcctggccgggccttggctccgctgctggtcacttgcatgcttatagtgtcgtatggcgggatgttaagaacaatcacataaaatatattgaacaaccaggatgttttggaatggaaaattttgaagcatggcctggattgttgtttcactttccctagtaaaaatatactatatttaacttttatagttcaactttgaaaaccttgtctaataatatattcaaatatattatatataggagggagtacgagagaccaagaccgttgattttaccgtcgtatgaggcttggttgattttcccgtcgtatgagatagcttttttggtcgtgggggacatatgccccctccccgttctctcgagtgagaattggagagcatcaccatggaactcaacaagttgaggtgttacgctgccatggtcaccatattgaaacaagttgaggtaccacgttgccacgatcaccatattggagtgtactactccaatgttgtactccatcattcacaaatttttggaatacaactttgatgatcaatttttctttaa

SEQ ID NO: 25937 - DNA, 6620 bp, Oryza sativa
tgggatttaaaccctaacagttataatcataataaacattttttatggtccttgagaaaagtacctagatatatactaaaattttacatacctcgaggtaccaagttttatgctataacatgtggtacattctaataccttctcaagaatgataaaattactttaatcataaacatacaataattaatgtgactttgcaataaccataccaaatgtgctatacctatataggtgcacagttactaaaatgttttagcacacgattaagttaattaaccacagcacgttaactgttaagcatatttgatcttaaagttggcgatgcaaaagcaaacaaaaaaaatatctggtagattttccggtgatcgatctttgtaattaagtacgtgaaatgtatttgcatacgtacaatgcttggtcataatcaatttcagcatatatttgtgcatccattatatattatatatattaagaatatataacggcgatatatatatgactcgtgcattcggtgttatgtttcggccggaccattaattttatgtgttcccgggccttcatccgttaactgtcaatcggtgcataataactattaatctcactcgatcgcaccaaaaaaaacatcatgcttgcaggagcgcatcacataatttctgccaagctgtatatatttgcctccaagatatatgaatggaaaattcatgaagatatgcatggggcactatatatgcatgccagcagctatatatgggttatggctagggtaaacggtatatataaaaatacagcatagacgacaattattattgacgaaacaaattaaaatcttttttttcaaaagaccacataaggaagcaaataaatcatgcacacatatatataagatggtgaaacgatcacgatcaatacagcaaggacgccatgcttagtgacgacgtctgtctgattaattagatttctctgagagaattaaggaggagaagaaattaaaagatcgtaattaaccagctgatactgatcaatcgatctcgatcgtatacatgcacacagctagcagccactgcacacaggtgagaagaaaatccccaaacctcgatatgtatcgcgattgtaagtaggttagcagcatatatagctagtagttattcctcttgctcccagctgctgacctgtactgatcgtcgccacccttgagcatctcttgcagcacttggtcgtctaggcactccagctcgatcacctgccgctgctgatgctgtcgggacgaggacgacgagcctgatccccgcacgtagttgcgcgcctcagcagggaagttgaggacggcgaggtggccgcgcatggcgtaggcggcgcggtcgtaagcccgcgcagcctcctcggcggtgtcgaaggttcccagccagacgcggacgctctgcctgctggagtcacggatctccgccgcgaacttgccagaaggccggcgacgcacgccacggtacttggtcgtctcgccgccgccgttgccctgatcgtcccatccgcccccgccgtcgccgtccatgatatcgatcgatcgattgcgaccactgaccggccgcggacggacaataatcaaattaactagctactactgttacggatcggaccggggatgcaggggtgtgctaataatattgtaagtatatatatctaatgatagctagctactgatctattccatggatcgatcattcagctcagctagctagctatgcatggagtatatatatatatatgtctctgaatataatgcttaaccgatcgatcgattacgctatatatatatagctatctagctgcagctgcgacggcgctggaaatggctaggggcctggacttgtatttaagagcagcttccgagcttaagccctaagggagctcaagataatggagatgcaatttgtgatcgcgttattgaaagcagagaggaagatgccgattctctcgcgctcaagtgatcacatagattgtggaagatgggccccggtcgctcctctgcatccatcccttgttgctctctgcctgtaattagctaactaaaaaaaacatatatatagtaatgttactaaataacatatataataataaagcaggtctcgtggtttcagagagcttgatcgaatgcatatctataatccctccgtttcgaaatatttaacacagttcaaatttttagtacatgtttgatcgttcgtcctattcaaaaacttttatgaaatatgtaaaattatatgtatacatataaatatatttaacaatgaatcaaatgataggaaaagaattaataattatttaatttttttaataagacgaatgatcaaacatatttaaaaaagtcaatgacatcaaatatttagagagtatatattacgtgttcgggatgatcgatccggtcatgcatcagtacgcctaatttatgtaggtcgagtcattctttaattaatttcaggtgactatctaaaaccatatagatatatagctaaaccagccgaccgtacctcacgcgttctacttgcgttgagttcaatgacagttgcctaacttcagctattaacttttgcatatcattgggcattgaaactactcagtattgtttttatttgtaggctataccgctaccttgttttctctttgaattgtcatcaccgtgtttgtatagttggagaatcctttttgattcttgtatggacggatgcaaactaaattaagctcaactagatgatgatgagggatggaatcataccttgatgaattgcagccttgtatatagttaggcctcgtgcctcaattgactggctaaatataatttgtcgcatcgctaactttattaagcaatgactcctcttgtcacaattagcaattgttttaggttagtgggattgcacgtatagtatatacaagtacataactcacacatgcatgtagtcctagtactgttctataagaacaaaagagatggtttgaatgaattgcgcaccttaattttttttatttgggattatattcttgtttggactttgaaacgaatagggacgtattggcctcgatttccctaggaccggtcggcgacacgcatgtgcatgcacgctgtttaaattcatgtttgatcgatccttcgaaaaggaataatattggaatgtctttgctggaattaactaaaatttagttagatgagcccagctgcccagtttctttattgcttctgctatttaattatacaagatgtaattatatactagtagtagataatgcaaggatgtttttggtttgaggaatctaatacgattacacttgctggccaacaaacataaagggtaaatccttaaatccacaaatcccttatatgtatatatatgtattcaatataacatgcatgatgttagtggcacaaggatgacatagaaagcatcgtacgtcgtacgaaattttgcgctgcaaacagagtgagtagttgcaatataatgcagtgctgtatagcgaagcctgcgcactagctagccagttttgaaattgatgaaagtataataatttcttttgttggttaaaagaaaagtttgaaaacgttcgagtttccaagtaaacagttttttttactagtaatgagaagtcgttgtatagtgaagagaaaagaaggtgaggaaatagcaaagttaagggacggtgtgtaatgcttaatgggctagcttgtcggccccatgtatgatgattggatacaatctggcagtatgcatgtttatgggccgatccaactgatacgtgcataggataggagtaggactggcattgcaaaacagcagatgccatgacatgcataaatactactccctccatcccgaaatataaaggattttatgtggaggatgtgacacatccagtgcatactactactacttggcaattggcatgtacgcatatgtgtatgtgaatatatagggagaaaatggcagaggcattgacatgtgcaaatggaggaggtaggtttttaagctagggaggattggatggggatgggaatgggaatggaatgaagttgacttgagagtcaaaaaggagagatgaggaaggagggcccagctggggaagggaataaatccatccatccatccatccatttgctgcctttgattttagtttaggcggccgtcgaaggcgacccgctaggtccctgttccgacttgcgagctgcgaccatatgcatccgcgtactgtatactccttccgtctcaaaataaatacagttttgtactattcatgttcaacgtttgaccgttcgttttatttgaaaaatttttatgattagtatttttattgttattagaagataaaacgtaaatagtattttatgtgtgactaaatattttcaaatttttcataatttttttaaataagacggacggtcaaacgttcacggctgcacttattttgggtgggacatgaggtagtacttggcgttgaccagcgcgtggacttgtaatatggacggacgcggacgtgctctctcatctcctagctactgtactagcactagaaaagaaaagaaagaagaaagcagcagcaggaggagagatggacttgctcactcggcacgtgaagtactccctccagcaactagtaagaagaaaggcaggctgcaggcgtggacgctgactgtcggtcttcccttgtgaattgtgatccaatattgccaaattaataatatcccttcatagatttctctctgaccccgcgaaacagcatcagcatgcattgcaattcaactcgcatattagtagtaagaagagctactcctactcagtggtgtggcgatgggttcagctctttcgggcagcggcagcgggagcttgttggtcctctccgtctccgtcgtcggcatccttttcacctccatcctcctccttgcctactacctcttcctcgcctgctcatggcgccgccgttcccaccaaactgcacgacccacgccgcctcttccttctttcttcttagccgccgatcaaccccgccgcggcctcggcctggaggaggcggccatccgccgcataccaacgctccgctaccagcagcagcagcagcacaacaagcagcagcagtgcggcgtgtgcctgggcgagttccacgagggggagaggctcaggcggctgcccccctgcctccactccttccacatcgactgcatcgacgcctggctcgccaccgccctcacctgccgtctctgcagggcccatgttaccgtcgacaccaaccacattgctgctgctaccaccagcacgcggcacgacgacgaccagttgctctccggcgtgcaccagccgatgaggaggtcgttctccctcgactcctgccacctctacctcgccatcattttgcacccgcaccaactctcggactccgacacccgcagccgcagccgcagggaaccaaagcccgccgtcttagagtcagagaggcctagtaggacgctgcgcagatccttcttttccttcagccacactaccacctccccagtcccaactccaatcctccctatctgattctcaacactaatctacttgtacaatcccatattatatttattaactcatccatatcattggtatttttcccatcacatcctcgtgtctctatgctctcttttttttcagactgtacaacactgccggttactgtaatttcttaatagacatagtaagtggaatcatccccctttaatacttttttcgtttcgtttatgcaatgtgcatcagccatgtagcaggcgtctgaaaataatgactaaaggtaatcctgccaattttaaaaataaagaatgcttcatgcaccatcatctccaacacataatcagatgggtccggcttgccaaatgagacatccatcattacttccttgcgtgatgcctccaacggtatttaacaagaacaacacatgacggttcaaccagattttcattttttattattatctgatgatttgacaccaaccaagtatttcatgttttctatgtattactttattcatattgcctactaatcattatatcgaattcatccattttatgtggcctttttatgttacctacaggaataagtttagggtttgtttaattggtgaaataaaaatctttggatgtcacatcggacgtttgaccggatgtcgaaaggggttttcggacacgaatgaaaaaactaatttcataactcgcctggaaaccgcgagacgaatcttttgagcctaattaagccatcattagcgcatgtgggttattgtagcacttatggctaatcatggactaattaggctcaaaagatttgtctcgcgacttacatgcaaactgtgcaattagtttttctttttatctatatttaatgttccatacatatgtccaaagattcgatgtgatgtttttgcgaaaagtttttagggaactaaatagggccttactttacgtctcattttcctttaaggctgagtttcaaacgtatccttcagccataaaaccgaatacaacgtattcctcatattgcaatactagtctaaacaaggtcctaactctcaaggtacttcatccgttttatattataagactttctagcattgcc

SEQ ID NO: 25938 - DNA, 3000 bp, Oryza sativa
tgatgggatcatagcaatgcttgatgaaacaaaaatactgaacactgctgataatttctctgtgctagatttgtaacagcatggtacgtacgactacattttacaaaacactacaattgttaaggcactgccaggaacttaggaaaatctcccagtaagcaaattccgtagaaatatttcatagcacaataaccatgtgacagaagaaggtaggactctgggtacaagactataaataccaaaaaaaaaactaactttaagcaggccaaacaaaataaggtttcccttatggaccctgtaggccaatcctgaaacaataggtaccagatcaactatgaaagaaggataagtaattatgagctgtacacaagctgtcaatttgtggctgagaacatttaactcattcaggtgattattgacccaaaaatctatctattaattccctctgggggaacaagaaacttttttaaagcaagttattgtgaatatattggtgattggaataactaatggttttacataataatagaagccagctttcctgccaaaagaaaagaaataagaaccagctaagaaaacattggcacaagtaggagtatggaaccattaattgtgttttgttgggtatacagcaaaatttggttgggaagaaaagaaagctaattaaagctaaatacacgtcattggtgtggcaggtaatgactacactccttttcatttgtatattgttatgacttacgagtatctgtaaagtagccacttgatgtaagcattttacttgattatcttaattctgtttcatgacttgaccagcttaaccataaggtagtaatctgccgatattttagaattatatatgtgctccgatggaggaaacactccagtttttaaaataatgaaaaacagagtcacctaaatttacaaaagtaatgttgggatccatgagagaaacactcaaaaaagtaaccaatgttactactatgatacagtttcaagaaaaataggaaaggaaaatggacatatttagatgtctgctcaggtaggatgcacataaggtttataggaagcaattttataacctaaccacatgttccatatctcataaacattaagcacaaagtacccatcctgcattttggtatgggtacaggcatgcaacaagtagttctgtttggcccaatatgtgctgtttaattactgaacttgtaaacattgaacagcatttgcattcatattaaataatacttcctccgtttcatattataaaactttctagcattgcccacattcatatatatgttaatgaatctagacatatatgtgtgcctagattcattaacatctatatgaatgtaggcaatgctagaaagtcttataacctgaaacggaggtagtataaaagtttaactattacatatgtgttcaaccatcaatgatatatgttccactcaggagttggaaatgagcatgaaaggggtagaacaactgggcttaaaataatgaaacttgtagtccactagggagaccaagatgaattaattatttgacaggctttggcaatcacagtactggggttatctttataaatagcagagaatgatgaactgaagatccatatcataaccagcaaggagcaagaataagaccaacaacagcatcaagaacaaggatgacaggacttggctcaccatgtggcgcgtgcaagttcctacgcaggaagtgtgtgaaggggtgtgtcttcgccccatacttctgccatgagcaaggtgctgcacactttgccgctatccataaggtatttggggcaagtaatgcctcaaagatccttatgcatctccctgttagtgaccgctgcgaggctgcagtgaccatgtcatatgaggcgcaggctaggctacgcgatccaatatatggttgtgtcgcgcacatcttctctctgcaacagcaggtgagcaagttcttcattagtattcagtacattacaatgagggttttggttcagaattatttttttttattaaaagaagtggttttattcttcatggagtgggaaaaactcacctggtgagtgttgagaactcaaggctcacgggctatcctaactaatctgtatgatcataaaagggttttgaagtatcacaagaaaaaacagttaagaagtatcccctctttctttgttgaaaatgtgtagacttctaggttccttggatggttctttgtatcaaagtgtaattttttttccaggaaaggaggttctttgcatgaaaatattgtcttaccatatactgcaaggaaataggtgacactgacagtggtgttccttgttaaaaattttcacaggtagtcagtctgcaagcacaactagaatctctcaaagctcaggcaacacaagggtatggagatggttgttcgatctcaagccctcaaaacgatagctgtggaaatatgttaacgtctattgtgcaagatgagcaacagtttgttggcccaacaatggcaagtaactcttcagtaaagaatgagaatcattcatacattgcaaatggccacttggcccctatgtcagctcaatcttcacaaggctttgaagcagagttgtgcatggctgagtacagcaacaccaacccttgttgcagtgtgcaagggaattggtatcatgacatggaggaccttcagtcagtagcctttgcctatctgaatcaggcatgagttgatgatacatatgtggtagactgctagatactgtacgagttggaacggttttggtaacaataacttacattcttataggatgaacattcaattgctaaaataaagcagcagagttgtgatgtagctgttcaaatattgcgaacacataaatttattttgtgtcgatatgtagttccatagttagtgaaagtaagttgtctggtttctgcaatactaaaatcgatctgtcctgaaaaaagcatgagttggaggttaagaggaaaaatatgattatggcatgaacattcg

SEQ ID NO: 25939 - DNA, 934 bp, Oryza sativa
atatgtagttccatagttagtgaaagtaagttgtttggtttctgcaatactaaaatcgatctgtcctgaaaaaagcatgagttggaggttgagaggaaaaatatgattatggcatgaacattcgcaattgatgtttgcaaaatgggctaaagctcaatgatggaaaaatagttagacgggcgtaatgattgaaaagcctaagcaaatagataaaaggattgcattgcatatagatatagaatgtggaaaggcatatttgaggggaatgtgcagatgaggacgttaggctagcgtgagtgtgtgacaagtcgtggggtgcgagtgaaacatagtatcgagcaggtggtgggcatggcctggcctggccgggccggtaagcacgacataggcggatcgctggtggcagtgcgcagaggagaggaggaggatatcgagtgcgggccggagggaatcaggttaaaatataatataccttgatgccttgtcttccgtcgaggctgcgggctctgctattgctctgcccgcatccctccctcgtctcgtctcgtggattgccgatgaacggaggcaggcagccatccagagacctcttctcttcgtgcacgccgatgaagattgatattacctgcggccgccggcgccgctgtacatgtgcgtgcggatacatagatagcgctgatgagagacgcggcgctcgcctcgaacaccttgcgcgcaggcgcagtggtctaatctaagactggagagattcagaatttcattaatttgatttgaaagggccggcccataaaatggtcaacttgcgtaagcccaagtaattaggaacgagtatatgggcccaatttccatttatgggctggggctgtggaccgccagacttcatcgtctccgtcgtcggcgcagatctccggctcctccatccatcagtctctct

SEQ ID NO: 25940 - DNA, 987 bp, Oryza sativa
tatagggccaattcgagctcggtaccccatcagaccgacctcaggaggccaatgtccgatgtggtgccgggggctactgtcggagatatgggcccgggagtatgcgaagtgaggggaatctaccttcccatcctgccacgtgtccctacagcctggtcctgtccccgtattccgcgaaccgcaggagcggctggggggtcggagcctcggggtgccacgtcatgcccctcgggcccttgcactactttgccccgaggccctcgcccaaccgccgtttggggggggggagcaagcgaggagggagcccaggctgaacttcctttaatgcgcgcaacgccccaactgccccatgtcgcatttaatgcagtggggcagacgtgcggcgtgctaaactgacgcgcgatggtcaagaatgaccggtctgtgaccggcctgacgccggtcacgtctgactggacggacaaccgtgctcccacgttgcatctgcttccggcagagtggaggtaggtatgacccgtcccatcggggggtcgttcggacggcggccaccacaagtcttcacctattaatgagggaatgacagggttgtcccccgtgtcaggcgagggacggcgctgggccccgctcaaggataagctgtagtttagcttccaggcgaaggcacgggtcgagttccagtcaagatagggtgggtccccacccgaaagaagagtaagtagaggcggtgcatgtggtatccctttgaggtataaaagaaggactttgcccaccgagaggggggacgactctcagaaaacctgagcttgtggaggagggaaataagagtgttctccccaatttaggaaccctttgaactctcagtctaaatcccatacacaggagtagggtattacgcttgatagcggcccgaacctgtataatttggttgtgtgccaactagctaggaaccttggggacaaatacgcgattctagaggcgagctttttt

SEQ ID NO: 25941 - DNA, 712 bp, Oryza sativa
  unsure (1)..(712): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccaaaccaagttttgtcttgtatcttggagtctaatttatttgtagtagcctgctatcttaattatcactattgcacttggagagttataagagattatatatttttttcttttaagtttggcgtcttggctggatggctggttatccctcacaaaaaaatgatgaatactatcaactggtaacaagctgtggttacaacttctgtaatattgtgaaacctgtttcatctctgttataatatatggagtaactactaggctggtttcctggtagtacttcccataaaaaaaactggctggtttcccgtccgctgtctgtggtgcctcgtgacaccacacatccctcataaatccaaaatcatataggaggaaaaaatacagaaaatcgtggtgatgcaaaaacaaacaaaagaaggggaaaaataaccgcagctagccttcatgaaaaaacactcgtgtaattgggtcaaagtctaatatacgtacactcgtgtaattgggtcaaagtctaatatgcgtagacatgtgatttttggtatgggtaccgagctcgaatt

SEQ ID NO: 25942 - DNA, 425 bp, Oryza sativa
attgtgcaggttagtacaacaatagctctacccctgacgaatatcatgatatcatcatcaggaatgctgctctcgtacgccatcagtaagtagtatacatgggctccactcaagattaaattcatagatttgatgcttcgctaatcatgcatccgagcaacgtcgcaattttagtttagctgatgaatatatcaacgggcgcatgcagatgcatgccaaaacaaatcctaaaagttgcagaactgatgtatgattacaccatcctcatcgcatcacatgtatcagtgcgcatgacgaatcgaagacatgcatctatatgtagaatcaagttaactaatagtacacacacgcatcctgcctaggaagagcaagcggcgcatgtctgcactacgcatgcagggtaccgagctcgaattcgccctata

SEQ ID NO: 25943 - DNA, 1884 bp, Oryza sativa
taagggagagcaagctctaccttcttgcgtcaaaaaaaagatcaaaatgtagatgtgaaattgaaagaaacaatcatcaacatcttacacatatgcggtgctcagtcctgcatctagctttgactagttcagatgaacatcggccggataagtcgatcttaggcagccggcaattcattcagattcattgtaaaccaaggaatcatcattgtcattactgcatctaaacaattgcaatttgatctgttgtattcttgtttgtaataataaatagaagagggagggaagaaccccaaatccccaatagcgtacaatgttaataaattgtgacccagtagcgtatacaaaaatcgtacaattgaagaatacagagctgcctggtacatgcaggataagaattgaatttggagtccaacttcgtatctgctctgcgcagggggaaaagaaaaagagaaacagggtatgcatatgctaatctctgtctgaatgatctccttgtaagagaggtttggtttcatctgtgcctccccacttgtgcacacgagctgaagcttgcgcagcctgaaattatatgtacattaatcggcaacagcaatggtatatcatgatgagcaactctctttatttttccatttaaaatgaaaacgaaaatgtaataatactatatattacctctgccttccagtctgttctccagactacaaagagtagaatgagtgtttgaagtgcaactccacagagcatgccaccccaaaccccctgcagccaatttaattttaatttttttctgtgatcaattatatataatttcgcagtacatatgcatagtactccattatattagtggaaaaaagaaaagagaaggaaggtaggtaggaataggaataggaatgggtaccccgactccgaggttgaagtagtaaccgagaaggtagccgacggggaggccaaagaggtagtagcaggcgaggttgatgtaggcgacgaggccctgccatccgccgccgacggccacaccggacagcaccggctgcacgctgttgagcaccatggtgaccccgagcaggccagcgatcctggagacggcgcggagcaggtgggcgtcgctggtgtagacgagcgccagcttgtcgctgaaggcgagcacgagcgccatgcagaggaggccgatgagcagcgactccgccaccaccaccaccacggcgtgcatggccgccctgggcctcccggagcccagctcgttggacacccggacgctgatggccgcgttgaggccgatgaagatcatgccctcgtagccgttgatgttcatgcagatccccagcgagtcgaccgccatctgggcgtcgtccaggtcccccgtgaggacggtgatgaggcccaggtaccatatctcgaggcacagcatcaccgccgactcgatggacaggcggaggaaggcggccaggtcgtggaacgccgccatggaccacccgcgccacccctccctgcaccaccccattatgtaggccacctgcgccagcgacgacgcccactgcgacacgtcgtacgccgccgccgcgcccgggagcccccaccccagcaccgacaccgcgaggtaggtgatgcccacgtggaacgccagccccgccacgccgatccatgccagcacccccaccttgctctgcgcctggaggaacttgcccgacgggaagttcacggcgaaggcgaaggcgcccgggaggatgtaaagcgtgaaccgccccgccgcgcgcgccacctccgggtcctgccccaccagcaggagcagcggctcggccagcacgtacacggggaccatcaggaccgtggcgccgagaaggatgatccaggatcgctggaagtagacgcccagcatggacacct

SEQ ID NO: 25944 - DNA, 1645 bp, Oryza sativa
cccatgcccaggaggaagccgagggcgaaggtggcgaacacggagaggcccacggaggcggcggcgagggggaggtttccgaggtggccgatgaacatggtggtcacggagctgatggcgtagttggtgatggtgccgatggcgatgggggtgccgatggcccacagccgctttgtctcatgccagaacatgcgcgccgccgccccggccgactccacggcggccgcgtcctcctccggcgctggtggtgacacggagcccatggttgattggttggagagcagcagcagcagatctctccctggtctggtcaaatgtgtggcgaaggcgcgtcatttatttggggagttgcgccggtccatttcacaatgaatgcgtatgactttttttctgcttggattttggattttgcttggagtaggtaccagctacccgcacgcacgccgctatcctcctcgtgacacacctccatttcagtttccatgccttccctttattaaattaacggagcacggagtacttatcaatcagagcagatacaatagcagtctataaaccaactataaatatattttaaatagataaaagaagaaagagaaaagcagcggactacagatctgtagctagctgcaatatggactctaaaagtaatgtgtgtatgatagatgagactaggtattaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaatagtaaatgaaacaactattttataaatcgactattacgttggctaggtgatttagagctagtagctagttatactattaaacttcctcttagatgcaaccaatgtagtactagagagaattaatacctgtaactgtaacgattaaaaaaagaaagaaattaaaaaaggatcggggcaaaacaaaaccgtcatttctagtatggctgtactaggatcgtcattcgagccattatttttctctctatatttttcgtaatttatgaacaaaaaaataaataaattcgtactccagtccgtgtcagcgagtggtacagctgagtaaagggagtgggtggactgtgcggtgcaaacagctaccacgtcttcacgtattataggctcctactgggctttctttctttctgttgggcttgaatcctccctccaacacgaatcgcaatcgcgcgaggcattgtacatcggaataagtccatttttactcccttaaaattgacccaatcaatcttgacacataaactgttaaatccgg

SEQ ID NO: 25945 - DNA, 2752 bp, Oryza sativa
cacgtcttcacgtattataggctcctactgggctttctttctttctgttgggcttgaatcctccctccaacacgaatcgcaatcgcgcgaggcattgtacatcggaataagtccatttttactcccttaaaattgacccaatcaatcttgacacataaactgttaaaaccggtgcaatttgactccctcgacggttttggtgagcggtttcgctgacgtggcatgttatgtggcgatgttgacccgtcttcgtcctatgaggcgttgacgtggcgcttacttgtaattagaattaaaaaaaatatgtgggctcacttatcattcacaaacacacaaaattgtgggacccactgacaggtgggacctacatgtcagtctatcccttcatcatcctcccgacctccccgttccatgccccatgccgccgtcgtcagagcagccagctctctagcatcgagaacaccggcgcgggcccggcgccaccggtggccatcttgctcgtctccgtcgagccctccagcgtctgggcaattgccgtggcggcggtggcggctgtcgtcaccgctctggctcgcgctctggctcgccgacggggacgccgcgccctcgccggagcactgtagctgatgctgcatcgtcgccatcgtggaggtcgaccccaacgcctcggggcctcgcgagcgccgcgcactaggagtggcagacgcggcgtgagtggaggcgatcgatctcgcacgggatccggcggtagtgctcgcgcaagactttgtctgggagttgcgcccatccccgaggccgttgatcagccgccattggaggagacgggaaaggattggatggagattggaggttagcagcgtactctggggcgaattgaaagggaaatggcatgacaggtcgatgtgagaagacaatgtgctactgtatattttttttagataatggaatataatattccggcctttactcaaaagagctacagccaattattacatagtagttttcataaacatagtgtaaatctaaataaatagaacacaccgaagatcactattattgaaaccagcctaacgtaaggagatcacaattattgaagtctatttgtaaatctccaaccataattggcaaatagttgtataaccgtggtctccaactttcggcatgcaaccttcagaaactcttcatcttcatcacacctttgtagttgtgcccaaaaccggagccaatgagttgccctgaaaataacctacatataggaaaatgatggtgatttgtcaaaaaccatatcgttcctactcagccatattgcccaacaaatagcagaagctccaacaagtatcagtttactcattttcttatcaactcccaaaagccacccattaaaaatatgagatatgctaactgaaagattaaaaccaaaagagaactgaactgctctccatagaaatttcgcaaaatgaactgctctccatagaaatttcgcaaaatgataatccataaagagatgttgaatagactcattcttcaaacaaaaagaacacctcaagctgccattccagttacgccttgccaaattatccttagttaacacaacccctttaagcaggtaccacatgaaaattttaatcttaagtggcaacttaagcttccaaatacacttgtttctttcgatatagccattattaattaaagctaggtacatagacctcaccgagaacaagccattctgatggaaattccatctaaaactatcagacgaatcattcaactgaatatgtactatagaggcacacaactgatgccaacaaacaagattctgaccaactaaagctctcctgaaagaaacattaagcggaacatatcccataacagtggcaatagaagatgttttcctcggaacaattgcgtacaaagatggatatttatccttaaaagccaagttaccaatccatctatcttcccaaaatctgatttgttccccattattgacaatccaagaacccatatttaagaaagtacttttgacattcataagaccagaccaaaaatgagaatcaccttgtttcctgtcaacttaggttatagatttattataaagatatttcctcttcaataaatcatgccaaaccccatcctcattaattaacttaaacaaccatttacttaaaagacatttattttgtatctccaaattatgaatcccaagacccccctggtccttgggttgacaaacaacatcccacctagtgagcctgtattttttcttatggtcatccccttgccaaaaaaaaccgcgatctataataatcaattttacaaagaacccctttcggcacctcaaaaaaagatatcataaacagggtaaacttgagagaacagaattaatcaacactagtctaccaccaacagataaatgcttgcctttccaactactaagctttttctcaattctctcttcaataagtttccaatctttattagaaagcttcctaaaatgcatcggaattccaaggtatttaaaaaggaaaggtacctaacttacaacccaaaatatcagaatagtgttcataacattccttggcctgaccaaagcaaaataattactcttggggaaatttattttttaggccagataacttttcaaatatcgataaaatcagtttcaaattctttgcctgttgcaagtcatgctccaaaaagataatagtatcatctgcgtattgcaagataaacacaccatcatcaacaagat

SEQ ID NO: 25946 - DNA, 1470 bp, Oryza sativa
ttatgttccatttggaaaatagcatccttaacctcattttcagaaaattccttagttaaggcttcattctctaaatatgaaacttgaggaatgtcagcaacataattctcatcaaattgaaggtcagactcatcaggagggccaaaaagacctttataataagtggtaatatgcgactttaaattggcatcaccacttattaaatgatcaccctcctgtaattgataaattctagttttcctatgttttccatttgccactaaatgaaaatactttgtattagagtcaccctctaaaatatccttagtcttagcccgctgataccatttaatttcttcttcccttagaatgacagataacctactcctgaaaaaccatctaatatcaacttcctcttgagacaggagaacagtctctgcctttttatccagcgcctccaacttatctaaaatatgctttttctcttttttgtataaaccactggtatgtttagcccatcccctaagatgctgtcttaggcggcgaattttcgcttgccaacgctccataggagtattgccctcatcaaccccagaccaaacttcttttaccatatcaacaaatccatcacgtaataaccaaccaagttcaaacttaaaactatgttgagcgttactaaaagaggaagattttgtatttaggagcaaaggagtatggtctgaaatatctctattgagagcaacaacagaggataaagggtatttttgctcccattccgtcgacactaaaactctatccagtttctcataggttgggtgtgccagattatttgcccaagtaaaattcctaccagtcatttgtatctccctaaggcacaacccatcaataatagcattgaataagaagggccatctatcatcataattatcattatttttttcattaggactacgaataatgttaaaatcaccaccaataagaattggtaagttctcatgactgcacatgttaactaattctgcaagaaattggtccttaaactcattttgtgcaggtccatacaccaacactaaggcccacttaaaattatcagctttatttcgcaaatgaaacttaatataaaaaaccccctcatcaatcaaaccaatgtcagaatttaataaattaatacccaacagaagaccaccagatctgcctctaggaggtttacaatgccataaaaaatctttaccagcacaaagattattaagagcagctgtagaaaattctttcttaacggtctcagataaagcaataaaatcaagttgatgttctttggttaaatcagaaacaaacttatgttttttcgggtccttgaacccatcacaattccaaaagattcctttcatttaaaactaattttattattcttcttcttttttttacccttcttaccattagaaatactattagtagaaggtaccatggaatccaaagtggactgaatattat

SEQ ID NO: 25947 - DNA, 885 bp, Oryza sativa
agttcatctgctgcctcgacgcaccgccccatctgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctagaaaagtccaaaaaaatctcttctctcagtgggcaaggtcccccttttatatcttaaggggataccacatgcaccatttccctcttttttgtggggacttcccccaccttttcataaatggacggagatttgtatcgttgccgtccgagtcaccttctgatgggacggcccacaactacctccactttcgccgggagcagatgcgacgtggaattgtggccacctgctgacgacatgaccggagtcagaccagtcacgtcggtcattcttgtccaccacgtgtcagcttagcaatctacatgttcgcccttcttcacacaacatcttgcttgtaatggttaggatgaagcctggcatatatctgatcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcactgcactgcgttacatgcggcgtgacacgctcagccaaaccgcaataaatgtggttag

SEQ ID NO: 25948 - DNA, 530 bp, Oryza sativa
  unsure (1)..(530): unsure at all n locations
atgggctaaacataccagtggtttatacaaaaaagagaaaaagcatattttagataagttggaggcgctggataaaaaggcagagactgttctcctgtctcaagaggaagttgatattagatggtttttcaggagtaggttatctgtcattctaagggaagaagaaattaaatggtatcagcgggctaagactaaggatattttagagggtgactctaatacaaagtattttcatttagtggcaaatggaaaacataggaaaactagaatttatcaattacaggagggtgatcatttaataagtggtgatgccaatttaaagtcgcatattaccacttattataaaggtctttttggccctcctgatgagtctgaccttcaatttgatgagaattatgttgctgacattcctcaagtttcatatttagagagatgaggccttaactaaggaattttgtgaaaatgaggttaagaatnnnnnnnnnnnnnnnnnnnnnnnnnnnnnnnnnnnnnnnnnnnnnnnnnnnnnn

SEQ ID NO: 25949 - DNA, 685 bp, Oryza sativa
  unsure (1)..(685): unsure at all n locations
tgtccttcctgtcgctgcctctcctaaccttgtgagacgatgacgatcccccatgcaacaatgcgttgtgtttgtttgttaggcaggcagcatgagcacgaggaggcatgctatgctatcacattcacaccacgtctctctgctgcttctcatatcatctcatctccctcctttttagttatagatagatagtacattagagattactgtactcgaagggagagagatactcctagatagagacagggaaagacatgttatgttattattactagggccaggcggcaatcaatgggttgctttcgaacgctgttccgagttggtgcaagtaacatggacggattattggatcatgccaagattcctcctcctcttcctccccctttcaaaagcacaaaccatggcacctgcacactcatcaccttctttcgacttctccatctacaacagctacagtacctactaccactacggactagtactagatcagaagatgtgacgcccttttgcagcacccactcatcaactgcacttgtccactccagtgcccactgcagctcattgccaaatttcaaggaatcctaagctcgggatgattccattccagcttgacattttgtcaggaatgtcagcccgcttcttcctnnnnnnnnnnnnnnnnnnnnnnnnnnnnnnnnnnnnnnnn

SEQ ID NO: 25950 - DNA, 852 bp, Oryza sativa
atgcgtaacccactgttctgcactgtgcatttgctgtcttgcttgaccgtgtgaaaagtgtatccatttatgtcatatccttgccaggtggtggcactccattcaggaccctgtgacaaccactgaagtgtttcactagggcaattctgcaacctggcaatttcgttcttcaggcactcgttgaaagaagacatgtgcttattcctgacccaactctctgaacggcctgggtactcttgtcggataactgtaaggtgttcatcaacgtacggcaccaccttagtcatatgctgtaataccgtgaaatgagctttatcgtacaccttccgatccaactaatagtctttcttccaacaggaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacataggggttctcacaagttctgcctgtagtttatctagtccctcgggatcaatgatcttctggccgattgcatggaagaaggaacacaaccgctggatcgggtgtcgcaccttaggaggcaaaatattccttattgcaacgggcaacagctgtgtgataagaacggggcaatcatgcgacttcattccaaccaactta

SEQ ID NO: 25951 - DNA, 2029 bp, Oryza sativa
tgtgctcttctcttttcgctttccaactttcctcttttttccaaactcgttggttattcccatcagtaagttgtgcacctctgtccctgttagctctgtagggggtccggttgtatctctgtgtccattgaaattctttttcatattcctatacgggtgataccttgggagaaatctcctgtgacccatgtagaccgtcttgtgtgaatgcttcaaccatttgcttcttgtttcctctatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacacccagggaggaaggttatagttaacaagcagaactggccatgtactgtgacgactgctcaaatctccgaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttaacttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattaatagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacaccctgatccaacacttcttcagctgcgacatcaggcgcctcttgctctccatgcttggtccatcaggtatatttcttcatgaatccattcattatcaaatgagcatgcacttcatccttgtcttcgatcatccgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatatgttttttaccttgaattttagtaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggt

SEQ ID NO: 25952 - DNA, 1175 bp, Oryza sativa
actatagggcgaattcgagctcggtaccctggtattctagcgaagccaatttaagtgatggtatttctgcaagccaatcttatgcgatggtagatatgcaattttctcgccaaaactagagtttcatttggaaatgtaaagcccctccgatggtccaattcttcatgtggctgcttgcgaaggaaagattgccgacaagagtaaacctccacaaaaaaaacacattgtcccaacaccgatctgtgagctccgaagtggagaagaagagactgcaacacatctctggtggtgtttgggaaggaggggacctctatctgagctgtccatttgctgtttttcgtagtatgacctattccttgctcatattgatcgctaaatacatcgaggacgccatgctttgggtggaacgtctctatagcgaggatagagtagttgtggactcctggtaaggaactcttcccccctccccctcaaatcctatcttactataaagttatcctccactaactccttaagcttaacatgcaaagatgccacatcatcatacactaacaagatgccacatcatcatccactaattaacaagatgccacatcatcatccactaacaatcatcacatttaaacatcatgcaaatatgatatatctttatagtttttataatttaagagcttttcaaatacaaacatgttaaattatcatccaacataattcacataatgtttcaatgtatatctttattatgttttatgatatcctatatacttatatagttcatcctcacttagttagtgcttaaatgattaatctatggtccaaattatttttctccttttttcctctaattaagtcatatacataaattgtttttagcctttagatgattaatctacggtccaaactatctccctacttttcttcttccataaagtcataccaccctattttttacgtttgaatcaccattctacgtactatttaaatttaaattatcataaaccacattaatttacttaatctgatgttatctagctatcttacacgttttttttattgttatcatactaaattcccgcagcaatgcgcggggtttcacctagtctaatgtaatctaatcccctttaacaaacctttgctaatgaaattcacgtggggaagctctccccctgtgaaag

SEQ ID NO: 25953 - DNA, 1796 bp, Oryza sativa
  unsure (1)..(1796): unsure at all n locations
ttggcgacttgataactcccatcggctgattccgagatgctgcagtcgataatgattctaagccgataacgtctttgccgattaccaaatttcactgttaacatatttctatatggcctctaagcttttcaatataagatgtacattagctagcaagttgcccttgccgcgaagaaattagacaacaaactaaagcatacttagtaggagtaatactctatatatagtcagttttatctcttctgtacctagcttgcttggaataattatatataagtgattaacaaactcagtataaagtacacaatgaacagatggatatgcattgatccgatctttttcgcgaacgctgcattgatccgatctatgcatgcatatgcgactagagaggcattcagaattaatctgtttaattagcactcatatatagatatgtgaagtaaaccaaacacacaacacagcaattacttggtgatgtttgattaagctattgctgctatactacacacaaatgctaaagaaagagaaatatatatggccctggcacttgaaccactaaaatttacctgtataaacgtacttatatagcttggatcgatcttgcattatattggctcaccttttgttaattaattagctcgagctggctagctatatatagcttgttgatcatatatatcatgtgagtatatatatatgccaattaattaagcaaggatttaattcatgaagcttaattaattaatctagctagagagctagtagggcggcggcggcggagggcgggcatggtgccatgcagcaagcccggcgtcgtgcattcccccgccgaaaagtagtggatcggcggcgccggccatgagtggcggcggcgccatcatgccgcctgccgctgcttcctcctcctcctgatccagcggcagcctctcgtaggtggcgttggcgaaggtggaggcgatcaccatgaccggccccgccgcggtgagcgtccccaccacgctgccgcccaccacctgcccctgcccgccggcgaggtacacggtcagcccggtggagcccggcggcgccggccccggcaggaacgtccccgtcagggacaggatctcgaaccgcccacggagcgccaccacggcgctcggcgcggccggctggcgcagggccacgtcggtcacggtgccggccccgctgagcacgcagacgccgcgctgccgccgccgcgcgaagtgcgcgatggactcggcgacatcggcgccgccggccacctccatgacgtggctgcgcagcgcgttcgggctgtcccgcgtcacgaagatgggcggcttgggcttgttcttggagcccggcggccgtccgcgggggcgccggttgcggccggtcaccaccgcgccgtccttgggctcgccgcccccggcgctggtcccgttcatctcgtggtcgtggtcgccgcttggctccttggacgccatgtcgtcgtcaccggcgccggtggtgtcgttgttgccaaggccgagggatgggtcggcggctgtcaccggcaggctgagccgcccctcgtcccaccaccggctcgccagcttctacctgcggcctatatatccaggctaggctagggtttaacttcttcttcttctttctcggcttccgatcgatcgatagatcccttcaattgattagcttctggctagctagtgcttcttgctcgctgcgccacctcggatatatatcatatgtnnnnnnnnnnnnnnnnnnnnnnnnnnnnnnnnnnnnnnnnnnnnnnnnnnnnnnnnnnnnnnnnn

SEQ ID NO: 25954 - DNA, 5572 bp, Oryza sativa
ccccccaccaccgcaccttgcagcagctgcgggacgaagaaagactggaatagccgcatcgtcgccggtaccccgatgaacatctcacacaaatgcgcaaagatggccagcgtcatcacgacgttgggtgcgagatgcaaggcatggatttcgtagaaatccaaaacctcgtggaataatccggagaatggcgggatcaaccccgccatagcaaaggacaggaggtgcacggatcgctccgggtaccgtggccgcggccgcgactcccccgccctcacggcggcgtcttccggcatgatcttgcgggggagactaaggtgcctatccgccataatgcgcgatgctggaagcactgcgtcgctggcatcttgagccatgatgactggcggagaaacgacgaggggcttggtgtgcggagtagcgtggagtggcgagaatgttagggcttagggagcgagtgtgcgggtgagcagttggcgaaaggaagaaggcaaagtccccgcctccgtatccttttatccctgcctcgcccgcgctcgcctccttgtttcacgccctctcggttgcccccacgattctcgcgcctgcagttgcctcatcgtttcctgcgaccactcatcacgtcgcccactgaatccgcgtcccgcatttagtgcgcctgtcagcggcacactcggcgtagggcgtgcgacggtcacgggcgcaatctgggcgaaccgtcaccagtaccgccgcatgcgtggcgggtgagggagtctaggtgcagtccatccaaccccctgattttcgcgccttaagcatcctcatcatcagcgcggtcagtggcggtcaaaccgctgttgttgttgatacgccaacctggccactcggcggcatccacttagattccctgccgggcccacaacaccagtttgggaagtcgtgaggcaccacatcagaccgacctcaggaggccaatgtccgatgtggtgccgggggctactgtcggagatatgggcccgggagtatgcgaagtgaggggaatctaccttcccatcctgccacgtgtccctacagcctggtcctgtccccgtattccgtgaaccgcaggaacggctggggggtcggccaaccctcggggtgccacgtcatgcccctcgggcccttgcactactttgccccgaggccctcgcccaaccgccgtttggggggggggagcaagcgaggagggggcccaggctgaacttcctttaatgcgcgcaacgccccaactgccccatgtcgcatttaatgcagtggggcagacgtgcggcgtgctaaactgacgcgcgatggtcaagaatgaccggtctgtgaccggcctgacaccggtcatgtctgactggacggacaaccgtgctcccacgtcgcatctacttccagcggagtggaggtaggtatgacctgtcccatcgggggttcattcggacggcggccaccacaagtcttcacctattaatgagggaatgacagggccatcccccgtgtcaggcgagggacggcgctgggccccgctcaaggataagctgtggtttagtttccaggcgaaggcacaggtcgagttccagtcaagatagggtgggtcctctcccgaaagaagagtaggtagaggcggtgtatgtggtatccccttgaggtataaaaggaggactttgccctccgagaggggggacgactctcagaaaacctgagcttgtggaggagggaagtaagagtgttctcccgagtttaggaacccttgtaactctcagtctaaatcccatacacaggagtagggtattacacttgatagcggcctgaacctatataatttggttgtgtgcgagctagctaggagccttggggacagatatgcgatttctagaggcgagcttcttctcccggccgaactcacgaaagggggggtctcacgatctcccgcaagagagggtcactcctcgacaaagttaattactcgatctgaaaaaaaacatatatatgcacattgctctcgttgcgttcatcattttatatataccaaagcatatgcatgccagtttaatttaatcattaatttacgattatctcaacagtcttagtagtactattactagctgtctcatcttttttgttatgtaaagattagtagtacggatatatcatattaggtactagattgggtttttatgggactgagagggcatatagtaaagtacaagcagccatttgcagaacactgtacctagactctaggttgtgatgaacccaacaaacacctatactagtagctaagctaagaccatggattgactggtaattttattggcaatggccatacaaagctcctaatgatgcgtgaaaggagatcaaaaaagtgttaattagctttaatgacagctcccactaatataaaagggcacagattcctgtagctagcctcctaatgtaatggtggtccggggacacaagttgcatgcaaggcttcattgccatgaactttgttttgttaattacgacaggtcatgccggattagattactgtattaagataagctagcttcacttgttggttagcgctttcctcaaaaaaaaaaaacttgttggttagcgcaacacgtcaaaagacagcactatatgtattcacagcaaattaatctcaactgcagcaatgatcaacgattttttttttgtaaatatgttcagttaatatttggaatctctcatattcttagatgaataatactactgcctttctagtttgctgattaaatcgtgcgccttttgctgcattagttgcgttgtttggattaaactatccattatcaagtaattaatcacctcccttggcccgtgaatggccagttggaattgtaaaatggatgagacaggagagacgatcggagaggtgaggctagcagcaaatacattaatcggacaaccttaggatggtcgaatttttcttaattatgtacgggcaggaagcaaggagtactttaggatttgtgcaattttcggaaccacaagaagtatgcacagaagtttcatccggcttctggatgctaacatgatggatcacatcacaattcacccgtattcctttcattttaaaataaataaatatagtagttttaggtcataagatgttttaactttgatcaaagtcaaactgttttaaatttaactaaatttatagataaatataataatatttatattaccaaattgattttattaaattaatacttaaatatatttttataataaatttatcttagataaaaaatattactatttttttataaacttggtcaaatttaaagcagtttgactttgatccaaatcaaaacattttataatctgacaaagtcagaatattttataacctgaaacagaaggagtacgggatatgacacacattcgtttgtccaggatatgtcatgctactattttgtgatgacggagggagtacgtagacgtgtagcacacagtgacatcattaactcaagaagtcttcagtgatcgatacaacaacttggtggccatgtttgggggcctaacacacagtaaaaacttggcaggggcacagtctctcttggaacgtcaactcgcaatagcgtgaagagcaaaacaacacaactcttcgttcattcattcggtgtccagtgtaacaatcagcaggacaaagtcgccatttgacatttgcagcagccacttgcaggcagtccatcgacagacacacagcatcttctcttctctagcaaatcagtaaaatctcagcagaacaattgcagtgagtgaagcgaatccaaatgctggtttgcatacaacgatggttgaaatgggcacaagtgtagcaccaccaacgagggcatatatcatcaactcgtaactcatcttttgccgtcacaaagttttacaacagttctcaccacattcagaaaacgttcagctcgccttacaatcaatccacacagtttgagataaaattctcaaatgttcggtcatcaagtgcacaaaacttgataaacaccgtcagccatgtactttacgtgcaagcaagaggaaaatgaaaggcagagtcagacaattcttctacttggttaggtagtatataaggaagaagacagaaatgaaagaagccaccatggtagccattctgcgacttgctttggtctcaaaaacctgaagtaagaaaaaaaaaagagcaattgtaagaataacagaacagttaaggagtagcccatgacgtggagataggaactccttaattcattaccatcttaaacttgtccaccgttccagatagaaatcctctggaagcatccatatcattaccgtaaatagcaaagaaatgcattagagagtagtgacaagaaagatagcatcttgcaggatattagtaccattctgtccagcattcggttatgattctccacttcttcatgtatatctcctgtcaactgaagagacaaaccacatcaaaggtacagtaagtttagaatggctataagcacatatgaagattacattgtgatctagcatgcaaaatcttgagaacaataacatacaaaagctaaaagatgcagcgctgtttacttttgatattcagatcatccacatgcaataaccatcatactaattttttgaaatggtatatggcaggaggactgccggttatattaggaggagaaaaataaagataaaaagttattaacaatggatcatagtccgtcgagagagaaagaggagggaaggggcgacttaattacataaggagtgaatcatagactaaggaaaataacatatggtaaattttgcagtgaactttgcgccatgttcctcacaacaaaatatttgcagtgagctaaggactattaacgatgcgtcgggacctcctggaggctggaacagtggaataatttatccttgaatgatatgtctttattcctcttttctagctgtttctataatgctattttggattctcgaatgtgttgatctcacattcagatgttcagaccgtccttatatttttcttcgatggaaaaaattggggtcatttctccctagaaaaatatgtcagacaatctggaaatttatactagcaaatacacaagaaagtgcccaactcttgccgtgttactgtacaaagctataagtagtcaccttctgcagttagcacgaaaacaagtcatgggccatcagtaaataattccaaattaagccgttttatttctaccagctcgataaaaactccatccttggtattatatagtgcaaaacgatctaaccccaacctgcaaagccggtgttaccggagctggccatctaaaccgtggttgctctaggtcgtgccaatttgtatagcgagaataggcaccagtgtttcattatctttttgcacttctcaaaaaaaatctaaccctaaccttattgtaacggctcaaccattatcgcacacaatgcgatccaatcagactgaaccatttagccctttgcagtagcacagggttttgtgttaatgaggtagtaaaaacctttctaggtttgtattgcacataactcaatatgtgaa

SEQ ID NO: 25955 - DNA, 900 bp, Oryza sativa
cacagggttttgtgttaatgaggtagtaaaaccctttctaggtttgtattgcacataactcaatatgtgaagcaaactttgcagagaaatgaagtgcgtcatatgtactttttttgagaacactgaccctgtcatactcttttggtagctcagaaattccgtctttggtattatggtacaacacgatctaacccaaacattaacttaaaaaatgctccaagcattgttgtatactcaatgatcttatcagacggaacaatttagccctttgcagtagtacgggggtttgtgtaattgaggtttgaaaacctttccaggattgtgttgcacatagctcaattcagcaagtaaactttggagagaaaagaaatacatcatacgtactcttttgagaacgctgaccctgtcatgcagactgtccatagcttggtcattctcatgctcatgaatttgagaagagtaagctgaacttctgatcgcaccctcctcaataccatcaaataaagcagctctgtggctgcggaagtccctgcaaacggccaaatgaatataaaaggcattactaccgtgttctggacaactttagtactgtctagtatgcgtcacttccgttagctgagaaaaattacttccagtgattgaaaagtagcagagtagaaacaaacagtttaattattattattttcatatgtgttgtattttcgtaagtttccatgagattatattataattttttttatgaatcatgacatgttaaatgaaaaagggggtattttaattgtggaaaatcagtaaagactaaagaggcatcatacggtacggtaagattggataaggggataagcatgatgaacgaaatggacaaaatgcatatatgcaagaggcaggggctaagagggg

SEQ ID NO: 25956 - DNA, 2205 bp, Oryza sativa
  unsure (1)..(2205): unsure at all n locations
caaaattctccatgcattttggtttctgtcattctttgatgattaaggaactttgcagattatctaaacttggggatttatataccctttttgtctatgaataggtgaattgcatgaattgttgtttatatacatgatttatatacccttgctgctgctgccacataaataattgtgggctgttttattatctacacttgattgaattgaatggatgaattgctgtttacatgaagttagtagtactgtctgtttttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttctttatgcataagaacagattttctgcacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattttgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctgggcaccgcagggtacatctgcaaggaggcaatatgggctcaagaagatgcagccgctgcagcagcgaatgtccctgccccgtttcagacatccctgaacaaagagctcgcaactgggcgcgggcaaggggtaaggtcaacccggacggctctgtcacatttgagaacaaaagtgatgccgtcgtccatcaggaactggtgannnnnnnnnnnnnnnnnnnnnnnnnnnnnnnnnnnnnnnnnnnnnnnnnnnnnnnnnnnnnn

SEQ ID NO: 25957 - DNA, 2874 bp, Oryza sativa
accccggacggctctgtcacatttgagaacaaaagtgatgccgtcgtctatcaggaaaccttttgaagagttcactacttaacctaactaatttccgttcgtataaagtacaagttcgtataagcgactatcttcttttctagttgggcttggttactgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagatcccaatacaggaaacggaaagtctccaaggaagagaggtacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagttgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttcttaaatgctactccttgtaagtgcataccttctatacttgtgatatgactggactatatctcctaattaaattagttctaatacgtacatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacactacataaccactgcgcaggcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctaaattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctggtttctcctttttttttccttattgacaggttgtgcaggtcgatgacattatggctttaatccatttggtaagtatatatgcggttctatgagcaacgaccgaaattgtggctttaaaggggtgtgaatttgctgtgcaaaattgtggcatttgaactgcatatatgtgttgttggggatctgtgatgttatattgggggggtgatgtatctgtgatggatctgtgactagaatatatctgtgatgtttctattttgcagagggcatggctagcaaatcctgaggctagccaatatttagcatttatttttttttctggaattaactcatcagtgacgggtcggaacaaaaatcg

SEQ ID NO: 25958 - DNA, 1396 bp, Oryza sativa
  unsure (1)..(1396): unsure at all n locations
nnnnnnnnnnnnnnnnnnnnnnnnnnnnnnttactgctagcttgcagatccgtgcagaaaaataatatattatctaatttattcttgccgcttatacaggcttactgcatccaatattaactatattctgctaataaaggatggatttgcatatatttttttaaagcgaggcccttcacggaaaattaatgatgcctgagcacgcattgtccttcatgcatgcgtatatatatatatatatatatatatatatatatatatatatatatatatatatatatatatatatgtagtacggtatttaacttgttcataaataattataattaagcacactgatcttgtcgtacgtcgaaacttgctgaaagatacatgagcgaccatatatatatatatgcttggtcccaaataattctcccaatgaatcaatatcattacatttgtagggacatggaagaagatctagtagtggcctggtaacaatatatataatctagttgattattagctagtgagcaaaggtgcatgctgagcttctcatcaattgttttgctgatgctgtaagggagaggcatgtatacgtaatcgaaactacgtaagtctagggatgcataaatatataataggtacataaacaagagtaaaattggagacaaattaaaggctttagtctaaaaataattggagataaattaaaggctatatactgccttatagaatactgcacagcgaccatcgattggtgtgccaaagccaaaagaatgaatccatagtgacgaccttttcttaactaatcaattcgctcccttggaatagctctatatataaatatatcattcgatgaataggcatggtttcatattgatttgccgttgtttgcatgcgcatgcatgtatatatacaaattaaaaaatatactgaattattaacctatatagttagctgcagtacactggaggaatcagatgcatttttttgcgctggcattttgttcttgggtaaaggcaaacattttcactcttttgctggatttgcgaatcgtcctcttgtctttttatcctaccttaattatatatgcatgcatggatgtcgtttccagaagaaaccacatacgatgaccctgactaaatcagaaggacatgcatgagcttcaggacgactatagagtcagcagtattgtgttctggtccacctagctagacgacatgctgggctgtatgagctctattgatcatacatattctggcccaaatgatgtagtgttccatgggccatcagcttaatatgggcgttcaatcattgttggtactggcccagatggttgattgacatattatttggggattaagttcacttgactcccttaattagtggtcgaatcacctaattattaaaa

SEQ ID NO: 25959 - DNA, 2713 bp, Oryza sativa
  unsure (1)..(2713): unsure at all n locations
agctcggtaccctgcgctggcattttgttcttgggtaaaggcaaacattttcactcttttgctggatttgcgaatcgtcctcttgtctttttatcctaccttaattatatatgcatgcatggatgtcgtttccagaagaaaccacatacgatgaccctgactaaatcagaaggacatgcatgagcttcaggacgactatagagtcagcagtattgttgttctggtccacctagctagacgacatgctgggctgtatgagctctattgatcatacatattctggcccaaatgatgtagtgttccatgggccatcagcttaatatgggcgttcaatcattgttggtctggcccagatggttgattgacatattatttggggattaagttcacttgactcccttaattagtggtcgaatcacctaattattaaaactggtgtaatttgacttcctcggtggtttttggagggtagtttcactgacatggcgcctatggtgcggtagtaacctggtcttcgttctacgtggtgttgacgtggcgctaatgtggtattagaattaaggggttgtacagattgatgccatttccaaccataccatttttgataaagttgctaaagatgtgcatacatttatttttttaccaaaccttggtaagtatataagaaatcctatcaaaaattgtcaataggtgtcaacttatcaaaaattgataaagtttattttggctacaatctaaacagcctctaaagaatatgtgtgggactcatttgtcattcaataaaaaaaatactgtgggactcgctgacatggtgaaatcaccaggtaaaacgccaaggtgaagagaaatgggagagaaagagagagaagggtgagagggagggaggaggaagaagcaggatgacatgtgggcccacatgtcagtgggtccctcaaatttttttaaatgttaaatgggtcccacacatattttttcaattctaatgccacataatcgtcatgtcaataccacgtggaacgaagactaggttaacaccgctatgtcagcgaaattgtcctccaaaactacggagggagtcaaattgcaccaattttaatagttgtggagagtcgagatatccggtattgtggttcagtgatacgaattagatttggccactagctacgggagttaaattgaacttagtccttattatttgagcgtcatgtttagctagtgtttgtcatattgtagtgttgattatttgaagcccagcaattcaattctattattaattgccgtcatgtttagctagtgtttgggccggccattaggcaattaaacctaataatctatctggtcgtcttcttcattattccatccatcatatctcctgcgtgattgttaacctctgggggttccttcctttgttcgggcatagaattgaattagaggcaggatcaaatcaacatgactgactgtatacagtacagagagattgtttggaaggtaaacatataagacaggcggctaaagaaaataggaaatcattcgacaacttgagtgcgtgtttcatcaaatagtaatagaaaaatcttcatataacagtgacgagttctaaagaaaattcgacagtatatatagagattgttgatcactctatagacgatatacatttctcaatttgatcgacgaatccggcaactaacagaacaaaccctagttgttaacagttacggatccaggaaatttacgttaagtgtgcctatatatttaggatcactccactatatttttttttaaaaaaagaaaacaccaaagatctgacagcaaaattttaacaaattttgatcgaatttttcaaaaattgatcaaattgtggtctagaattcgtgaggaagtctgtaatattcagaagaaaaaaaacagaaataagcagtccactcctgcttcgtcccttgcagttgcagaaaccagttatcagtgaagatggctgtctagtcctctacacaaaaaccgctatcgagccattcctcttctttgttcttcctccaggctttcttctcctgatctgatttcttggagattaattacaggatctccagacaaatcataaccactattatgctccaatattcatcaagaggattccattttagtgacattttactatcatccatgtccataataatttcatactacattattttagtgtttttccataatttgtgggtatgccggtgcatacccgacacccccggtccgctcctggttattaataatactgtattattcatatttagctatgtgtaaatttaggtttgaaattttacgagacggtaaaactgtgccattaattaaatctttattatttccgtaaatatctcattgggaattaaggaagcagaagccccctgggcatacgtgacacagcaaggggaaagtaaagcggagagacttctgaggttaattagttgagaaaaaatggaggtgaagtgggcgcggcgctcaatcatatcatgcatcactgcatctgcgtgcaccacattggaaggctaggaacgaaagcatctccaatctctcattgctgacctctttaaattaacccccttaatttgaccaccctacgtaccagctttcatttcttaatttaattctctggcttctgtattnnnnnnnnnnnnnnnnnnnnnnnnnnnnnnnnnnnnnnnnnnnnnnnnnnnnnnnnnnnnnn

SEQ ID NO: 25960 - DNA, 12214 bp, Oryza sativa
tgtattattcatatttagctatgtgtaaatttaggtttgaaattttacgagacggtaaaactgtgccattaattaaatctttattatttccgtaaatatctcattgggaattaaggaagcagaagccccctgggcatacgtgacacagcaaggggaaagtaaagcggagagacttctgaggttaattagttgagaaaaaatggaggtgaagtgggcgcggcgctcaatcatatcatgcatcactgcatctgcgtgcaccacattggaaggctaggaacgaaagcatctccaatctctcattgctgacctctttaaattaacccccttaatttgaccaccctacgtaccagctttcatttcttaatttaattctctggcttctgtattatattgacagtgctcctatatatatgtactttagcgtggttagttatatattataacagcacgtaatcactgctcagcatgtacttaatttgtcccttggtagaatgatcagccgatgcttttgcacgatcagttcactgtgccatataggggctcccatgcatcatgaacaaattaacatgaccttcggtaaggcggtactctcgaaagtcgctattggggttgcacaagggatgagttcatcttcttctctcttattcctcctcctcatcaacctgtttctataggatgactaggagtttgtgggtggctagtagcttgcagttatggtaggacagagtgtctatgtcccgctgtagagctgtggtgacaggccacacataacagtgataggctcggcgttagttcttttctcaagttggtggttgggagtcgttagtttcatgctggtgagtttttcttttctttcctaattgtagcctcctagagttgtaatattgtatattttttcatgctatattaatatgaagcctcgcagctatctcatgtggtttgttcaaaaaaaataacatgatcaattgttgtttgttgtgtagtggtctctccggtgtcactatcggtgatttgacaaagacactcccaatgttgaatggtgtaaagatagtcatgtctccagtctttgcacatatatataatacatagagtcaaagtttaagatcaaaggtaaccttaataagcgattgaatgctctatgtgatggaaatgtgcatgacgtctatagtcctttctaagactctaagagtgagttacaaaccgcctttgctacctgtacgttgattgagttttagaaaaatcgtagttgattgatcaatcatcaatctgttgttgatctaagggctatagctctatcttgtacctcgagccaagagggagacatgataaggagagggatatgtcagagaggactcgcgacaacgtcctggtggagatgggcgggcggtgggtgggggtgagatcatgtggttaggttgcaagggtgatagatctagcagcgtgagccaccccgagatgaaggagaaaacacatatggatttgttgatgaagagggtgatggcagtgatgtggagggaaagaggacagggataggaaaggcttgtccagcctcgccggtgtcagcgctggcagtgcaaagaggaatgccatcacacgcgagtcaaagttgggacttagaacgttggtggcacaagagacgggatcaggagagggggaggctatgttaaaattagattgttacacaaataacaatgtaatctgagctatttaataaactatatataaaacatcaggcaactaatgaatggtcaagccgttatcaattattctggatggtaactccctgccttcgatgcaggacggagtgtagcgggggcccctgtccgaccatcccttgcgataagagtttttttctttctcagtaacttatatttcctgtatttgtgttttttgtttcttttttttccttgacccctagcaacggccctctgaccgtttgcgttgtgtaaccaaactctgttgtcttcttctaatatattgacgtgcaatcatttagcgcgttcgcgagaaaaaaatggtttggatggttaaatcttactagaaaccagaacaagataggctacgcaattagcaatggatggttggcattaggtcatctaaggtcaaaccgacggagatacatttgctgcataaatagcaactagcgtaatatgtgatgtgatgtacttcctacgtcttataataagtttattttttagctacttatatttgtctagaaataagttaatttttagaataattatttgtatcggagtttatgaaagtaaaaagtaattgtatttggagtacataaagtgaggaagtattgagatttgataaagtagaggtattttagtttttttttattggtacgtatgagattagtgaaaaataaatttatttgggaagggatgtagtacctagctactcttgtaccagctagattaagtataaaccaaaaacaacgggagtagtagtagtaagaatgtaaaacggttccaacataacgcaacaacggaacggttggatattcggttgggaggagaagggagattccgtttgagtaggttataaatagcaaggaatacatacgtacgttccaaatcatcacaaagcaagcaattaagctggcatgggcggcggcggcggggagcagcagcagcttgaggtgctccacgccctgaacgtggccaagacgcaatggtaccatttcacggccatcgtggtggccggaatggggttcttcaccgacgcctatgacctcttctgcatctccctcgtcaccaagctgctgggccgcatctactaccgcgtcgacgggtccccgtcccccggcacgctccccccgcacgtctccgcctgcgtcaacggcgtggccttcgtgggcacgctctcagggcaactcttctttggctggctgggcgacaagctcggccgtaagcgcgtctatggcatcaccctcatgctcatggtgctctgctccctcgcctccgcgctctcctttggccacaccccgacctccgtcatggccaccctctgcttcttccgcttctggctcggcttcggcatcggcggcgactacccgctctccgccaccatcatgtccgagtacgccaacaagaagacgcgtggcgccttcatcgccgccgtcttcgcgatgcagggcttcggcatcatcaccggcggcctcgtcgccatcctcgtctccgcctccttcagggccgccttcccggcgcctccctacggcgaggaccccgtggcctccacgccgccgcaggccgacttcgtgtggaggatcatactcatgctgggcgcgctgccggcggcgctcacctactactggcgcaccaagatgcccgagacggcgcgctacacggcgctcgtggccaccaacgccaagcaggccgcggccgacatgtccaaggtgctgcaggtggtggagatgcgtaatattggtaataatggtggcagcaggaggccgttcgggctgttctccggcgagtttgtccggcggcacgggctgcacctggtgggcacgtcggcgacgtggttgctgctggacattgcgttctacagccagaacctgttccagaaggacatattcagcgcggtggggtggatccccaaggcggcgactatgagcgcgctggaggagctgttccgcatcgcgcgggcgcagacgctgatcgcgctgtgcgggacggtgcccggctactggttcaccgtcacgctcatcgaagtggtgggccgtttcaagatccaggccgttggcttcttcatgatgaccctcttcatgctcaccctcgccctgccgtaccaccactggacggcgccggggaagaaccacgtcggcttcctgctgctctacggcctcaccttcttcttcgccaacttcggccccaactccaccaccttcatcgtgccggcggagattttcccggcgcggctgcgggccacgtgccacggcatctcggcggcgtcggggaagctgggcgccatcgtcggatccttcgggttcctgtacctggcgcagagccccgaccggagcaagacggagcacgggtaccctccgggcatcggcgtccgcaactcgctcttcctgctcgccgcctgcaacctgctgggcctgctcttcaccttcctcgtgccggagtccaaggggaagtcgctggaggagatgtccggcgacgccgaggcccaggaggaggcgccgccgcccctgcaaactgtactgtagcgctgtcgccgtctgcatatctatctatatatacatgcagatatatagccaccatataatataactgatcgatcgagaccagagaagatcgatcgaagaaaccgccagttgatatataactggcctggctatccactatatatatatatatatatatatatatattttgtcgttgtcgtcggcgacaccatgtaccttttcttctccttaattagccttattgtgtttcatgatgtgtcgatctacttctagttcgtcgtcaacgatccctgcctttttacaatcttgagcttttgcgcgcttttgacaaccgatcaagcctaactatatatataatctcgtagaaaatagaatatgtcaatgctagctaactgtacatcattatataggaactgtctaattaatgacctgaaaattcacttagtaacatatttttactcccccgtccttatttctagctatgtatctacacatgtgtatagccataaataaggtttttctataaaagtagtattgaattgctaaacaatatattttgtctgtgatagtgatatctcttgtgcatgtaaacaatatatatactatcccacattcatattgatgctaatgaatctagataaatatatatgtctagattattcattagcatcaatatgaatgtgagaaatgctagaatgacttacattgtgaaacggagagagtagccaatattaacatgaaaacgtgtccaatcaaagcacacagtaaatacatgcggtggcacccgaagatatgccactacaagaacaatacgtgccatcaggttctgcaagtactacagtgaaagttccaggagagaacccatcagggcaagtgcgtgtcgatgtgctataggttggctgacagggcctacggcacccttttacatcgcacaaacgaaataccaatatcaatttggggttggaagggttaagggggatatggattataaaaaaaaaaagtactccctccctttcatattagaagactttttagcattgcccacatttatatagatgtttatgaatctagacacatatatagattcattaacatctatatgaatataggcaatgctagaaaatatatgaaactgaggaagtaatggtttggtgttgttctaatgcttccaatatgaaacaaaactttacccagaaattccaggtagatctctctttcatggaagttttggttcccaacccaaaagtttcaggatatttaggaggtcaaaatctacccatagtgccaacttttggtgtaaacggtcaccaccagtgtgttataggctgttgttatttacactatagagtaaattatatccacggtacaacaatttggcgggtgggtgcgatatagtgcaataacttgaaaattaaacgttcaagtgcaacaacttgacaagtaggcgcgttctagtacaagaacttgacaaattagtattttgatgcatcaacttagctaagcatatgctaggtgagttttttttttcacgatgtcaatatgccattacatagcagtcctacggatattactttacaatattgaatttaatctttaagatttatactgcacattcaatttacatccaattatctttaagaatttttgttttctgtaccttcccaaatctcgaccgaaatataataatttctacatccagttaattgattttcagttattagttattaggataaaaatataaatatgcttatatacaaacccacgctagtatattgtcaaaataaatacttaaaaattaaatatgtatttaaaaagtgctccaaataattaagttgtcgcataacttcttaacttattgtaacaaaatcgtacatatcttgcaagttgttacatttatgcgatcacttataaagttcttgtcctgaattgcacttacctgccaagttattgcactagaacgctcatttctcaagttcttgcatcaaattgcaccaacctacaaagttgatgtaccgtgggtgcaatttactctacactataaatatgctaaatatatctattatttcttttaaaaaatatacttcctccgtcttgtaaaaaatcaatttctggggatgaatctggttgtctttttcttttggactgaaggtatattggcttatactaaaaagagttcttaattattaattttaaagtttggaattaaattaatgacattctaaatcgagagtgcaaaacaaatacaacttcatattatattaattataaattttgaaattattaaatttggaaaactaaaaaaataaaagaatgtgatatttacaattttttagataatgatgtgatatttacaattacatgttttacaatagtatccatgatagtaagtttgacctaatcaaaggctagatttaaaaacatgtaggagctctggcaaagtgtctaattaatacaaagtgtagattcgggacatcaattatatagagagggtacaatttcacgttggactatgccctttgaccaaagttctaatgggaaagggcgtgttcgaaagaaaaggtttgagaatggtttgggaatttttctctcgcgcacagaaaacaggatgactcattagcgtatgattaattaaatactagcttaaaaaaacttgaaaaaaaatattaatacgatttttaaaataacttttccataggaactatttttgcaaaagaaaaatacagtttagtagtttaaaaaatatacgcgtgaaaaacaagaaagtaatattaggaacattgtagtatagaccacaccctaagccaacgtgcaggggcagtataaacatattacatatatatggtggtggatgaactagatatgtgtatagggtgggaagcgtataatcttcaagggacaaccttgaccatcaagattggccatgcagaaaaatgatgtaaagcaattcttgtgctgtgttattagcttgttgtgcataagtcaaattgaaggcaagggatcatgctcttactgcttgggaatatgccggccggggagaagggagaaggaaggaaaagatacatctttctaaaaagtgattcagatattatatattgctcagtgtagcgtgttgctccactggaatgttcctatagtggcttaattggggctacctagtacaatatatacaggaggaggaggaggagaactagattaatgaatgatgatccaatgtggccggtagtgcatcttcgattcactcactacatgctgtcgttcatgttagatgtatactctcttcgtttacttgtgcgtctctattctcagatgcatgtcttcatgccataggtagtttgcacacttcatcgtaactgtcgcttcgaattaagagcctacttggatcatttagttttcgaactaaaattagtctctggaccaaaaactttagtcccctactatttggatccagggactaaaatgtactaaacgcacgtggaccaagagagaagagaaagactgccactttagtcactataagtacctccaagagggactaatggattttagtcatccctgtttggattcttaggaactaaaggtgactaaaatggagggactaatggattagtcctataaaccgaacaaggcctaatttgtctttgtgccatgtgtagtttgcacacttcgtcataactgtcgcttcctacagaagtacctctaagagtgactaatggattttagtcccaatatacacttagtctattttagtcatcccaatttggatttttaggaactaaaagtgactaaaatggagggactaatggattagtcctatgaaccgaatcgggcctaacttgtcttcgtgccatgtgtagtttgcacatttaacttgtcttcgcgccatgtgtagtttacacatttcgtcgtaactgtcgcttccttaggaattaacttgtctcctttcttttttttattacctaaaattttatgataattaaacttggacgaaaaaaaacaacttaggccttcagccctaaaacacgtgtctttattttttttatttttttgagaagggtaatttttacccgtctctatatccaaccggtgtctttttattttattttttatttttttgagaatggtattttttatccagcctctatatccaaccggatatatgtaaacttttttaaattcttagctctcaaattatccaatctaaaattcattcctatggagatttgaactcatgactttaggatgctactcaggttactgcaacactattctacatgctttttccttcagctcaaaatttctgcagccccaagaataactgacattgtcttcccaccaaattacatgattattaacctcataccaaaaatcacatgtctacgcatattagactttgacccaattacacgagtgtacgtatattagactttgacccaattacacgagtgttttttcatgaaggctagctgcggttatttttccccttcttttgtttgtttttgcatcaccacgattttctgtattttttcctcctatatgattttggatttatgagggatgtgtggtgtcacgaggcaccacagacagcggacgggaaaccagccagttttttttatgggaagtactaccaggaaaccagcctagtagttactccatatattataacagagatgaaacaggtttcacaatattacagaagttgtaaccacagcttgttaccagttgatagtattcatcatttttttgtgagggataaccagccatccagccaagacgccaaacttaaaagaaaaaaatatataatctcttataactctccaagtgcaatagtgataattaagatagcaggctactacaaataaattagactccaagatacaagacaaaacttggtttggctattataataaacctccgaggagctgtcaagagaggaagataaaaacgaagggcagatagaactagtcagagagaccagccctgctcctcaagtgctccttgaagtccatgatatcaccttcccacctggtcaccgcctgcttctcgcacacccaaatctcttgagcaacctggttgataagcctgaagtcatgactcaccaggaccaaaccaccgtcccactcgttcagtgcctcagccagagaatcgatggtctcaatgtccagatggttcgtcggctcgtcaagcagcagcagttgaggctgcctgtaagccagccacgcaaagatgacgcggctcctctgcccatcagagagattcctcattggcatcacctgcgccttcccagacaggccaaacttaccaattgcagccctcatcttctcctcctcattcccagggtattccctcatcatgtactgtagggccggcatgtccaggtccagcttctctgcgagatgctgatgatactgcgcaattcgaaggtggttgtggcgcctgaccataccatctaatggagctaggtcacctgtcatgagcttcagaagagtactcttgcccgcaccattggggccaaccagtgcgattctagagtcaagatcaacaccaaagtcgagattcttgtagatgaggttatctggggtatacccgaatgagacttcaacaaactgcagcactggtggtggaagtttgccaacatctgtaaagcggaacaccagtaccttgtccctgacaaccttctcagtgagcccacctcgttccatcttagcaagagttttctctttgctctgagcttgacgagcaagctttgcagatccatggccaaaacgtgcaatgtactccttcattgaagcaatctgttcctgctcccatttgtactgcttcatttgattctcttcaagctcagaacgagtttgaacgtactggtcatagttaccagaatataacttgagcttcttgctctgcatatggatgatgttagtgcaaactccatttaggaaatcttgtgagtgtgatatgacaacaagtatacgatcaaacttctttagtgtctcttccagccagacacaagcctcaagatctgcaaacgaaagaggaaaaaacaattaacctacacaggcaaaaggttcaacaaaatagtatcgcaacaaaaagccaagaaaacccatggggatgcaatagcacatttttatcttgttcagacttttataagcaacgttctttccttgagctacactccaatgatgggtaggcttattatataagtgtcaaccagactatgggaggagagagtcaggtgtagaacaaatttaaggccaacaataagtaatcaggttataactgtgtgttcagaaaacaaaaggtatagcaacataggggccttttgtcccaactctcaattcatagaaccaggtaaaatctaactacaatatacagctatttaaaagatgttccgtttgtatcatcattaagtagggcacaaacatccttgcccatagccagcagccaataatttgacacatagatgtgtttaaaaaaactaaagcaatgtagaaaatgcctttttttcccactggaaataaaagatgaaatcgattctttatttccgtgtggacttagatttcctttagaagactcaccaagatggtttgttggctcatcaagcaaaaggatggttggattcataaacaaagctcttgccaaagcaatcctcatacgccaaccaccagaaaaatcctgagttttctttgcctgcatttgtttattaaagcccaaaccaaacaatatctcagcagcacgcttttcagcagtagatgcatcaagtgcttctaaccgctcatatatacgatccaaagcatcaccgccaccatcatcctgtaaatgtcagtaaagaaactgatgttacaagaccttaagtacccagttataacttgcaacaggaacaaagatgaaataccaatacagatatcaggggcacagatatagcaatatgaagcatttgaagagctggtcacctgagcagacaaaatttcagcttccttttccaacttcatcctctcttcgtcacaacagataacagcctgtagcgcagacatatctgaagcctcaatctcactggagagatggtaaatatccatgtgttcagggatagggagttccctgcagcctatggctgtgagcagagtagatttgccacagccatttaggccgagcaaaccgtaacgcctgtaggttaaataaataagacaagtgttagtgtgaatgaaggggctgtagcaggataatttttgtgattttaaagtgatgaatgggaaataaacgaacctcccatagttgagctccaactcagaatcaacaataaggtcatggccatgaaatgttaatgagagggactctatctgcaacaacatcgaatcgaaagattacgtttcagttagtttttgggggtgcaaataaaataaaagcaagaagtaaatatgaatgaagatgattatagtaagattacgtttaatttgtttatgtatatatgtatatgtatatgtatatatgtatatatatatatatgtatatgtgtatatgtatatatatacatatatatgtatatgtgtatatgtatatatatatacatatacatacatatatatatatatatatatatgtgtgtgtgtgtgtgtgtgtgtgtatcaacatggttattgtatcgatcccttagaaattggagcgcaaggatgtaggagtgcaagttggaagcaggagggatgatacatgggcatctgatctgagattctgagcggagcagcaaagcgcatcttattattacatcttataaagggggggaaagaaaaagaaactaggtattcccctccctcgtcaacacaacacgtacatctggtctaatcaaatctaatagggagcagtaagtaagaaggagggaggggggggacaagatccttacgtggatatcgcgggagagcggatgggaggcgaggactccggtgcaggtgcgatcggaaagcttaagcgcggcgataccgttggccgctttatcggcggcggaggaggaagaagatgaggaggaggagg

SEQ ID NO: 25961 - DNA, 3516 bp, Oryza sativa
  unsure (1)..(3516): unsure at all n locations
nnnnnnnnnnnnnnnnnnnnnnnnnnnnnnnnnnnnnnnnnnnnnnnnnnnnnnnnnnacgataaggtttggtctttcgaagttttaagacgacgagatagctatttaataaattttaagtaaaatcatactgaaaaatatatgattttgtttgggggctagccgcgcaattgcgcgggccacccagctaatttttttctaaaaatagctaatacttaattaatcatatgctaatggactgctccgttttacgaaagatgagttgctaacacccaccaacgaacactactcttatatatggatcgatggatgcgtcagtgcactgcatgcgtagtggagacatcggcggccgggtctttttaggtagtatacccgtaagtacgagtaattaaattaattagacatcgagatgcatatctttgatacgtcatgcgcactgatacatgtaatgtgatgaggaggggggaatcgaacaatcattttccaactttcaggtgttgttttggcatgcatttgcatgcgcccgtcgatatatccatcggttaatcgagaattgtgacgttacacggatgcatgattagtgaagcatcaaatcgatgaattgaatcttgtgtggtgtagaagtatagtacttaattttggcgtgcgagagcagcaatcctgataataatatcatgatctccgtcaggggtagagctactgctgtactaacctgtagaataaaggttattggttcgatgtcctccaaccgtctcactccttcatcataattgtatgggggaaggaaacccacccaccttagtgtggtgtgtactcctcatgggccacgacttttcatggcccacacccgacttcatttatgggccggcctgtctggacgacggcccatcacctacctatccatcttctcttgcagctgccctccccgttgccattcgatttatttgtaggtcttcatcactgccgcatgtacatatgtactccctccgtcccataatataatggattttaagtttttacttgtaacatttaaccactcgtcttatttaatttttttaaaaaaattattaattattttatttgtgacttactttattatgcacaagttttcattttttatatttataaaaaaaattaaataagactagtagtcaaacgttgcaagcaaaaactgaaaatcccttgtattgtgagacggagggagtactgtacttcatctagcaggagtacttacttgttggatgttaataactccatcgttttatctttattttttttcccattgcaggtgcagcgagcgaagaagcttaattgtacaggttagtacagcagtagctctacccctgacggagatcatgatattattatcaggattgctgctctcgcacgccaaaattaagtactatacttctacaccacacaagattcaattcatcgatttgatgcttcactaatcatgcatccgtgtaacgtcacaattctcgattaaccgatggatatatcgacgggcgcatgcaaatgcatgccaaaacaacacctgaaagttggaaaatgattgttcgattcccccctcctcatcacattacatgtatcagtgcgcatgacgtatcaaagatatgcatctcgatgtctaattaatttaattactcgtacttacgggtatactacctaaaaagacccggccgccgatgtctccactacgcatgcagtgcactgacgcatccatcgatccatatataagagtagtgttcgttggtgggtgttagcaactcatctttcgtaaaacggagcagtccattagcatatgattaattaagtattagctatttttagaaaaaaattagctgggtggcccgcgcaattgcgcggctagcccccaaacaaaatcatatattttccagtatgattttacgtaaatttattaaatagctatctcgtcgtcttaaaacttggaaagaccaaaccttatcgtccctctatttctaattatatagtttttaaaagtcacaccacatgctacctcttacttttgtcatatccttttttatttgcctactagatctatcactatttctattcattctccttgaaaccttaaaaaattagatattatagttttagagtttattctctcattgggtagtcccgtcaaacgctgccattatactcctctacgacatgtccacagtcttccctctttattgtcattaggattttaaaaatcgaacataattatcgttcggggtttattttttactttacagaagtcccgctaaaccgtcagcagctttgctattgtactcctttatggctcgcccactgcatcgcttctttattgtcattaacattttaaaatcaaatatgattatcattgttattttttttttgctttttagaagttccaaacctttaaaaattggacctttagtttttagagtttattgttttgttgggtttaatttcttataaattttagaagtcccgtcaaacgatgccactatacttctctacgactcatccgctgcctactctttattgtcattgggattctaaaaatcaaacataactatcattggaattcagtttttattttttaaagtcccaccaaccgtcggcggttttgcaactatactgctatacactccgcccgttgcttctcctttttattgtcattgagattttaaaagtcggatatgattatcaatggggtctattttttttactttctagaagtctcggcaaccgctttttatgtttgcttcacggcctacctgtcgccccaccttttaatatgtcgtatcaaccgccaccactctactcctttataggcctggtacttaatttatctcgtcatgtgttttagatggtcttttctttcaatagtctttattttttatcaccaattttagttatttataaatactattcctaactgaaatcttttttctttttctaatttcagaatttatttttttcatattttaattaataccgtatagttttcttttaatatttttattttttttacttttgaatttcagttgtttcaaaattgtattcttacatgaactctcttttaatttttctaactttggatattattttattttttatttaaaattttaattaatctcgtattgagtttcttatatggattcttctttcaatatcgcttatttttaattctgaattttagttaattttaaattgtattcttacttgaactcttcttttctttttgctaatttcggattttttttatttttattttgaatattaattaatctcgtgttgggttcctatatggattcttctatcaatataccttatttttaattccgaattttaattatttttaaattgtatttctacttggactcttcttttcttttataatttcggattttattttgtttttattctgaatttcgattaatctcgtatcgggttcttatatggactcatctttcaatttcagctatttttaaattgtatttctacttagactcttctttt

SEQ ID NO: 25962 - DNA, 3569 bp, Oryza sativa
cttaatggtcaggcataatcccaaaatagtgatgttaaagatattgctgttaaattatagaattctcttatgcaaatgcctattttctaatctgatcttatgccaagaatctttgatgttggtgttgtggtcaagtaaggggaaaaagtgtagcttgaacctcccgatctcagctatttctgacctctaaatttaggtaaaggccaactgaatgaagcaacaagtcgactacaaaattttccaggtcatttcagaaattatacattattcttagaacctttgttttatgtgaactggaactgttgaattgtacaaaatatattttgttttatggtgcctctagctaaatatggagcttaatttcctacacggagggatcactcacctccaccatatcggtacgataacattttgtagtaagatggttcatgtaatcttgtatttagatgtgcttgattttataattgtggaaagaactaatttgtagcttcaaatgcaattgcttcaggtacaacaaagcactgccattttataatctctttcgttgttcacatttcaggagttacatataagtattttcatttgagtataaaaatataataatgtgttgagatgatgattgtgtggtgactagctctgataattgataattttgtttatgctttatacaatgtgcgtttttttagcactgatcaacatgagattgttctactgaccagttaacttttttgcacgcttagtatttatgttgcattgtttatgccttggatgtaaatgcaacaatttgaaaaaaaacctatattgaaatacgtacgtaggaaatggctaccgcatttattaatgtcaaagcagatagttggagataaagaatcattttttatgacatggtttaagttatatatagctttcctcaaggatataattttaaatcatacctattgttggcaactttttgtgacaagtcgacaagcacgattgtaacacctaaatgccttgcggtgatatggagtcgccaaccacctcaatctagccaaagggccaaatcaagatgggttttgcaaaaagaaaagctaaaccggctagcggagccgatttatagatcaaaatcagcctctacgccgatttagatcgatacgaggataactacccgtctcgtgggcaaaacggaaggtttttaggacaaacctacaaagaggtgttgcactctcgcagcggcggcggacggtttacggcgcaaaccgataaagatggactaaaactagggtaaaatagaaaacatagtaaaagaactattcaagtaaattgtattcgggggttttacaatgaaccggtcttgtcccttaaataggggttggttttgccctctacaggcccttctccacgtccaactcgggatagaaaccaaaggaaacacgaaacatgcattcccgagcaaggaaacccaagacccgacgaaaacagactcggactcggaccctgacggtctgaccccccacatacctgcggtcagaccggccctactagctggtcagaccacccacacacctgtggtctgaccggccttatgaaggaaacccgtcactttccaaacaaattgtcttatcctccaactggtagtgtccaccatttgtggtggtgcttgagaggcaagttgatatctatcatcagatatcacgaagaagcaattcattgttcgaaatagacgacattgaacatggtcaaaagtgcaagttggtgggattgaatccattgggttagaatggcatgaaacttggacctcatgagaactatggacacttctggaacttcgacaacagctttggttgcccatgtactattgttcatgtatttaccatgttcatagcaattgattgaaaacaaggatcatcatttgagggtttttgtttatttattgttagatcctatggagttacaaaattatttatgcaaagttgattaattggattgttcaagattcaaatcttatggaatttattgtgtaaatttgtatgcaagaggaactggtgtccttataacaagcgcatatatattgctttaactggcaactggtgcacaggtttggttttgtggcatttgccatctttccatatgtgccaaagatatgcatcttgcccttctgttattttaatttttaggtttgtaaataaaattagttggttgggttaatgattgtgtgtaaactataggaaaaaagctacagatctttcttatcttttcattttctaaagcaatattaagcactatgttatgggcaaaagttatagcacctaaacattttagtatatatctataaaaaaaatctctaggtgcaatatgttcggtttagttcaaatattgatcacaacgtgcattgcatgtgcacgattacttgtggacttgtaaattggcagagtatttgtaatttggctcggctctgtataaatggaccgtataatatggatattgattttggctctgtgtttggactagaaatatacttggactgtaaatgtggatgggacggtatggtgtatattgtataattggtcatttggctataggtcaactcgtgtaataggactgtacatttataattgggactgtatgactggacgttgtatttgtggtgggacggtgtgacttggacagtgctttggaaatgggatttgtggtatgtatagatattccgagaatgcacgagggcagaataaatggattgcaacatgagactttgtttggatggatgcaccgtattgccaaataggagtttagggttaacgcacgataaatgaatttatcggttgttgtaggattattttgagagtgttcgtacaaacgaacgacggtagcgaagaaaggattttagggacaacgcgtagcatacaaatccaatcgtcgcggtaggaatagaatcggagataattgaattgacgcatgataaataaatacgccgatcgattgtagatagtcaagggagagtgttgggtttgaattgatggagtgattttaaataatcgctgggcgagagtttgagagagcaacaatatcgcgataggacaaaaaagttttgggtcattgatttatttagcatcgaagcacataacaaattagaccgcgaaggtaagagaaggtaaggatggaaaaagaaaggtataggaaagggtgtcctttctagagatagggtttaatcaaaatctatggcacaaattctaaacacacacaaataaacaataaatcctaacatgcaaactaggctatacctgagggaaaattagacgttgtgtgagaaggtcatatcttttgaaaatagcctattatgaattatattttgcaaatagggtttttaataaatactttactaatatatattattttgtaattaattttccgaaggcaaattccttttcaaaggttcgtataaaatagccatagctatgtttctttattaaaagggtatttatttcaatatactacccatagagggttttatccaaaacggtaacatgtatttatgtgtagctttattacaaaataattatgctgaaggggttctaatagagaagggtttt

SEQ ID NO: 25963 - DNA, 8261 bp, Oryza sativa
tatttattattatttactttgttagttaggtccaactccaatccctccccaactattttcagattcttattagctttgacattcttgtctagttcacctagtctacatatccaattgaactcaatttacatttcatcagacacagttattacagtatagaggtttgcttggaagatgcaccccttctgttcaaatggatcttccctttgagggtcagggaactatgatggcaaggcaaactgtttgttggagaaaccgcctacctctctcgtttattttacttcgttatgttagatcatgtatgtgccactctcgctccgcgagtcctttgtagctgttgtccacttttggtcatagccactatatttgagcgcgtaacttgggctatgcctactcatttgtccaacatcttgaatggtagactgacacattatgccttaggtgacatttctctttttttttttgcacaaaacatctcaaaagcactctctctctctctctctctctctctcgttctgcatgggatatattcgtcatttacttgcttgttgcaatctgcgtacagaatggacactctgaagaagcatctaccagtatcagtgcctgaggggttgaatgaacttcaaaagatagcagtgcgatttgaagagaaaatctatactgcagccaccagccaggtacacttagcctcttgctaactcatcgggttgatccaatctttcagttgtggggctcaagcatggcatttgggatcttagtagaagaaatcgatcgtccaatgtttgcaaatatgtctgttgattttgaagtttgttagagtttcgccgtgaagtatccacattttcttttgaaccgattgtaatatttcgcacttccacctaaatcagattatccaaggctgctgaagcttttccccttccattatcgggggaaaatctcctttgcgccttggatacagggactaagactgattcagtcctatgctagaggtgttgatgtccccacattattttcattgataacatatctcaatagtaaattagtattaatgaattatagaactaaacaatatttttaccatgagactggtttctctcattggccatgttaaaagtacaggagttgtaccttgagttctgtaagcccatcattccatctgttcatgcttgtataaatcacctgtaaaatattccctttatcccagatgaaacatcaaacaatggtttactccagtccttccttttgtgttagcgagtatgtcatcatatatcccacttcattttggtaaacatttttgtaggagcttctttggctgggtatagggattcataatctccaaattccaattgtgttctcctgttcatacttcatcaggcttattcatgccaaagtagtttgctgtatagataagaatttgtataatttaattgattgtataaaaaaacgaagcatatgtttcaattgtgctaaccaccaggacttagggtggcaagttatttattacaaagccaaatcttaccattgtattcttttgtatcaccagtctgattacttgcggaagatttctctaaaaatgctctctatggagacaaagactcaacagaatcctggaaacgcccaagtgattcaaaaccaaaatccccctggctcaggtatcatatgaagtatattcaatatccgattctgaaatactggagtaatagtaagatattcgctggtacccatattttgttcaccgtaaaagtccttgtatatatttttcatgatgtaactatattgcatgtgtgtttacaagccccatttctgagaggaaaccatccaatggaagctctgccacactgggtacaacagtgctctctcgttttagcttgtatcggataatgctcaagcaagtaaattaaggcgagatgcctgtcagtcgaaacctccaaacttgttgattactcgaacctaattaagtaattgctaatcttgatagcaaacacaccatttggatgctggccacgaatccttgcatggtcatattcaaagcttttgggcaccaacatcaaaacagacgaccccttcaatctgcttgttctagtagaggctagatcagccatggcttccaaagtagaaaagcaaagcaaggctcacaccatcacgtctgctgccagcagcccaaagaccaaagatacacatagctttctagcactcattctctctctttttaatcaaagattagtatcatagtctagcccattggcaatacacaatcacttcatcgatataacctctcgcactggatttcctctccctgacaactcggtagctctttgtttatgtatttagaaaatgggctatcaagttgtatggatttgtatgtacttgttgtccatcgttaagcttgcccaggctcaattggatccaccactggatggagttatatgtctaaaagttccctagctagtgtcagttttggtttacatatcttgtattattaacatatgctgtctagttatttgcatgtgcttcacttttttgaactgattagttgtccatgatctatacacaacctagatgtttaattgatgccatatgagtatgaaatgacacattttaaatgattgtcattttcccctgataagtgctaacacatgttatgttagttatttgcgtttgcttcttcacattatttatgctcatttttcttttgaagggggatgtctactttccataattcatgatctataatacctaaaggttcaattaatgccaatataccatgaataattgcacattatgaatcgttgcactgtttaatttattccccctgttaagtttcatgtaactttgctttatgttggagccagattacacttgtgtgactactgaggtaaaataatagttggctattttgagttattgatggaattatgtttattctccttctgctgcaacttgtcagaatttatttgcagtttccttcttagccttatcgaaaaactaattaatggttttttgtctaagctacttgctaacctcttacttgttttggtacatgtgtgttccttggaaaatgtagattctcgtctcaaatatgtctttatcatgcttatttggggtgttgttatgctttttacaattttgcaagtattgtctacaaggtatttatgcacattcacgatcttttctgcaacagtacctggactccctcaaggcagtaatccaacacagtcatcagcgatccctttgatgtctcagcaacaggcccggcagccaaattctacgtctgtccaatcttctcttactaatcttggtcagaacttgccaggtgtcaaccagacatccacactgcagaacatgtctggcatgccgcagaacactatgaataatggcttggcacaaggcgcttcacaagatatatatgctacgcaaaggcaaatggcaggaaggcagcagcagcagcaacaatctcagaaccaattaatttaccagcagcagcaaattatgatgaagcagaagttgcagcaaaattcacttatgcaacagcaatctttgttgcagccaacacagatgcaatcctcacaacagccaatgatgcaaataccatctagcctccaacccgggcagtccattccgcagacacaaccaatggtacagtcatcatctcagggtggtattcaacagaatgctttgaactcggtaccacaatctgtgcaatcgttactccagcaacctacacaatctgctatgaggcagcagcaacactcacagtcctccatgcatccacagccttctctgcagcaagctcaaccaactcagcagcctaacattcctttgcaacatcaattaatgggccagcagcaaaatttacaacaaaatcagttaattggtcagcagaatggtgctgtggatatgccacagcaacagagactaccagttcaatcgaataatcttttgaatatgcagcagacacagcagatgttgaaccagcagtctatgccctcgcaccagcagcaacaattgggctcccaggcaaatatttcaactctacaacagcagcagcaacaaaatcagcagcaacaacagcttcttggaactgtgcctaatgttccgaacattcaacgaatgcatatgctacaaacaaaggcagttcagcaaccacagcagcagcagcatgctcagcagtcatcactgggtttgatgcagcctcaatcacaacataaccaacttcagcaatcacagcagcatcttatgtcacaattccaagctcaacctaaccagctgcagcaacaactgggaatgccgcagcaacctcccatgcaacaaaggcttcaaacgtcagctggcatgctcttgcaacaaaataacattgatcaacaaaagcaatttatgcaggcacaaaggggccttcaagaagtttcgtctagcagtaagttctccatatgctgtctatatagttgcatttattcttttattgtttccccctgttttttcgctgtgttattgttcctttatccctctgttttatccctattcatactgacattagttttctcctacatttatgccagcttacaaatcctaaatttcattagttaacttaataaattggagatagtaaggataacatttgtcagttagagtctattgcaatgtacattgataacatgctgacgaagctgaccctaatgattttgtgccttctgttcaaatttgttttttctgagttgtggacatatttgccacaaaaggctattttcagattactgtttcaatctgacctcaagttcactgttgtatttttctagtaggaatcacacaaggtctcccacttctgtattacatcctatgttgtagtagcagcttgctacttgattgcttgttcattgacatgatgtttgatttccttgcttttcatgcagcatctgtggactccactgcccaaacaggtcatacaggtacaggtacaggagattggcaagaggaggcatatcaaatggtaatgcataccactaccgtttggcgctcgtttgttcacttggaccttcctaaagaaattcagagaaaaggacctctgaacattgtatttgatgtttagaataagatttggtcaaacttctaaaatactgaccataaataatttctcaaatgcttagtcttaaacaaaataaatggtataggtaaatttgcttcaaaaagtactatcataaaatcatatacttataaacttattctaatataaaattgatagtcgaaatctaaaaggtctgaccgaatcttgttgtgacatcaaatatttgaccggagagagtaatattctcccgctatcctttttcattgttgttttgatctgttttccaccaactaaacaataaacagttcccaattgattgcatgtccttttttctctcgagacatctggaacgaattcgacactgcatttttttttcagatctgtacaattttatgtgtaactcattttgttcttaatcttttaaccattgaagtatggtgaaatcaataattggacatgtgtagccaaagaaacaagaatgttatcttttactgataaaggtggaactgatattcatacaactatgcacatgcatgctttctttaagatagaggattctttgtgaatgtggactgtatagcatattgtatctagatgtgataaggttatgatgcagtttgtaatccctttctcttgaccttgcaagttcaatcaacaccatgttttctactggttattatagttttttctttaagttccctatgcatgtaataactattcgaacaatctttgcctgcaccatatctgttagttaaacaacaggccttggtttactgaatgatttcttttctgtagtatccatcccttcatagcttttgtgtttttctttcttgtgatcacaggtgaagaacttaaaggaccaatattttcctgaattaaatgatttgtacaataagatctctttgaagctacagcatgttgacaacatggttccacctcaaaagccaacagaacagtatgaaaagatgaagaatttcaaactgatgttggagcgtacaatgcatgttctgcaattgaacaagggcaacattcagcctgcccttagggacaaaattcctgcgtacgagaggcaaattatcagtatcctaaattcgcaaaagaggccaagggtgcaaggccagcagacacaatttcaacaatctgctgggcaaggtcctacctctaacattccgcaacaacaacaaccttcccaaggtttgcagcagcatgataaccatactaatcagatgcctcaagcaagcatgccaagtatgagcaccggattacaatcctcaggtgcagctggtatccaacatttacctgcatccccagcaacaaactttggtgttccagcaacacagcaaaatgtcacaaatgcaccacaggctacctctaatttggaggttactcaaggaagcaattttaattctttgcagcatggttcaatgagtggtgctttgcaacagggaagcactgggcccatgcagggtacactgaatgcacaacagcaggccagtagtagcatgttatctcacaactcagtaggtacaatgcaggctaatgccaattccatgcaagccaacgcaaattcattacagcagctgaagcagcaacagcaggagcatcatatgatgcagaatcagcaaatgaagcgtcaaatgtttcagcagttccagcaaaaacaaatgcttcagcagcaactcccagcacagcaacaattacagaaacagcagcaatcacagatgcaggttccacagcatcattctggaaatgatgcaaacgagctgaaggttagacaaggagctgcaatgaaacctgggatttatcaacagcacttggctcagcgcaataacttttataatcagcaaatgaaacagggcagtgctttcccaatttcgtcaccacaaaacctccaagcatcatccccccaaatttcacaccattctcctcaggttgatcagcacaatctcttgccgtctcaagtgaagaccgggacaccattgcagtcagctaactcaccatatatgccatctccatcgccacctgttgccccgtctcctataccagtggattcagagaaaccactctccaatttatcatcatcacttactaatactggtcaggctacacatcagcaaacaaacatggcgcctcagtcacaatcaatcgccgttaacactccagggatctcggcctcacccttgttggcagaatttacaagtgttgatggaaatcaggctaacatgccaacccaagttctaaccaaatcaagtgcagcagaaaggcctttagaccgcttacttaaagcggtcagtaactttgccaactttttatttactgtcttttcttcgtttctgtagtgcaaaataaatttattatttaatcagtgctattctgagtatattttaaagcgtaattaactatggcataaagaacacagtaggctcagctaaaatatttagttcaggagttatatatgccatgccttttgcttgtaacctcgtgcacctaccttgctaaagttaatacaaacattaccctgtttcaatcaactagtttatcaaacgataactaaaatgatgcccaaaggttgcagcagatctcagataagtatatcgtaaattctgaacttgataattatgtcaaaaagggatactatgctaaaatcccagtcacatgcacatatgcgtgtgctaagggattatgcaaataacacacatgttagatctgtacacaaatattttgaagtcaaggggatgcaaagcatgggagtcatcatgcctggtcatttcatgttactgcttatttaaagttgactctttgagtcttgacatctgaagaacttgataggtttagcattgacctattttatttatttctcttcactattgctctgtggaatctagctatgttttccggatagcctgttttgctgctgtgctaaaagagaagaaatcattaataccttttattcccctcaaattagcttccttaaacaaattttgatcatatagaaggcatataccctccctttagattgaaattgaggatttaccttcctgtccctttttttttcttgcatgattcatgtcccttgtgttctgtatggcagttgcggacaacacaacgccagtccttgagtgctgcagtaagcgacataggttctgttgtcagcatgattgacaggattgctgggtctgcgcctggtaatggttctagagct

SEQ ID NO: 25964 - DNA, 4973 bp, Oryza sativa
catttcatgttactgcttatttaaagttgactctttgagtcttgacatctgaagaacttgataggtttagcattgacctattttatttatttctcttcactattgctctgtggaatctagctatgttttccggatagcctgttttgctgctgtgctaaaagagaagaaatcattaataccttttattcccctcaaattagcttccttaaacaaattttgatcatatagaaggcatataccctccctttagattgaaattgaggatttaccttcctgtccctttttttttcttgcatgattcatgtcccttgtgttctgtatggcagttgcggacaacacaacgccagtccttgagtgctgcagtaagcgacataggttctgttgtcagcatgattgacaggattgctgggtctgcgcctggtaatggttctagagctgctgttggtgaagatttagttgctatgacaaagtgccgattgcaagccaggaatttcataacacatgatgggaccggtacatcaaagaaaatgaagcgtgacactagtgctatgcctcttaatgtgtcatcagctggaagtgttaatgacagtttgaagcaaacattcagcataggtacccctgaattgcagtcaactgcaacctcacgtgtaaagtggcaaaaaaccgaggtatgctctttattatttcatagggatcaatacattatatgcctcagtgatcagcttcacaatcgtttgtatagatgaaacttagtggcatgatgaataaactaaaatatcatgattatccagctgttttgtttccacaatgacttccattacatatatgggcccagagaagggaagtatagttaaattgacgggagctattctaaatttttggctacctttattatttatcttgtctctggtgcacctgcagataaaccatgctcttatggaggaaatacatgagataaaccaacagctcatagatacagagctccatgtttgcgaggatgatgctgagtcttttggtgctacatcagaagggacagaagggacagtcatcaaatgcacatttactgctgtggctgttagccccagcttgaagtccatgtttgcatcagcacagatggtaagcttctcaaagcatgatctgtggtatcggcttttattgttcgctgatgttccatgttaaaaatgtgtggcagagtccaattttgccattgagggtgcttgtccccgctagctaccctaagtgctccccggttctcctagacaagttcccagatgaacaaaggtcagtatccaatgttttatcagattctacgccaggtactacatattaggctgtcctgattctctgtacataaataaactaaggatgttgcattgtgcttgtgaatctgctatagaaactcggatgacctgtcgaccaaagcgaggtcgaagttcagcatattgcttcggggtttagctgagcccatgtcactaagagaaattgcgaggacgtgggacgcgtgtgcccgcaaagtaattgctgagtatgctcaacagactggtggaggcagtttcagttcgagctatggttgttgggaaaattgcgtgggtgcttaatccccattcttcttcagtcctgctggcaccaatcttcgttttgcatcgatattgtgcgatcgcttgcacgcccttaactggaacggttaatgcatcgctctataaatatatgcacataaatatatgtaaccataattaacattttagcaaacatgcaattgctactggtgtgtacttatttattatgtgtggttgtacttttggaaatcctccctgtttactagctggatttggtagcggcccctcttgtacagaacagtctacatctccagcctggtttgattctaatataaatatactgtgagatcgctgctcgtaatatatgttgtgtattgacaacagttgaaggacgtgtgattttctgagatgtgctgagaccagtttcgtcggacgttttctcttttcttgtgtgttcttttcatatgcggaatggcggtaatcaatgagcatgtacagaatataagaagatcaagctagggaagtatttgacatttttagcttggttgctaagggtgtgtttagttcccgctaaaattgaaagtttaattgaaattggaacgatgtgacggaaaagttggaagttttatgtgtgtaggaaagttttggttcgatggaaaagttagaagtttaaagaaaaagttgggaactaaaccagacctaagtatgatcgcgagagcaagtgacattcacttggttcagttacggaaaattttatccaatttgggacttgtaattcagattgtgtttctgcctgcaaggagtgccagcgctcattatgttatagcacacggtgacgttacaacaggtaatcgtttgatcaggtacagtacagtacagagagggcgtgttaacaggtccagtactggttgcataaaacatataatggtaacaatagtatatatgtaggtctagatggggatacaataatggtaacaatactagaggtggagaagaagcatttccttggctacgaaatgtgatgacatgatggatcttggatttgatgttgggtacaacaggcacctgcgactgagagatgagaaggaacaacatgtaaacgcacagtaatatgtactgtaagcatgatacttgtacgctaaattaattaagctgagatgacagatacaagaaaatgagctaagtactctaggagacatgtatggtagtaacaaggcaaaccagctgctattagttgttaagcttagcttggccggagaaaactgcatatatgtagtgtaggtcctagcaattgcactgcgattgtgcggaggtgtagtacgtagtagtagggtagagagttgatggagtaatttttattaattggcacacagtaattcagtaatcgttggatcgagtagctatagtaatactagaaattgaatggatcgattcattcgatgtgaagtaagatacttactggggaggggaggggaggggaggggagaggagaggagaggagaggaggtcaggcgaggtcttggtcgtcgaagtcgtcggggaaggaattgaagaagtcggcatcgatgggaagggaggaggagggcgggtggcggtcgtcggcgtcgacctccatcatgcccatgcccacggcggaggcggcctccgactccatctcccccggtgagtcctcccactcgttcacgccgcccggcgagctcatctcgatgactcgattaatccaaccacttttggaatcttggattggatgattggatttccgatccccaatctcctcctcctcgctttgcctcctccacttcaacaacgacttgtagttgtaggtagggagggagggtacaccacagcagaggccaccagccggcgtcggcatccaactccaaatgcttttcttcctttctggcctttgtgtgtccaatattaattgctagtggactcgactagacgtgaggcccatttgttggcaagtttcttcccttgtctctctcttgtgagacgaatcttttaaacctaattgctacatgatctgataatatggtgctatatttaatatttactaatgacagattaattagacttaataaatttatctcatggtttactgatggattctataattagtttttttattagtgtccgaacaccccatacgacacgctatataatattcgctgcgacacgccaaaactttatgactctggatttgaacaccacctaagttgcctcttactcctagtattaatatccaaaatactgtatcaaacacaccaaataagcaagtggatggtggtggtggtggggcatcggagacatacagtacacgtgcatttccccaaggagaaaaggagggcagagatggagtgagtggctttgacttacgacgatatagcactagcagtactcgtactcctaaatttgtgttggtttgttggactatctatgtgtgtagtgcatgtgcgcgtgcaagccgcatttttgaaaggaattaatgtgtttttctataaaaagaaaaggagaaaagaaagaatgaagttgctttaattgatgaagttgtcttgtggggtagcagcactttgaagtggtcgctgttcccattggtgtatgtcggtcggagcggaagacaatgcttgatggccatgtgacagtagagtatataagatgccagtcgtaagatgttactactcgtacgtagacacacggagtatggcaagcaatgcaaaaatgtccattggttagcaagactagtgctagtgtagtatagtctgtggaggagtattgacacccctttattatttgcattgcactactcacactcagcaagcattgtctttcacttgagtagtactaggagtggtgctcacttgcacactatttcactccactgctccagtccacagtccagtgtgttcacctgctctaccccaagcccaagggaattgaagcaagcagatgagatgagatctgtgatgatgtgctgcctcctcctcctcctggtctctgccgctgccggggccgaaggcaagtcggaggtggcgctcctcctggagcgcgtgaagccggcgctgcagggggagggcgaagtaggagggaacgcgcagctggccacctggaccgcctccaccccgctctgccagtggcgcggcctccgctggtccaccgccgccaccctcccccgcgagctcccctgcggcaacctctctgcaggcctcgcccaccacccggtcccggacgacctcctcctcctcctctccatccgcctcccggcctccgccctcgccggccacctccctcccgaactcgccgctttctccgccctcgcctccatcttcctcgcccacaactccctctccgggcccatccccctcgccctcgcaacgcccccgccctctccctcctcgacctcgcctccaaccgcct

SEQ ID NO: 25965 - DNA, 3227 bp, Oryza sativa
  unsure (1)..(3227): unsure at all n locations
cgtgcagtgcagtgcaggcgtccagcactccagctacataatcctacgtactactactagtagtagctgctcctacgtactccgtactctactgtacggagtactactagtagattttccttttctcaacgcctgtctgcctgcccaaatattaatcctctcttcctaaaaacatgactccagtcccctacaaaaggatgatcactgcactgatttggatatctgggcaaacacagccttttgcccatttgcattgcatatgcttggtttcattagttttaggtcctgtttagttcgcgaaaagaaaatttttaagcgtcatatcggatatttaaccggatgtcggaaggggttttcggacacgaataaaaaaactaatttcataattcgtctggaaaccgcaagacgaatcttttgaacctaattaatccgtcattagcacatatgggttattgtagcacttatggctcaaaagattcgtctcgcgatttccccctaactatgcaattagtttttttaatctctatacatatgtctaaatattttatgtgatgttttttttgaaaaaaaaatggaaactaaaccaggccttataatgaaatatagtagtatgtcaggtccttcaaattacattctggtatttgatcgtatacgactatctatgtgatgctccacgttagcacacattttacatacgcctcctggatagggggtgaaaacggtacagaaacggacggaaaccatctttatcgttttcgttttcatattttttttcggaatcagaatcagaatcagaaaccccggatatgaaaatagaattgaatattatcgaaactgaaaacgaagcaaaaacggcgcgaatacggtaacgaaaatttatcagaataaaaaacccctcaaactgataaatccaattgaataaattatctatgtttaaaagagtaatgttgttgataaatcccaatgtaggacaaaaaatattcttatgtaattttagatttgcataacaaatatttttttaaaaaaaacagccaaacaccatggtattcactatttagtgcttaaaaaagaatcatggtatttcagtcacaacatttctggtaattctgagaaaattttctgaaatttcgagaaaatttccgaaaagttttcgaccgattccgagttccgacggaaattgcccttatcatttccgatttcatttctgagaaaatattttcgaattcgtttccgattccgaaaaattccgaccgacagattctgttttcgaaaataggtccgaaatccagaaagtttccgtaccgttttcacccctacccctggatctcgcacttccgcagcatatacaaatgcatttccctccttcccgctgcaagatgtaccccagtactccctccgtctcctaatacaatggattttgacattttgcttacactgtttgaccatgcatcctacacaaaaaatcttgaggatccattatttaatttatttgtgacttactttattatccaaagtactttaagcacaacttttcgtttttcatatttgcacaaaatttttgaataagacgagtggtcaaacagtgcaagcaaaatgtcaaaattccttatattaggggttggatggagtactaacaaagccaaacacaaggtcctaggactgctaattgcttgtccctccatcctattttgatcatcctcttaaaattttaagatgtcttcccaaaatgatcatcatcctaacatgtatatctttgtttatttgtgtaaggaattaatgtgcatctttaaatgtgttgcatacaaccaaacaagattaatttctgttgatgtaatgacatacaatatttaaaacatgagctattcacagtatactaagcgatgaagcatcttaactgatgggaattaatctgagaataatgaatgttttggccgtgtcgttggccttggtaccctttgcttgggtgtgtttggttctaagactaggtgggatgggatgaaaccatccctgattttgaggctgggatgattccactcgcgtgtttggtttgtagaataggacgatcccatttttttgtttggttgaagggatgagggagggatgggatggacgctgtttgccaccaatggcgacgccgtttgcaacaaccatagccgccgccgcctctgccctcacctccatctctgccaccgaggtgcgccatgccgccggacaggaggaagctactggtctggggcaccgacaggccggcgcggtcgcgaagggacgcaatgcggcgggtgatggcctcggccttcgcgcagagcagctgtggcttggcgacgacgacggtggcgaggtccgcacgggagagggagagggacaggccggcgcggtcgcggagggacgcgatgcggcggctgatggcgtcgtccttcgcgcagagcacccgcggctcggcgacgacgacggcagcgaggtccgcacataggccggtggagaggagggcgagcacggcatcagggttggagcacggagttgaggcgggagagcttcggggacgacgacggacggtcgggccgcctccggatccgtcggcgcagccctccccatcgtcggatccgccgccgccgccttccccaccacaggatccggtgccgctgagccccccgacgccgccgctgccgagcctgtcgccaccgccgtcgcctgagccgtcttccggatccgttggcgcagccctcccaattgtcggatccaccgccgccgcgttccccaccataggatccggagtcgccgagccagtcgacgccgccgctgccgagcctgccgcctacctccgtcgcccgagcctgtcgccactgccgttgccgagcctgtcgcgccgccttagacaagcccgccactgtcgcccaagctgtcttccgccgccatctcctaagggtgagcagggcaagcgcacgagctggcgtcgtcacgccgttcgctcattccaggtgggacgagtttgtccgccagttttggccggattagttggtcccggatctgataggaatattcctctataggggccaacccatcccactcacccctaaaccaaatactcctaaaagtacgttcatcccatcccatcccatcccatctcagcaaccaaacataggggatgattaaaatggaattggggagtactnnnnnnnnnnnnnnnnnnnnnnnnnnnnnnnnnnnnnnnnnnnnnnnnnnnnttttta

SEQ ID NO: 25966 - DNA, 3897 bp, Oryza sativa
  unsure (1)..(3897): unsure at all n locations
nnnnnnnnnnnnnnnnnnnnnnnnnnnnnnnnnnnnnnnnnnnnnnnnnnnnnnnagtataagtttgattttttatgggacggaggaagtattacataactgcagtttgatcgcagcaattgtactgatgtggtacaaggaggttccatgcatatgagtagggatggcaacggggctgcacccgtcgggtttcactaccccgtccctgcccccgaggtgatgaaattcccccgttcgccatccccatccccgtgctcgggggaaggtttctcaccgtccccgtccccgcagcgggtacggggcacccgcgggtcctagcacccaacaaacaaacaccaatatacatagaacaattgagcaggaacagatgataaagagtttacaaatacagttcacaccaatgaaaggaagcaagggtgaagaacttcaaaatccaatgtagatgtacaatagaaacagaaacttgatgcaccagtgaatacgagtggcgcacacactaaagcaatagataagtactacatgttgatgctttaaaatcagatcgagttaatgccgtgcaggtagcttgcgtctcacgacggcatcatcactcctggtcagcaagagcggagaaaatgagggcgacgccgctgtgagtcactgggggtggaggtggagcaggagagggcgccgccgcggggagccaaggccgccatggctccagtcacaaactgacgacggcgctgcaatagcgatggcaaagaggcgggctagaccggcgaactagtgaaaatagaggaaaggggatcggcgaatctagaaaaatgcgaaggggatcgggacttctctccgtgcgagtgcgaccatgcctgcgagcggcggccaagaggaagtggggacgggattgaaaagttagggtttctctatatatattgcttctaattgggcctaaatggactgtaacctaaggaatttgctgatgggccgtcatatcttggagccccatggggatacggggccggggagtggtggaacggccccgcccccggcccacccgatggggcctgcttttggccatttgttaccccgtgggggatgaatttaccccgatagctcaccctaatagaggaattccccaccggagaacggggaacggggccccattgccatccctagctgtctgtaaacttgcagccgcttctcatctctctcctctcctctctcatccacctcagcattcagccttcttatagccatctattatacttgctcttagtgataaaatatagggtagtactacttctgcaatatagggtaactatagtgagatcaactctaatagagttgctagatagctttattccaagttaaatttcagcaattttgatcaaaatacaagctccaacccagatggcttgtatggctagcctggatactagccaaatttggccatgctatttggttggccattttgtgggccccaccatgaatctctcctcatccccctctctctcccgcatctttcccgttgtggcctccccattcatcgctatcgccgacatctgtcgtcgcctttaccaccatccttcgtgtcttccccatcatcgtcttccccgcccctgaaggggttgtgcccgcgtgtccgagtccatcgacaacggcagtgtgccggtccctacgctaccccctccgacggtagttgaggatcttgtcgccctactgggcttccaagcgctcccctctctttccctatcctcctgaaccacctcccatgcttgcctccattgtcgttgcctcatccgacgctgcccccttggtcgcgcattcaaggccgcgccgatggagcaggcgagacactacacgggactggtgcaatcgctcgtcgcccgcggtggtgaacaacgcactctacaacctcgtgggcacctaccccaagagccgtgcgccttatcaccgtcgacgtcgcttcccgcgcaccgatgggtgggtggggaaaacaagagagaagaagagaggtgctgagaaactgacatgcgaagctagtaaaatttgaagagtggtagatagagagactattggatctaacaacaaatatggagaggattctttttggatagcttcccaaatggacaaatagagagtaagatttgccactatgttggagatgttttgataaagtacatatgtagtactataagtgtagtgtggttgaaatcaaattcgcattaggttcttcttgtcaatttctatggattactgtgtgtactatctattttcttatatacaagttgcattgggtacatcatacattgagtgtctttgaatggtgaatttgtaagcatcaacagtagtccagcagagcttgatatgtgaaaaggatttaagattcataactaaatgaacaaaaagtatgctaagatggacacataaatcacgttgaagctaactaatgccgaaatatctaagaggctacactacttaaaaaagggccaaaggtgtcggttcctaacaggccataggtgccgatttttcatccggcaccaattggtcggcaccaatactagcaaccgacacctatatggaaaatagaaccggcacctttagcattgctcaggccaaaaaaaaaagagccagctcgaatccaagccgaacttacccagtgccgtcaccgcgcatgcgcccatctcaaaatcaaattgatatccccaaacccaaaatcatccacaaatcgtcaccaaaataaactgacatcacaacaaattcacaaaataaaacatcaacaaaaattatagctagatggatccatgtcgatctgaagagaagaaaaagagatcgatggcggtggcggcgagagtagtggaggaggatccagatctagagaagaggggagggcgccgccgcaacctgtcgcccgtcgtctctcctcttgcgccgctacctgctgcgtcccttcccgccggatccagcggaggggatggtgccgccgcagcccgttgcccaccgcctgctgcctcccctcccaccgtatccggtggaggggagggtgccgctgccacccgttgcctaccggctcccctctagccaccgccgcttgcgcgagaagtgagagagccgagtgagaggagagagagagagagagccgagcagagagatggagagagagatagcagataaggttgactcatatagggaaaggccaatgcgtcgccgcgtcgggctagatcggctcggcggctcaactcggttttctataatttattataggtgccggtttttacgtaaccgacacatgtagcatatcaaaggtgccgggtttttttaaaaaaccggcacctatactatatgtgtcggtttttctttagaaccgacacctatagtttcttaaaggtgccggttttttgtattttcagtccgtggaggaggaaaaatcactataggtgctggttttagctgttccagtacctgtagtgccgatctctatgggcttttttatagtagtgctaccagaatttggctctccaaatacccttatagtgagccaattcattgagcaagtttggccaacacatatagtcgattagtcagcctgccaaggacatgatgtatacctaaaattctttttttttacaaaaagttatatgccataggaaaaaggaaggaaaaaagagactgtgttcaacccagaagtcttcctagctacctccctcctccgatgccctaaaacccgatttgataacattttcatcccttcacattttttttgaactttcacagggggagagcttccccacctgaatttcattagcaaaggtttgttaaaggggattagattacattagactaggtgaaaccccgcgcattgnnnnnnnnnnnnnnnnnnnnnnnnnnnnnnnnnnnnnnnnnnnnnnnnnnnnnnnn

SEQ ID NO: 25967 - DNA, 8761 bp, Oryza sativa
  unsure (1)..(8761): unsure at all n locations
cccgcccccggcccaccgaagggggcttgcttttgaccgtttgttaccccgtgggggatgaatttaccccgatagctcaccctaatagaggaattccccaccgatgaacggggaacggggccattgccatccctacatatgagcatgaaaaaaagcagacgcaacacgcaagcggacgccgacactcaagatcagacacgacgtgccatattcagcacggcaccactgccaccacacgaccttacccaacccaacaccaccatttcaccattgcactgcacgggggcacggccgatcgaaaggacaaacgagttttcctttcccaaactattactagtactacagtataaaggtgcctctttaaatcgcataaatgataataagataataagtgtgaaataaaatattacaaaatatacgaaaaatataggaaaaaatataggaatggttgtttgattgaccagcgaaaagaacataaaaatcgaataagagagataaagtcaaaagaaaatttttaaaaggttggagtttttttaaagtttcctcaaaatctctttttattgtccattcaatagaaattttaaattgtatgataggatttaatccattgttttaaaggtcttcacacaaaaattttttataggattaaaaatcctttaaaatttctatgttttcctacaaatcaaagggtccataaaggttggatctacttatgggtccataaaggttggatctacttatggcctatttgttttggaggaatttaaacatataagaatagaaaatgtgaaagaacaggaattcgtaggaattttcccagaggtttgggtggatgaaatttttcatatgctttctctctacatctaataggaatgaaaatttttcttctatttttctatacctatatgcctacaagccgaatgatactaatatgaattaattcttagaaatccaactttttttcgtccaaaccaattttttttgtttcccttatcggtcagcacttacttttcctttttttttgaatttttcttcaaggaaaatgggcttttctctctttgatcctccagaggagagaaaacgtgcattttaacttcctccagtgcaatttacatttaggtcttatctttcaaccataaaatctggtttatcgtttctttcaactatcaaaatattattttgcctctgcaaacgtttttgaaggtgattttgtccaatgtggcacattcgtaacatcttgatatagtcttcatccnaatatggcgtataagtggcaatacagccaaagaaaaataaaaaaaataatgcgacccacatgtcagtggcataaccgttcctctctttatatcgcctttcatcagacaaaaccgttaactatattgacttataagcgccatgtatgataaaactatcttcaaaaccattcgaggaggcaaaatactggttttcataattgaagcaggtgataggttgagggatgcgaactaaattcggttatatttgagggagtgaatatggacgttttcctccagataaagttgcccaagtggaaaaagtacaccgaaagtccctcaacttgtcatcctcaacttgtcatcgagttacaaaatcgtcccccaattgcaaaaccaaatatatgacttccctcaacttacaaaactgttaacttttagatccttcagtggttttgaccccattttgtctgacatggcggctgagtcagcgcgggatccatgtggccccacatgtcagggtgtccacgccaacaccatctctctttcctctattctctcccttctctctgtctcacttctctgcacaggctggccgatgggtggggaggaggcctgcagggtgaggcaggagaggagggtgcgaggcgaggcgggactgccgccgctagggaaggagccgccaccgcaccagaaaggcggccatagcaagtgaagcagcggcggcggcgacgagcgagcgtaggggcggagcagcggcgtcggcgggcaagcgcggtgacggagaggcgccggtggcaggcggctgcggattgggagcgacggcgccgatgactccgcgccgctcggcctcgtcgtcatcggcggctccaggcgcatgcagagcagaaaggcggggggcgcgaacgggcgatcggtggcagggatagggctaatgggaggggccccgagtcgtcatcgtgctccgcatcgccgaccgtcgcccgtcacgcttgccctcctctcaaccgcgctcctccctcgccggcgcgcccaccgtgccagcactcctcccctaccagccgtgctccttgagagaaaaaatgtgtgtgtgtgtgtgtgtgtgtgtgtgagagagagagagagagggaaagggagagtgtgctgccttggcatcccaacacatggggcacatgttggtctcacgctgacttagccgtcacgtcggataaaaccggggtcaaaaccacataaggacttaaaatgaatggttttgtgagttgagggatgccatattatcttgttttatggttggggatgattttgtatcttagatgacaagttgagggaccttcggtgtacttttgtgctgcccaagtctaggtctaagtggctgccgtcgtgcattacttcatcatgggcctgatgggcttcccattgttgtcacaagacaagagtgttatgtactggactatgtagttgggctttattacttggtcattcgactccttcgtcttcctgcgcccctcttctccgggtctagggtttgctgctccccctccccgccgccgccgcctccgcctccgccgctcagatgggaggcaagtgcccgcaccgcaaggtcaagaagcgccgcctctcgcacaagacggcccgccgaggcaagttcctcgtcaaggccgacgacgccgtctacgacgagctggtcaagctcgccgacgccggcaaggacgccgacgctacccagctccccgtcgacgaggacctccccggtatgggacagttctactgcctccactgcgagtatgtgccccctctctactgtccctgctctgccccccctttatatcgaatctccaactaggaatacgcctttgcttcctgcaacgaactctctctctatatatatatatattgacgaacatttacacgtctaatataaccactgattctcgtagtttgcacgctgcctttaattgaattgaactgtaactcctgtgataaaccaataatttagtctcgttgattcttgcaatgcctgcaacccttatcaatcaaataatatgttcaactctcgccgtttatttctgataccaatcatataatgcatgcttgctatgttggttgtcgcctgcagtcgctactttgcaagtgagagtgtcaaggaggagcactaccgctcaaagcgccacaagaaaaggtgatcgccttgtccttgctacttttaaatctctcttctaagaagaatacatattggtaacctgccacattccagcatcacagacccttactgcactgcatgtcatggagctaatatatattatatggtgtcatgacattgtagggtgtcaatatatattacctccatcatggttactgaaaacatactaacttcttaaattttatggtcacaagcatctctattccttattgcatttcatgacattggagctaaacagaaaaaatattctgctctaggttgtcttctacagttttgacgagatagtactttgtttcaataatgtatacatgcacacgttttgttgttcagcaacaaatttttgttgtttggtaaacgcaattgcctagagcatataatgtaacaagctgcaagtaccaacttttgacaaattttacagaagacgaaagtccttttgttttggatgcagctagtacatatcatttatatccgtgtagctagatggtcttcagttctataactttgagcttgaaagttaaaacaccagcgtaataattatgtggtatagaaaaggtctctgttgtggtactactatgcagcttaatctactgaagttgttcaatctacttcgctgtacctatctattactccttcggtttcaaaatatttgttttgttaggacaagactttgactaacaattactctattaggatataatgttttgtgacacaattaaatttattagatccgtattcaaaagtacttataattacatcgtatatatcactacatcagtgtagatagttggtcttcagctctgtaactttgagcttgaaagttaaaatactagttaattatcccctccggttccataattcttgacgttttgaacaatgacacagtctccaaaatatatcctagactatgattttctattataatatatacactaaataaatacatttttacttttattatagtaattttaagaaaaatctatatatgttgttctaggggctttaaaccaaatattattaaagttataaaagcttgacctcagccttacacaaaacatcaagaattatgaaaccagagggagtatgtgctacagaaacatttctttctttgtgcaaagtgatacggttcaatctactatgctatatctaataatgactttgcgatacttgtaggatcaagcaaatgtcagggccagccccacatactcaacttgatgcagagcttgctgctggaatggggatgcctgacaatggcctgaagctcatgtccatgtgaacctcttcttgttcctggtttttactcatatgtttttgtcactgccgtacgtatgtacttgctctgcttagtagttaatggagttgacttgatggtgtctgttggtccaagaatttacttttaagaagccaagggttactctgttttgcctgcctcattttgtctcgcttctgattgaatatcagttacctcagtcagtgcttgggatcaaaacgtcttatcggtttattggcattggcttgagcacaagctaccaaaggcaaggggcgttgatggatgcgctttgcctcacatgctatggctgccttatgcctgtagggactaccagcaatgagcattgtatggcataggtaaactacatataggcccagagtattggccacataaatatagattgtgcctttacaggtgtgttgatctgtttttcacgccccatatgatcttttgcacattctggatctacccttccatgacctggtcatgtctccccactgagtctctgggccatgttgatggtgtcgtctggggctttatgcagctgtaatatgcattttagcatgtattagttgcaccgtcacgtgttactggcaactactagtagtgtgttttggtttggtgtaaggacgagttgaaaaggaataggcggtgccatattaatcaatagggctgtcaatgttgacaaatgttcctccttatctaatctacttgttgatcgcaagtgcgtgatggtcacctgacctgggctgttggcttgttggaatggaagtctgcattgcatagaaagggcgagaaggtgaatgatggagatgaaatgagtagaaagatgcctttgatgatgcagcttttgtcataatagcagctatagaggacatagcgatgcaatgcacgcacgctccttgtttgtgtgcgggcgtcaagatgcatatactacttactactgtactctactatgctgggtgttggacatgcatgcatgcatgccggggggccaagctaagctagcgaaatcaattggtttgcatcatcgccagttgtgcaattgtcctgcctatactccttatctttctttcactttcatgctcccaatcatgtctgtaataaagtactacacgtagtaggagtaataagttataagtgccagaatgaagccccatgagctgactcccccgtctcccttcccctggtgattggcgatgagttggattggatttggatctccagaatccatccagatgctgaaaagaaaattaagagcaaggggccaaaacctgtcacgcgctcgctcaaccccaccacaacaccatccatgctcatcatcttgttgtgcagttgctgctcttgttctccaatcgacacaaacacaacacatgccagccgcccgcccgggccggctgtggattgtggaagagagaaaaaggactaatgattccatggctgtcctttcggatcgaggcgccctggatgattagcagcagcaggggcaggagcatggcaatctatctttgatgccaagcaaagcaatggctggctgatatactaccactcactgatccagttgcagtttgtttagggtgtgccacttgtttcagatctctcttttgccttgtttctggcagcatccacaagctcgccttgcgccaattgacatggccaaccccacaaagactagggtggtgacttgagctccttcgcccacacttgtgctcattgctcgtcagaccagatacacaaacacgcgccctgctctactactggagtactactactccagtactggtagtacagtagtacagacacacacactgacactggccctgctgatggtagtggtagtggcagtgttaggtaccccatcgcagaaagagaagaggagactcgccatggactcacctctacagaggagaggtgtaggagtagagcagtgtcagtgtagtatggggcacatgagttttcgacagcactaaatatggtggcttagatttgacagtgccatttggatttggttcatccatgaaatagaaatagaagaggcccccatactgctttgtccgtccggaggggagggggagggaccatgcagcgagcgagcgagcgagcagtcggtgttggggcacacgacggagacgatcatgtcatgtgcaagcaacaacaagacgtcaacattatgcctgcatgtgcatgtgatagtccttccaagtcaaactttggagggtccagaatttctgcaattctgcctccctccctccctatcccttgcctgcaaaacactgttactttggactttggagtgtgaacgaatgatactcctactcctacgactactctgaatgttgtactagtagtagtgacaaggaagccctaaatcccgggtcatacctgctgatcgaattgacttggtaatggagtaatattatactactccagcagcagcagcagcagcagtggtggtgtatcaatcatcctcaactaatcgaactgagcatgctgcttttgtgctggtccttgatttccggacaaactaatcgaagaatcgagctaaaatgatccatcgatggacacagtactagtagtatcatgagctagctagctagcagtatagtaattcatttcattaattcattcttagaacatctagcagcagcagcagcaagaacacacagcaaaagaagaacatgttgttgtatcaaaacgaatactaggtgccgtgtgttgttgttgaggaggaggggcccggcgcaacgtgggagtgggagaggcgctggagctgcagcatgcgcgcgtagcagccatcggggtggtggttgagcaggtgggagtgcgagccctgctccgccaccttgccgtcgtcgatgacggcgatggtgtgggcgttgcggacggtggccagacggtgggccaccacgatggtggtgcggccggagccagaggaggaggcgagcgcctcctgcacgctccgctccgactcggcgtccagcgcgctggtggcctcgtccagcagcaggatgggcgcctgcttcaccagcgcccgcgcgatggcgatccgctggcgctgcccgcccgacagctgcaccccgcgctccccgaccaacgtcccgtacccctccggcagcgccgatatgaacttgtgcgcgttggccgccgtcgccgcctccaccacctccgcctccgtcgccccctcgcgcccgtacgcgatgttgtcgtggatggtggccgcgaaaaggaagggctcctgcggcaccagcgccatggcgcgacgcagggaccgcaggttgaacttgcgcaggttccggccgtccaggagcacccgcccggagttgggctcgtagaagcgctgcaccagcgccagcaccgagctcttgccgcacccgctcgcccccaccagcgccagcgtccgccccgcccgcgccctcaggctcaggtcccggaacacctgcacctccggccgcgacgggtacgcgaagtccacgtgcttcagctcaacctccccccggggccgctccggcaccgccgccgcgtccacgtcgtccggctcgatctctgtcctccggtccatcgcctcgaacaccgcctgcatcgcccgcccgcccttcacgaagtccggcgccagcgtcagcgtctccgcggcgccgttggccgacaccatcagcaccatgaacacccggatggtcttggagaagtccgacacgccgtgcttcaccagccacgccgcgtaccacagccccagcgcgtacgacgcgtacagcaggaactgcgccaccccgtacccgctcccggcgatctgccccttccagaagcaccgccggagcggccccgccaggttcgcctcgaacagccccacgatcttcgcctccgacccgaacgccgccacggtgcgcacgttcgccaccgcctctcccgcgatctggtcgccctcgcgtgcgcccgctccaggtcgcccgagaaccccttgaggaacatcttctgcagaacggtggcggccaccaccagcgggaagacggccagcagcaccagcgcgaggcgccactgcaggacgaagccggcggtgcaggccaccaa

SEQ ID NO: 25968 - DNA, 10952 bp, Oryza sativa
  unsure (1)..(10952): unsure at all n locations
tactactccccctgttactaaatgctaatgcagcaggcaggcgtgtcagctactcagctggcaagaataattaatgaagggccggagtgttaaggtttaattaagcaaaccgcctggcaagagctcatgactccatgagcgagcggcgagccccatcaaacaagagggaaagaaaagaaaagaaaagaaaacaaaggattgattattgggaggaagaagcgggctgacattcctgacaaaatgtcaagctggaatggaatcatcccgagcttaggattccttgaaatttggcaatgagctgcagtgggcactggagtggacaagtgcagttgatgagtgggtgctgcaaaagggcgtcacatcttctgatctagtactagtccgtagtggtagtaggtactgtagctgttgtagatggagaagtcgaaagaaggtgatgagtgtgcaggtgccatggtttgtgcttttgaaagggggaggaagaggaggaggaatcttggcatgatccaataatccgtccatgttacttgcaccaactcggaacagcgttcgaaagcaacccattgattgccgcctggccctagtaataataacataacatgtctttccctgtctctatctaggagtatctctctccctccgagtacagtaatctctaatgtactatctatctataactaaaaaggagggagatgagatgatatgagaagcagcagagagacgtggtgtgaatgtgatagcatagcatgcctcctcgtgctcatgctgcctgcctaacaaacaaacacaacgcattgttgcatggtggatcgtcatcgtctcacagggttaggagaggcagcgacaggaaggacaaacagcaacaacaacaacaagtgaaacgaaggaaattgacggaagcagcaaaatacttgcctgcgtgttgtaggcgtcggggagcttgacgatgaaggagtgggcgttggcgaccctggcggcctcctccaactcctcctgcgtggcgccgtccctccccagcagcaggttctcccggatggtggtggcgaacagcgccggctcctggctcaccagaccaatctggcggcgcagccaccgcaggttgaggtccctcaggtcgtggccgtccagcaggatggtcccggcgttgggctcgtagaacctctcgatcagcgacaccaccgtgctcttccctgacccggagctccccaccagcgcgatcgtcttccccgccggcacgctcagcgacaacccccgcaggatccccacgtctggccgcgacgggtacgagaactccacatcccgcagctccacccgccccgtcaccgcctccagctccaccccgccctcccgctccatgctcggcttgtgctccatcatccggaatatcttcgccgccgccacccgcgccttggcgaacgccgccatgctcggagccgactgcccaagagccctgcggatcggattggatttttgttttgtttttactctcaatccggccaatcggagtacgtatatgctacggagtactacaaagctttacttacaggccgcctatcattactgagaacatggtggcgatggcgaggcctccgttggtgtgggcgcgtcggacgaggtgacccccgtaccagaggagcagcgcgtagcagcagaagacggtgaagtaggtgccgcccagtccgatgcccttggcgaagccggagcggtagccgatccgctgcgccacggccagcgccgccgagtaggcccgcatcacccgctcctcgcccacgaacgactgcacgatgcgtatctgcgccagcgcctgctccgcgatgccgctggcgtcggacagcgcgtcctggctcctggaggagagcttggcgagcgcggcggcgctgaggccgccgatgacggcgatgagcgggacgacggcgagggtgacgagggcgagctgccaggcggcggtgaatccgacgacgaagccggagacgaaggtggcgaggtagtggatgaggttgccgagcttctcgctgatggcgtcctggacgacgacagcgtcggcgttgatggcgtggatgacgtcggaggtgcggacgtcggtgtcgaagaaggagacgtcctggtgnaggcggncgtgaaggtagcggatgcgcatccgggtggactgccgctcgccggtccacatccagcaggagatctcggcccaggaggaggcccagatggcggcgccgacgacgaggaagtagaaggcgtacttgacgacgaggcggagcatggtgtccgggtgggcggcgtgggagccgaaggagtcgacgaggtcggcgaagaagcggaggaagaccgggagggagcagccgtggacgagggcgcccagcgtgcccagggtcatgaggacgtagtcgaggccgtcggcgaagctgaagagttgacggagcggggccggcgggaggggcttgggcggtggaaggtcggtggtttggatgtggggaggcggcggcggcgacttaggaggaggaggagtaaggggagcaggtggcggtggcgctgctgctgctggtgcatcaggttgaggatgggattgtggagaatggtggtggtggaggaggtgcgagtgcgggggctggtcggcggaggggagatggaaggcctcgagctccgggtcggcggcggcatcggcgccgaggacgacgacgcggccctttatctcctcctccatgcctagcctaccgccgccctgcccttgctcgatcgcactctgctctgctctcctgttcctgtactaataatctcttgctgctctgctcttctctaattctagctctacttcctaataattctagctcaaccctccaattcttgagttgacgagttgctcaattcctctcttcccatctgtgactgtgagcaaggaggaggaggaggattgccttgcctaatggcttatggctggtggtaagaggggacgacatgtttataaatagagagactactggactaatagaaaagaaaaggcacgtggccttgcacaacaagcctggtccactaggccacaccaagtcggcttctagttctacaccagccagccctttttcccttcatgtagagtagtagttatccacggtaatactcttaccgggtgtgtgtggcctccttcaacctcaccggccgacccgcccggagccccaagctcggagctccggtaatctctctctctctttccacggtaatataatatccgcaggcaggcaggatgttgcagttggtcctttcacatattgttgcttcagagttcacacgagctaactaccaatcatccaaaccaaaacctaccacatgcttcacttgacaatataatcaagcttttatttccaacgacgaccgacgaccactgtcacaaatcactatgctacgtaagaagtagtagtatgcacatgttgtcgcactccattttcactgtacgcatttgtacaactcgtactggagtactagtatgcatgtatgcgcatgctggactagctgctagtatatactccctctgttttgaaatatttgacaccgttgactttttagtaaatatttgaccgtttgtcttattcaaaaacttttgtgaaatatgtaaaattatatgcctacataaaaatatatttaacaatgaatcaaatgatataaaaagaattaataattacttaaattttttgaataagacgaacggtcaaacatgtactaaaaagtcaacggcgtcagacatttcgaaacggagaggttactccctattacgtactcgatcggtactcctaagcatggctgtgcatagttcgtgtgccaaaattctttttaagtatacggacacacatttaaattattaaacgtagattaataataaaatcaattatagatttcacctataaactgtgagacgaatcgattaagcctaattaatccgtcattagtcaatatttactgtagcatcaaattgtcaaatcatggcgtaattaggctcaaaaattcatcttacgatttacatacaaaccgtgcaattgatttttttaatccatatttaatgctctatgcatgtgtccaaacatttaatatgacggaaaagttaaaagttttaaaaaaaagtttaaatctaagcacggccaatactactagtactactcctcctccaatcaaaccttcaacacctacacagagtgcagacagagttgctagctaggtgccgcccgaccggccagcagtctcaaatcttttttttttaagaaaaaattcttccaatacttatgctaactgccacagtcaccaagtccacccgtacatatcgatctacacctatatctctctctcgcaccaaaccattcctgcaaactttctttcttcaattttaaaacaaacccccaagtagcttatactagtagtatttctttctaaaaagatatattttcatcacaaacacccatggaccatggtgcatggtgtggtaattttatactcctactttatggtacgatggtagtaactaatttaattaattactattgtaactgtatgccacaggtgatgcacggccagccaaatgcttgcaacttacgctgattcacgccaacggagaaaatgttatgtggccaatcgctttacttatcttatggaaccacgtgatctctaacaatgttgtaccattacaacaatgtcgtcaaccatcttatcgcaccccaatccattccgctcacgcattgcacggacggcattgcggtaagtcattacatggcttgtacgcacaatcataagtaaccaacatttatttactgtactatatacttactatagtagcacatttaatttgacaactcaaaaaaaataaagaaaagattagattaaaaaaaagtaagtaactactggggacaggggcaaatccagcctagagacaaagctggtgtcggcctatgctaatttttcatcatctcaacccgtcatggtgaaaaaagagtctcgacccatgggctttcaacaccagatgggtcatggcggtttgggtctgctccttactaagggatttgccagttctcatatgattaagattcccctgtcacctttctcaaggaatcgtcgtcaaactccaagcaaggaagagggagaagactcaccaatggcaacgactcctcaacaatggtgacgaccagtagcgaacccagaataaaaattaccgggatccaatgcgtaccaattatctaaatttttacttatatactaattaacatcatataatttagttagaattgaataatttactggggtccgaggaaccgggtaaatgtaactaggatcgccactggtgacgatgtcgaaactcttacgaataacctagggtttaggtttccagggtaggggtcgtgagggaatggccgtgagcagtggtaagaccggcggtgggtggcggagtacatgggcggtgggtaacggagatgccaccgaagctgtgtagttagaaaagaatgttcaaatatatggacatctagatataatttttccataaataaatcataacattaaacatgtaaaccaatagaaccatcttaaataaatcaaacatactaaacatgattgatacatctcgacgattttgattctattgtggaagtggagcagcacaacgcactgcacatatatacagtgcacggtattggatattgatgatgcacaacaccctaacgtagatgaagatgagtcgttgtggacgaacaacgagcagtcgcacgagcgattccaaaaatccttattagtgccttctcccgatgcaggatgtctaagacgaaggtttcagagatatgcggaaggttgtggccgtacggcggtggagtgagatgtatggttgtgacgcctgccttattgcccgtgagctgtatgcggctagggttagaccacaattagtggttagctggtgagttggtggagcagtgggctatttgggccttgtggctgtggttggaacgaactttgtggtagtcaagtattcgggtaaaatccagatatttaaaaaggtaatatccgtgttttataccagataacacgcatatgtaagatatcgtcatcccaaacccgatcttatatccaacagaaaatacctatatttggacctgaaaacagtaaaaactcccgaatacctcaatttttaacctaaaattgtcacaaattaatacacccgggcaggcgatcaggaaatacccaccctgttttcacccctagccagcaggcatgaaaagtagactacgagcaactacgcggtagagaggagtatccaaaaccctataatttttttgcgtgtgttgcatagaggtggtggctcgatatttacaaagatataagaatgcatgatcaggacaccatacaatctccatcggataagctgcgtgtaacctatctagagattcctcgccacttcacgcaccaagaatgcgatgagtttccaaacaccaaattatgcagcaaaaccaatctgaaaaaaaagagaagtcgtgtctgcataagcataagaaaccatttttgtggaccattcacacgtatgcctaccaaccggcctgtgcctagtgaggcgagcgagcacgtgtgtgtcccgtaattctcacccccacacattacttaagtgcttagaagagcgctttctcttttaagaaaatcaccctgttttggaaaaggcaaacatagtactaaagattaaaatacatcccttcccatgagatgagactttgtgattttcttagaaattaatcttcgtatgagtcttagcctacatattaattcgagtagaggacgtcgggcagggtcgttagcagagggttatatcctggatggttagtaggcggaggcaacgacaagatagtgggccaatgggcgcgatggggagttattgctttctggtgccgacgaggctaagaggtagggcatgggggtggggggagggggaaagggggtatgtgttaggtggttaacgaacacacgtcacgatggagaggagatgtgtgtagtgggagaaatgcatgaatctggaaagcaatatagctagtgtaaatttggctgaaatttatggttgtttttagatgactataaactagatctcttatgattatgatgatacccgtacattttagtaaggcaagacaaacctagtagtccctctctctcaaaagagatatctaaccctagagtgaatttagatttatcaccggaattgggttttttttttacaagggagacagggacccatagcctatattttttatataggcagacataagttgattttttttttacaaaaaggcgtatgtgttaagtagtatgccgtgtatatacgatgcagatgcaagcatgttcagcgtcgtacgctcatcgcagattaccgaagcacttcctatatatatatatatatatatatatatatatatatatatatatatatatatatatataccagccagttaatttgcttcgcggtatacaagcacttttaagcaaggcgtattnnnnnnnnnnnnnnnnnnnnnnnnnnnnnnnnnnnnnnnnnnnnatgaataatgcatgaaactgagtttataaaattatttaatggcataaataaataaattaaatattataaagttgaatagttgatttaaaaagttattagaaatgatgatgaataaagttttttagataaacatatcatttagaagcttaggaggcttgtccttcaatttgtaggtagaaaaagaacgtgaccttaatttctcatatacttgcaaatttatatgataattaatttgaatgtcccaaacgacgtaagcagacagtactcttttgaagtataggaatacttgtttaatttttgtgtgtcgtggtgcatcgatctgcatctgcatgtgagcctcactccctaactatccttttggttaatgtacattataatcgagttcactttacaagttagtggtgtgttgccctttaatttgtctttctcgtgcatcaagctaattaatttaggattgcactacgggtttcacgatcaaatgaaatctcttctttcttccaagctactcctagcttaatttatagtagtaacttttcttttcatgttacttgctaactcagtctgtgtttagttcgtgtaccaatttttttataccgacacatatttaaagtattaaacgtatactaataacaaaacaaattacagatttcatctgtaaactacgagacgaatctattaagcctaattaattcgttattagcaaatgtttactgtagcaccacattgcattgtcaaatcatagcgtaattaggctcaaaagattcgtctcgcaatttacatataaattgtgcaattgatatttttttcatccacatttaatgctctatacatatatctaaacatctgatgtgataaaaaagttaaaagttcaaaagaaaaaagtttaaatctaaacacggcctatttcttcagcggtggcatgcctgcccttctttcctctgtcaccaccgtacagtacatacagagggaaaggaaagctggtcatgctaccgcacgaaccaattttttaattaagttaatggatcccctttcctttaattaaattttgatttttgaatgatctctgttctgtgtacgtaagaccgtagaggccgtccgtccggccggccatacgtactgatagagcttcttcatctgcggtgcaaaaatattgtctgaagatcgaacttattgcatatctcacgtgtatacttcctcccttccaaaataaatcaacctcattctcattgtaaaatatcacatccggtacaacttggtttaggaggtgtttagatctagaggtgtaaaattttagcgtgtcaaatcgaatattatatagggttcgcatgggtgtttggtcactaataaaaaaaactagttacagaatccgtcagtaaaccgtgagacaattttattaagcctaattaatccatcattagcaaatgtttactgtagcaccacattgtcaaatcatatagcaattaggcttaaaagattcgtcttgtaaattagtcgcaatatatataattagttatttttcagcctatatttaatactttatataggtattcaaatatttgatgtgacatgaagtagaatttttaacagggatctaaacatgcccttatattgggatgaagagagtactagctactactagtcctagaatatatatatcacatcatgtatttttttggacaagtatattatttcctcaatcccataatataagggattttgactttttacttgtactgtttgaccattcgtttgattaaaaaaatttggaattattatttattttatttgtgacttatttattatccaaagtactttaagcacaatttttcgttttctatatttatataaatttttgaataagactagtggtcaaacagtttaagaaaaagtcaagatccttatattatggaaggagggagtatttgtctgtcagtcattaactggcttatgcaggttgattttaattaattccctatcactccactaggactccgaggctgtacagacccatattaagggtgcgtttagttcatactaaaattgaaaattgaaagttagttaaaattaaaacgatgggatgaaaaaattggaagttttgatgtgatgagaaagttgaaagtttgaagaaaaagtttataactaaactcggcctaacttactgtccgactgtatacttaccgtcagatatcagctggttgtgatgacgtctttggttatatagttattggtaagtttgtagaagcctaaagcagctttagtttctcacacaatctccagtttcgctaaatagtttagactatcacctagattctaaaaatatgtagttgtacgattcaaaagatgaaaacgcagtttttttcatattattagaaattggctattaaattcatagaatctctaaggctgcgttcattgctgttggttcccaaactccatccgtcttgttttccacgcatacgcttcctaaactgctaaacgatatgttcttttttaaaaaaaagtttatatacgaaagttgcttaaaaaatcatattaatccatctatctatctattatattattaagacagctcgaaaagaaggcaccacgttcaccgtagaggtctagaaattaccacgttaatcggagaaaaagaaaaaaatttcgaccgcttgatcattgatagcctatattttaatggctgagatttaattaaatttttggaagattagacttggtttcacgtagacggacataccaggcactagaaaccagacattcatatcagacacggattgacatgtgcagtagtaataggacaccaatacgattgacatgtgcaggatttttagaatttgtattatgtgtagtatacggattaacagttttgaaaggaggcaccacgttcgctgtgggggttagaaatttccacattaatcggagaggaaaagaaaagaagagtctaagtagaaatacaatttaaaaatagctgaaattgaaagatgagtccatataagaacccgatacgagattaatcgaaattcagaataaaaacaaaataaaatccgaaattataaaagaaaagaagagtccaagtagaaatacaatttaaaaataattaaaattcggaattaaaaataaggtatattgatagaagaatccatataggaacccaacacgagattaattaatattcaaaataaaaataaaaaaaatccgaaattagcaaaaagaaaagaagagttcaagtaagaatacaatttaaaattaactaaaattcagaattaaaaataagcgatattgaaagaagaatccatataagaaactcaatacgagattaattaaaattttaaataaaaaataaaataatatccaaagttagaaaaattaaaagannnnnnnnnnnnnnnnnnnnnnnnnnnnnnnnnnnnnn

SEQ ID NO: 25969 - DNA, 377 bp, Oryza sativa
tcctgctgagttttaccaagttttctggaatgtcattaaattttaccttttagagctatttaaggactttcattctgggagtttgcctttatattcgcttaactttggtactatcattcttttgcctaagtgtgctgaggctttaaagattcaacagtatagacctatatgcctacttaatgttagctttaagatttttaccaaagttgctacaaatagaataatggatgtcgctcaaaagataattagtcctactcaaactgtgtttattcctaggagaaatattatggaaggggtggttattttacatgagactttacatgaattacatcgcaaagataaaagtggtgtaatttttaagattgattttgagaaag

SEQ ID NO: 25970 - DNA, 612 bp, Oryza sativa
ttcaaggataaattattccactgttccagcctccaggaggtcccgacgcatcgttaatagtccttagctcactgcaaatattttgttgtgaggaacatggcgcaaagttcactgcaaaatttaccatatgtattttccttagtctatgattcactccttatgtaattaagtcgccccttccctcctatttctctctcgacggactatgatccattgttaataactttttatctttatttttctcctcctaatataaccggcagtcctcctgccatataccatttcaaaaaattagtatgatggttattgcatgtggatgatctgaatatcaaaagtaaacagcgctgcatcttttagcttttgtatgttattggtctcaagattttgcatgctagatcacaatgtaatcttcatatgtgcttatagccattctaaacttactgtacctttgatgtggtttgtctcttcagttgacaggagatatacatgaagaagtggagaatcataaccgaatgctggacagaatggtactaatatcctgcaagatgctatctttctttgcactactctctaatgcatttctttgctattttaggtaatgatatggatgct

SEQ ID NO: 25971 - DNA, 3227 bp, Oryza sativa
  unsure (1)..(3227): unsure at all n locations
nnnnnnnnnnnnnnnnnnnnnnnnnnnnnnnnnnnnnnnnnnnnnnnnnnnnnnnnnnnnnnnnnnnnnnnnnnctgggtgtctgaaatttgctgcgtgatgcattgtgggttgtcaaattgtccctcaaacactatgttgttgcgagattttcacagcgtgtaagcgcaagcagcaaaccaaattggttctattccctttgatgagtgattcatgtctatgactgcttgtaggaaggccgagcttgattcggatttgttggccagctgcagtaagttcaatttttcccggaggttattggcattgttgcatcttaggaggatgtgatctgctgattctagtgcaggggcacaaggagctgtggggatcttcattccagtttttgctgaccatattggatttggtgtttagtctgtctttgaatgctagccaaagaaaaatcttacaattttgtggtatggtgtggatccatatataatctgctggtttccaaatggatccatggtatgtcagcaagcgataggcatttgctgctgagactttgggtgcagtatacaagaattctctttgtgtctgttttctctgggatggggcagagattttgcaagatttgcagcagtgcgtgtagttctgattttgcttggtaggaaaggctaggatggagctgtatttgctaggaattttgtctgaattgtgattgaactgtgcaatccttatgcaaagcaaatgagtataaaactgggtaagcaaattccagacgttgatgcagccatttatccttccaaatcagagttgttctgccatttccgagttttacctgtgttgtagagcatagggtctggaattgtgatagaatgagtttccaagtcggtgtatcactggttctgggatgtaattgtaatgtgttttgcatatacctctctctaaaccaattagcgattggatcattcgggcctgcgagcaccttatcttctagctttaaaattaatgctgtgttatgtgtccttaagtccttgatccctaatcctcctttaatggatttttcacctttccaaaagaaagcacgacttattttgtcagttgtctcgatagatttctctgtccaaatacatatagtaagttgggattgctgagataaccgaacttatcattttgatctagttcacctgtctttatcagtttgcgttgtgtcatccgtatttgcagtaactcttttgtggatttgtttccgttctgcatacaacactaggctttgggtgaatcgttaaggtgacccaaaaaagaatgtcaatacaactcattaattaagattgaaactgcggtatttttctgactattaattgccttgggcgacgttagaactagcatatcttgtgtgcaagtttcagcaactaacagcaccacaaaaatcgattgcttttctttttctttaattagttctgtcgaagaataaaagtggagcgagaattaaagaggaagatatttttatgtctcccaccggcaggtgggcccatacagttagtatattatcttttgattgatgatgagaaagaaaaagagagggtccgtggcgccgacaggtggtccccgcatgtcatcgaggtggaaaaacacgaaaccactcaatcgaaacagtagagataaggaggacaattggaaaagagcccctctaagattagaaaattactccactatatatnnnnnnnnnnnnnnnnnnnnnnnnnnnnnnnnnnnnccatccatccaacaacgcaagttgcagattctacttggtcggagtttcagcctccggcgaactgctccgatcgatcgatcgctcgctcgcggggacgcgacgaggtaacgacgcccatccctccctgctctttcttctcttcgatccttcttcgcggtcgtgtagggatccatccatcaaatctgaatatctaatcgaatcaatctatatggcgttgcgtttgcgtttgatttgaaccaccatgatgatgatgatgattttgctgctctgagagatgatgctgctgctgatgctagggtctgcttgcttcatctgtcgtagggtgggtgaatcgcttaggatttgggaatggctcgccgtttgattagcccctgccaaggctctggtttgcttaacgccggatttctcggcgtcttctcctcccaccatgtgattccactatccccctctccctcctcccttccccatcctccacttaaccaggcacctcactcacattccatgctcaaacccttgccctcctctcctctgcaatttctttatacattattcatacacacataggtttcgatatagattctcctagtgcgctggaatattgtttgtactagtattattaaagtttatatatgtgtcgatgcctctaacacaaatgatacatctacttgtcttctcctcactgtttcttccccccaattctattccctgtttataccagtatcatcgcgctgccattgtcatcatcacataggagttccccaactgaagaattgctaccttcctaatttaaggaaggaggtgtgtgcctcccccttgctctcagatgataatctcatgccacccacccagttatagcttttgttgcatggcattgctgctgttgcttatagattctagtttgtattgttgtaggtctcgcattggacaagaccagccacgccttccttgtcgctatatgtctgtatcatctcgcttatatgttacttttcttcattaactccatgtttttacttctgtagagtacatcttgatcggacaatttcccgatatttcagagtgcaaggcttgccagcaagaggacaacttgttccgttgcaaccgagccgccgccttccacaaccgaagaaccagagatggatcttccaaaggagatattcctgaaagaatacaaaaagcctgattacttatttgactcggtaactacatacctctctttttttgcaaccatccaaaattttcaatatctgaactccggcttgcaggctttctaacaccatatctatggatacttagctgtttgcaatctgaaatttaactagatatatatgctagcctgtatgggcatcttggcatttaatgaacataatgggctcctttctgtttgttgtctttactaccttcctgactttatgctgggacttaattttgggcaggtcaatttggaatttcaacttggcgaagacaaaacaatagttaccatctaaaatagctg

SEQ ID NO: 25972 - DNA, 3524 bp, Oryza sativa
  unsure (1)..(3524): unsure at all n locations
tcaattgtcagaactgacaaagtggtaatcagtgaataccatgtctaagaatatgcatctttctaactgtagggtggcaagcattatgcattgtgggaagaccccctcaaagaaaccaagctacttatttgctttagttgctggtcagttggattgcagggaggactcatttactacatgttctggccgaaaagtaacacttagaatttggactcctggtcaagatttagcaaagacagcgcatgctatgtattctcttaaagcagctatgaagtgggatgaggaggttggtcccgattcattctcctatgtttttgtgcaattcttcgtcgtatcactaacacaatttattaatcagattactaatacaattctacctttggattcgtgccaggtttttggccttgaatatgatcttgatttgttcaatattgttgttgttccagatttcaatatgtaagccttctctcttattacattgtcatgctgcaattttgttcagtctccaagacctaggactttgtgttttgttttgttggtacagttgttcttccagtggtatttatttttctactacagattgttctcactaaatctcctgtgttggttaaatagcagatcagatctaccttatctctctaacaacactcgtactaataaacttttgtgttgttttgcaggggagcaatggagaacaagagcttaaacgtaagaatctctctgtggttacaaaatacttaaaacatgaaacaacactgattcctgttatatcaatgaacagatatttcaatctagacttgtgctggcatcaccagagacagctactgatggggattatgctgcaattttaggtgtcgttggacatgaggtacattatcagaaatgatcgattttcactcactatattctttctgatcatgaattcctgttgatactaacttatctttcactttatttttgcagtatttccacaactggactggtaataggtaaatatcttaacgacttcaccgtactggttacatctaataattaaatttcaacttctaaaacatgatgtgtttggttgatttgttgccaattgcatctttgctcgtgttttttcattagttatactatttttattgatctcacgagcttcagttagtttagaatcctccaaaagaagaggcatcctttcaactgtcctctgtgtcatgagattcgtcatgattagtactagttaggacagaatatatcctgatgaatatcttgtgcaannnnnnnnnnnnnnnnnnnnnnnnnnnnnnnnnnnnnnnnnnnnnnnnnnnnnnnngggantnnnnnnnnnnnnnnncaggtactcatgaaataggcttttagtgatttgctgcaatgtttgggttttatcgtgctctgttaataaattgaatctgcaggaattctcatcagatcttggttgtcgcacagtaaaacgtatagccgatgtttctaaactcaggacctatcaatttccacaggttgtgtttctttaaatttcccttcactagtactggattctaattggtttgatggcagttacatttgttttcttgttttaaatcattactttcctccctgatatccaggatgctggccctatggcgcatcctattcgtccgcattcgtatatcaaggtgacaatacttaactgtcagttattgtaactactttgtgatttttagccaccatacagatctgatattaattcttctaattttactggcagatggacaatttttataccggtgagttgctctgtctgtgaagtatgatgtgcatctaatgagaagtactacatcattagctaattattttcaatcattttatgccctggtgaacctccaaccttattatttgttgaatcttgtgtggtgatttgaacgtgaaaaacctggcagtaacggtatgttttctgttctgttcaattagctttcaataaagttgtatgggaattcttttgtctaaagaaatcctggaacgttctgacattttcttttgctgctttctactttttcatccaatgattatgggatttcatcacaggtttatgaaaaggttcgtttgatccaatgttttcttattcacttttgacccctaaccccagtgggatgtaatttgtggatatgtacttgtagggtgctgaagttgttagaatgtacaagaccatgtttggagcttcagggtttcgaaaggtaaaagttaaatgcagaaagcatgatgatgatttcttttctcccatggtggtgctgtgggcttaaatatatgaaaataaaagaaatgagaaaaccgattgctttgttatcttttggcaaaaaaaaaaggaagcaccaaagaatgagaatcttcatgagatctgtctcttttcttcagttatcaaacgtgtgttatctgctcgttctgtttagttaacagtttgtatctcctgcacagggcatggatctttacttccaaaggcacgacgggcaagctgtgacttgtgaagacttttatgctgcaatgtgtgatgcaaataacacccagctgccaaactttttacaatggtactagacatctatctttcaacgatgcacatgttgcaagcacaatctgatcttaaaacaaccatgcaatagtgtactctcaggcgggtactccaactgttaaagtgagctcttcatacgatgcaagttctcagacattttctctgaaatttaggtgagcttctacactaccaagtttttagttactttcacttaaagagttaacccagtttatgattctttttctgtattgcttgattttccgttcatgtttttaatccacggattatagatattttgcttcttccttttctgccttctatagataatttgtgaaattagaatattttcaactaattccttccgtccttttaaatatcttagtcaagaagtgccacctacccctggccaaccagttaaagagccgatgttcattcctattgctgtcggacttgttgattctaccggaaaggatatgcccctaacttccatttacagtgatgggatgctccaatcactcactagtgatggccagccagtcttcactactgttcttcaatttaataaggtataagaactgattattttccagtcaaaaattcctcttcaatggcaacttcagggccacaagttgatttctttggattatgaaccttgcatgccatgcaattaagtcatttgtgagattatcattttgaactcttgctatactttgatttttatagaaagtactaagaattgtgccttagtcaggatcacgtggttgagatgtgtaaagacatcaacctgcaatttttatattcgcgttcagacattacatgttcttgtctgatcttcaaaatggctgaatgagacatttttttcatctttcagaaggaggaagaattcatatttaacaacatacctgagaaaccagtgccttccttgttgaggggatacagtgctcctgttcgtcttgattctgatctgactgagagtgacttg

SEQ ID NO: 25973 - DNA, 876 bp, Oryza sativa
  unsure (1)..(876): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgggcatcggcgtccgcaactcgctcttcctgctcgccgcctgcaacctgctgggcctgctcttcaccttcctcgtgccggagtccaaggggaagtcgctggaggagatgtccggcgacgccgaggcccaggaggaggcgccgccgcccctgcaaactgtactgtagcgctgtcgccgtctgcatatctatctatatatacatgcagatatatagccaccatataatataactgatcgatcgagaccagagaagatcgatcgaagaaaccgccagttgatatataactggcctggctatccactatatatatatatatatatatatatatattttgtcgttgtcgtcggcgacaccatgtaccttttcttctccttaattagccttattgtgtttcatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25974 - DNA, 486 bp, Oryza sativa
ggtacccaggacgaagaagatgaagttcaatatgcacgtgtcgaccatgaggaaggattatttttgtaatttatgtacgtagtttatgtctacatgtctgttatctgtatgactctaatatgttcgcaatgatcaatagtatattgcttatgaaatagtcaaataaaaataataattaagtgaagcacccactagaagtgaaataaaataattaagcaagtataagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggcccgcacaggtgacctcacctgcgatggcccagaatgttgggcccgtcacaagtggtcttacctgt

SEQ ID NO: 25975 - DNA, 2033 bp, Oryza sativa
tggatgaagaaattaacgcctcgggaatagcagagatttttccaaccagtttttcttgctcaaccaacacggtctcctcatccaacccgtcaaaatcttcgtcagacgcagtcaaaccttctgactccggtatcaaactcaactgagaagaggtaaaagaaggaccacccctctcagtaagattactatcagtagccatactcacatcagagacacccggtccagacttctttcccatgtccttgtcattttccccatcgtcatttctcttcccatcacccatccccaaaattatccatatccaaaggaacaggatccccagcaccaatatctgactccactttaaaagacagctcatacaaatgatcaccaatggccacatcaacaacatcagggattagagatgggtcaaggaccaaaacttgtaaacgagctatctcataccttctagtaaataacatatcaacagctttagtaatcccaagaatagaaccaactgcccaaataattaaatattccctcaactcagaaggaagccccttacactgaacccaaacttttggaatgacatatttcacctcattcccaacacctctttctatgatctccatctgagcctcaccaactttagtgtgcacctttccccattccaccatgcgattcagctcagcagcagaaggaaagatggtatgaaaagtgttatcaccattgtcatgtaccacccacctccatttaccaggaattaacctctccaattcagatacaacagcggggggccctcagctttaactgtcatctgaccattagatattttaaccaaggccgccctggggtcatgcctaatcctttgtccagctgggagggggatatgaaaaaaacccaaaccatcacccccataaccacataattgagcagtaggtttcacagctgatctaaaaacaggacaccgggtagcaatgtgatccacactttcacaaatttcacaataaaattttgatgaacactcctgaagagtatgccccttagtcaaacacctatagcagtaaggtttacccaatcccttagtgtctgcctttgatttacctttctctgaatcagtggcgcaaacaagcaacccttgttgtgcgggttcagcacccaccgccggggtaacagatgtgatgacatcacccattttagcagcagcaacaagagtaccacccacagcaaccgatccactaactgacccagaggtatttgcagttaaacctgcagaaccactagccgaagttcttccaaaactcggtatcacaccaactgaattaactgcagaagtcccaacaatcttacccacatgtccactcggcgccaaacctgcaggtagcactagcgatgctgacacagaggtagcagcggctccctgaccaccaccacccagcggaagaccagctgcaggaactccacccgggtataaaccacccggcggcccaaaagcacctgccggcggcgccataccacctgccggcacaccactagatccacccgtcgctgcaaattgaccaccagacgacggcacaccgaagaactgtgacccagatgcatcacttgccggccggccaaaagagcccaaagggaaccctaaaccggaattgaagccagttggcccagcattctgtccaaacccaccgttccaaccttgtcctcctccaaaggtgccatgccatctaccactgttgccgtgagagaagtcatggcgattgttgtgaccgccaaactttccacgaccccgggcccttactcctctaccatctctggcttggtatggaaaaccacctccggaacccggatgaaaaccccgagcaaagccaccggcatgcccggcagcaccgaaaccctggcgattgtttctctccattgggcattggcgaaaaactaacgacagcggcgtacgagcgagcgccagaaagagattgatctcccaccaaacacctgcgcctcacgggaccaaattttctaaaaagagcaactaaacccggttatgggcctatacggga

SEQ ID NO: 25976 - DNA, 1932 bp, Oryza sativa
cttgtgcaatttgcagatctcagaaggaaaagaagaagaagaagaagaagaaaagacttgcaacctgcagagttcagaaagaagaggaagaagaagacgcgtcgcaaacttcaaatcgagcgaagtggagacttgccgctcgccgccaccgccgttcgctgccacagccgatccggcccccacctgctacaaatgtctgaaggggaagagggcggcccctttcgccgagcgatgaccggcgaccacagcggcaccacgctgcccctctcctccttcccgcctcctcatgaatgaagccaatccccttgactgagctcggagaagacagaatcagtgccgccgctctcccgcccgctgtcgccactccggacgccgccgccgccactggcctccgcttgccaaatggggagggagagagaaggggaggatgaggaagggatagactggccccacttgtcagtggtcccacaaatttcttttgtgtgtgaatgataagtgagcccacatattttttttaattctaatgacacaagcgtcacgtcaataccacgtaggacgaagactaggtcaacattgccacgtaacgtgccacgtcagtaaaaccgctcaccaaaaccgccgaaggagtcaaattgcaccagttttaatagtttaggggtcaagatatctggttttatggttcagggtcatggattagatttaggccactttttaagggactcaaagtggacttattccttatacattccaatccggaaaaagtacaccgaaggtccctcaacttgtcatcgaattacaaaatcgtcccccaaccacaaaaccagatatatgacatccctcaacttacaaaaccgttcactttaggtccctcggtggttttgatcacggttttgtctgacgtggcggctgaatcagcgtggacccatataggcctcaccctatctctttcccctcctctctctctcacttttctcctcttgggcaggccggccggcgggtggcgaagaggtcgccgacagcggggtgcagtggctgtggcgcgtacctggccgtgccgccgggggcgcggtcggtgcgatgcgcgctctgccatgccgtgacgcgcatcccttggccacgccagccacagcgagcttagcactcggagccgcgagaagtagtcgctgatgacgagcagcgcccgcgccgcctgcctcgtggccaggatccggtgcatctgctggagtgtctgctacatcagcagatcagcctacacaaaaaaaatcatcgcatcacgccatggtaataagcaattcagttcgccattgatgtttgaccgaagcttgaggaagttctccagcgtggtgagcatggccatggcgatggccatctgtcccatgtagttagtgacgttgtcgacgaccacggtggtggccgccgatgccattgtgtctcccagcgtctgctgcagagtctccatcccctgcgacagcgcgtcctcggcctgctgcgactactgctgcaggttgcagatgcccatcaactgctgatccgtcagcggctcaagatggctctcaagaacctgcacaaacaacaacatcatcatcattcaacaatagcggtcaatggtagcttcagattctttgcttgttacttaattgggtgggtgatcactcgtgtcaaatcttgaggagctcagaggaacagaagccgccgagccacatgaagaagcgctcagcgtggctcatccacatgctggagaggacatggaatacgtcggcctaggtggcgaagctcttgaggcggaacacctggtcgtagtgcatcatcacggcgtcgacaagcacgcggagctcgtcctcgctcatcagcgcgtttgcgccgccgccgccgttgacgacgtcatcggggtgcgggcggcggcgagctacccgcgcgtctgcggcgagaagc

SEQ ID NO: 25977 - DNA, 3339 bp, Oryza sativa
agaccaataagaccatcgtcactgccgctctagctcccggcggcggttgctgcaaccacacatggtccttggccgtgcgcaccgccgtcatgttcgagcccgtcctctctgcagcttggtgtgttgccgacgccctcctcctctcccgcactcgccccgccggctgccctacccagggaagagagagagagagaccggaggcgcatgcgcggccggtggccggcagtggagaagagcggcggcttgctcgctccgtcggaccacctcacccgcctcgcccggcgacctcctccccacccgccggccagcctgcccaagaggagagaagtgagagagagagaggaggaagggagaggggaaagagggagggtgatgacgtggcatcctaacatgtggggcccacgtgggtcccacgctgatttggttcagataaaaccacggtcaaaaccaccaagggacataatgtgaacggttttgtaagttgagggatttcatatatctggttttgtgattgggggacatttttgtaagtcgatgacaaattgaggggccttcggtgtactttttccttccaatcccagtgggcctttcttcactcattccgctgggccctgcatcaaaatctctctatctctctctcctctccttttctttaattttggcttaacgtacgtgccactacaaacaagtactccatatttttctcttcaaaattcaaaatcattggttacttcaattgcatctctcctcattacattgctaatcacgaaattaaatcaagctcagtgtgcggcctccaaaatggattcaaaagaaatcgtaaaatggaggcgcctcgatcgctagctatccaagatggacggcgtcgacagggacacagcggcgcggctcacaatccggcagcgccaacgtgtgctgcagagggccatggtgatggtacacaagctacccttacggcggccgcggcttgtaattaatttccttattcattagttagctacgtacgaaattgcatgcactaatcaatttcatcaaactagtgtgattgtccacacacagattgtatggtttgtatcattgttttttctcaaataatagcatacatattttcacatttttataattaaaatatattaaaataataatatactttaaattatgtgctaacctgatcaactaactgatgtgtgatattatgatgaatatagataattccttactgttctattaatcatacaataaatcaaagatatgtttttaataaaaaaatgtatttcaatactaattatttttaatttaaaatttcaattatttttaaattgtattcctatatgaactataactctcattctaatatttctttttaaaatttctaatttccattatttaaaattatatttatatatgaactatagactcttcttctaatatttcttattatttttaaaatttagaatttccattatctttaaattatttgtttttatttcctaatttcatctattcctaaattatattgctatatggactctagaaacttatactaatatttctttttttttattttcaaaattttattatttctaaattatattttttatatggactctaaactattctttcgatatttttattttttttatatttctaattttacatattccaaaattgtattgctatataaactctagactcttcatccagtattacttaattttaaatttgagttttagatatgtacaggttatatttatgtatatactctaaactctactttttgttttattatatgtttaattctgaattttagttagttctaaattgtatacctacatggattctagtccccgcttccaataatccttattttttaatttcgaatttcaattatatgtagaatgtacttctatatggactctatgttctttttatattccaaatttcagctattcctaaattgtattgctatatgggctatagactcttcttccaatattacttatttttagttttgaactttagatatttacaaattgtttttctatatggactctaaactgtacttttaattctaaattttaattagttctaaattgtatacctacatgaactctagtcttctgttccaatattcttatttttttaattctgaatttttattatttctaattgtattttgttgacgaaaaaaatcgaacacaccggcttgggagatctgcttagctcctgtgcaggtacaaagattgatgagatgcgggcttgccagtcagtttgatcctgcaactgacaagatatgcaaatagcagatcaaaacagccgatcggctgacaagccgatggagtagttccagccgatagccgataacagccgatgccgataccagccgatagcgatagggtttaagcaatcggctatatatccaatgtagataatgatataaaggcaatcgactgatgatgatataataaaataacaatatagtcctgtataaaccaatcggctagcaatgatatgataaataagcatcgatccgagggttaaaacacacatcggctggaggtccgatatcatgaaatccacaagattagattaaacagtgaaacctttgttgtcatcggttaaatccaacttatatgtatatgcaatcattatgagccgatgcaacatccagataactcaccggctgaaaccctgatgaaacccttattggcaatcaagaagcaggctagagattatggttttaagcacgacttagtagatcaaacttaactgatgcagcactaagtatgaaaagaaacataatatctagacaatcaagccgttgactgagttttcagggtggtagatgtctaagctaatctaatctagtaacgcgatttagccgataccggcagaaaccctaaaacgagaagcagccgatagagctaaattgacatgctaagactagattaacagaaacatatgataaataggtaggcaaatatatcatccaaaccagagcaatccaaaaggtcaaatgtaccgatgcagccttgaacgacgccgacgtagacgatacaattgcctggaccggcggaacattggacttatcccttcgccggagatcaaagacgatgtagccccgcgtcgggtgccaagtcccaccgaaaaagggtagcgatgcgccgaattgtattgatcgtgaagatagattacaatgaccccgggtgtacatatttatacccatgggttgatacaagtccttgtcggacaagaaagaaaccttcgtaaagataaaatgaaaagataaagtccttataggacactaaacacactttcctaaagataaaagaaaactaa

SEQ ID NO: 25978 - DNA, 670 bp, Oryza sativa
  unsure (1)..(670): unsure at all n locations
nnnnnnnnnnnnnnnnnnnnnnnnnnnnnnnnnnnnnnnnnnnnnnnnnnnnccataggatccccgtacgtaggattatgtagctggagtgctggacgcctgcactgcactgcacgcatatgatatgatactccggccagctggactggagtatgttatgtacggcggagtcgggacgacattatattggaattagacggcggcggcggtgggcgtgccggcgtcgctcctgggctcggcggggctgtagatcgccgacggccggctgctgttccggggccggacctcctccagctgccgcaccacctccgccatggtgggccttgccgaagccaccggcgcgcagcaccccatcgccagcttcagcgcctgaagcagcccctcctccgcggggctacgcaccccgcgcgccacctccgcgtcgaacacctccatcatcgtcacctcctccagcaccgccgccttcaccaccgccggcagctctcccgacgccttccgccccatcagcagctccagcagcaatatcccgaacgcgtacacgtccgtccgcgggctgcacctccccctcgactgcagctccggcgccctgtacccgtccgccttccccaccgccgccgccaccagcagccggtgcactgcgtactccgccaccctcgccacgaaccactcg

SEQ ID NO: 25979 - DNA, 698 bp, Oryza sativa
  unsure (1)..(698): unsure at all n locations
nnnnnnnnnnnnnnnnnnnnnnnnnnnnnnnnnnnnnatgtttaggctgacgcaaaaagcatggaatggcaatgcaggttggggagcgcgggctgcagttgtcgggcgggcagaagcagcggatcgccatcgcgcgcgccatgctccggaacccggccatcctgctgctggacgaggccaccagcgcgctggactcggagtcggagaagctggtgcaggaggcgctggaccgcttcatgatcgggcgcaccacgctggtgatcgcgcaccgcctctccaccatccgcaaggccgacctcgtggccgtcctccagggcggggccatctccgaggtgggcacgcacgacgagctcatggcccgcggggatggcacctacgccaggctcatccgaatgcaggagcaggcgcacgaggccgcgctcgtcgccgctcgccggagcagcgcgcgaccatccagcgcccgcaactccgtcagctcgcccatcatcacgcgtaactcctcctacggccgttccccctactcccgccgcctctccgacgccgacttcatcaccggcctcggcctcggagtcgacagcaagcagcagcagcagcagcactacttccgcgtgcaggccagctccttctggcggctggccaagatgaactcgcccgagtgggggtacgcgctcgtcgcgtcgctgggctccatggtgtgc

SEQ ID NO: 25980 - DNA, 561 bp, Oryza sativa
  unsure (1)..(561): unsure at all n locations
nnnnnnnnnnnnnnnnnnnnnnnnnnnnnnnnnnnnnnnnctaggggtgaaaacagggtgggtatttcctgatcgcctgcccgggtgtattaatttgtgacaattttaggttaaaaattgaggtattcgggagtttttactgttttcaggtccaaatataggtattttctgttggatataagatcgggtttgggatgacgatatcttacatatgcgtgttatctggtataaaacacggatattacctttttaaatatctggattttacccgaatacttgactaccacaaagttcgttccaaccacagccacaaggcccaaatagcccactgctccaccaactcaccagctaaccactaattgtggtctaaccctagccgcatacagctcacgggcaataaggcaggcgtcacaaccatacatctcactccaccgccgtacggccacaaccttccgcatatctctgaaaccttcgtcttagacatcctgcatcgggagaaggcactaataaagatttttggaatcgctcgtgcgactgctcggtgttcgtccacaacgactc

SEQ ID NO: 25981 - DNA, 645 bp, Oryza sativa
  unsure (1)..(645): unsure at all n locations
nnnnnnnnnnnnnnnnnnnnnnnnnnnnnnnnnnnnnnnnnnnnnnnnnnnnnnnnnnnnncataaaccaacagctcatagatacagagctccatgtttgcgacgatgatgctgaggctttcggtgctacatcacaagggacagaagggacagtcatcaaatgcacatttactgctgtggctgttagccccagctagaattccatgtttgcatcaacacagatggtaagcttctcaaagcatgatctgtggtatctgcttttattgttcgctgatgttccatgttaaaaatgtgtggcaaagtccaattttgccattgaaggtgcttgtacccgctagctaccctaattgctccccggttctcctagacaagttcccagatgaacaaaggtcagactacaatgtattatcagattctacgccaagtactacatattaggctgtcctgattatctgtacataaataaactaatgatgttgcattgagcttgtgaatctgctatacaaactcagatgacctgtcgaccaaagcgaggtctaagttcagcatattgcttccgggtttagctgagcccatgtcactaaaagaaattgctaggacgtgggacgcgtgtgcccgcaaaagaaattgctgagtatgctcaac

SEQ ID NO: 25982 - DNA, 660 bp, Oryza sativa
agctcagcctctcacgtctgccggagacggtttgcctaacccggttagggcagggttcccacttcccggtgcaaatgaggacccaaaagtcctcactctttaaatgctgaatgacatgcgtgttgacactgtcagccggatggatttgacaggccctacgtcgcagcaaggtgtgcaacagacttccaagacaagcaataagaaatacatttaatgtgattatcctccctgaataggctcggcgggcccatgtggtaactccttgagatataaaagaaggtccaagcctacttagggaggggggatcaactctttgtctaactggcgcttgggggctcacgcgcttaagcatatgtattccacatatagtcagctaagcacatgagtagggtgttacgcttctcagcggcccgaacctgtataaatcccttttgtctctgtcttcgagggccccgcccccctctctttctctcatccaccacaggaatctcgaatctcactcgctgcccctggtcgaactaacaaagagggggcctcgcggtaccccgatagaggagctcacacttcgacatctaggatttaaaatttgtctcaaaacacaactacttgtgttatttaaatttttcaaaaaatacagctacttctctacctatctcctca

SEQ ID NO: 25983 - DNA, 923 bp, Oryza sativa
  unsure (1)..(923): unsure at all n locations
nnnnnnnnnnnnnnnnnnnnnnnnnnnnnnnnnnnnnnnnnnnnnnnnnnnnnnnaaatataacatcgatatcccataaccgttctgtgaaggcgtgacgtcgtggacgatatcgcgcggtgaaaatgtctcgcggaatgtgagactgaacgctctcacgaaatcaaacagatacactgaccaatatctccagtaattaatcactcaattaacaattaactaataataattaatgataaattatcttgatcagtgatttaattaattcgttaattaatggctaattaaatcatcatggcaccagtatcgctccttgcttcagcgataccgaacggtctcttcgcactttcatggcgcgataccgcctgcgacgttattccacgttattttcgcgtaacgcgtatgcgagaccgacggtatatttctgtagaaaattttgtatcccgaatattcctgagaaaaaaaatgaatgaacaatttaattccattcggcaagacgctgcggattttcctggtatattgccggtttagagcaggttttctgatattttttcctaagtcaaaaaaaaaatccaacctagttagtatgggatgtccagatctaggttgaggtttttttactggacagagtaggtaatcatgtactccctctgtttctatattaattgacatttagaaaaagattgatgttaaacttttataactttaaccatcaataactttaaaaatatttagtttaaagaaattagaaaaacatatatagatatgtctttcaaaacactataataaaagtaaacatgcatttatttattgtatatattataatagaaaaataagatcaaaggtatatcttgtaaagcgtgtcattgtccaaagcgtccattaaaatgaaaccggagagagtactatctacagcccataaa

SEQ ID NO: 25984 - DNA, 978 bp, Oryza sativa
  unsure (1)..(978): unsure at all n locations
aatatgaaagaattacggtaatacctacaatcgtatatcatgcagtgagaaaaggagaccacagtcgaatgctttattgttgagaaaaattgatggcattaattttatctttttttagctgaatctatataaccataattaattatctcgtgttagtagaagtatgcatcttcatgcatcaacatatcatgagactattagtaatagccaagtacactgacccaacaatacttaatatatcacaagactattgagtaatggacaactcatctttaattgtactaatgacttagtatatcacaagagtaccaggtaatagacaactcatctttaattgtgctaaaccaaaaaagtaaattacagttcgtactatgtattcttaaaagttttcatattatgtcatcctttaaccattcttttcatttacagaacaactaactttacatttcaatttggaccaccctatttcaatggcttagcttgactacccatttagcaatacggccgacgacatctttattcctgatgacttctcccaaaggggaggaggagatcactatgaccttatgggcttggaagttgtggtgtagctttctggatgtcatgatcacagcgtagaatagtttttggatctgtggatatttagtttttgcatcgtggagggccttgctgacatagacactgggtattgtactctttccctctctacaacgataaacgtactcatagaataaggtgtggcagtaatataaatgaataattcttcattattttgtggggcaactagtccggggggtttgacaagtagcgtttgagcgcaatgaacgcgctctcagcttcttgggtccactcgaatttgtcctgcttcttgagcagggcgaagaaagcttgtcctcgttctcccatccttgcgatgaaacgacttaannnnnnnnnnnnnnnnnnnnnnnnnnnnnnnnnnnnnnnnnnnnnnnnnnn

SEQ ID NO: 25985 - DNA, 1821 bp, Oryza sativa
cccgctttcttcagttctgatcagatactcaggattgttgtaggatagattctatgtagttttctggcgatcttctttcgttagatacagtagattatctcaggtatctgagatttgagatattgtggttttctcaacattaaatgtttgagaattcatagtgggtggtttcttcaatgaaacaacgtcagaaaatccatttcaattaccgatattgccttgtttggttctgatactacttaaaataattgcttccagtagttcagtgccagatttacttgagttggtagctcagtttgtttatgttctgacttctgatatctactggttcattgcagattttgttcctgctggatttctgaaattttactggaggactagagatatcaagacaccaacaacaaactagtacaaagttttccttccagttaatctgttcctggatctccttgccatacgcgaagcagtggatactatgcagtaattggttaggaggtctttactgaaccataatggctgatactccaacttcccgaatgattcatcccttcagcaatataccgagccaaaacctgaagcagttccagtattctgataatccacagcacccttgccacccttatagggcaccttcagacacccacgttgtgccacatcattatggcctaaagtcacattcaccggatgctggttatgaaagccaggctactcctaacaagtacacattggactcctctgaaggtgctggttgtatgagacatgattctccttccagtcaaagtttcacaaccagaagtggtagccctctatctcaggaagacagccactctgactcgactgatggatctcctgtaggcgcctcctgtgtcactgaggatcctaatgatctgaagcaaaaactgaaggatctcgaggccgttatgcttgggccagactcggaaatagtcaacagccttgagaattcggtggcaaaccaactttccttggagccggagaagtgggtgcgcatgatgggcattcctagaggcaacttgaaagagctactgattgcctgtgctagagctgtggaagagaagaatagctttgctattgatatgatgattccagagctgagaaaaatagtttcggtatctggtgagccacttaagaggttgggagcctacatggtagaagggcttgttgccaggcttgcctcctctggcatttcaatctacaaagctttgaaatgcaaggaaccaaagagctctgaccttctgtcttacatgcacttcctgtatgaggcctgtccctacttcaagtttgggtatatgtcggcaaatggtgctattgcagaggctgtcaagggagaagacaggattcatatcatcgacttccatatctctcaaggggctcagtggatctctctccttcaggcccttgcagccaggcctggtggaccaccaactgtaaggatcactggtattgatgactcagtgtcagcttacgcacgaggcggcgggctagagctggtcggaaggaggctgtcgcacatcgccagcctgtgcaaggtgccctttgaattccacccacttgctatctccggcagcaaggtggaggcagcacatctcggagtcatccccggggaagccctcgccgtgaacttcaccctggagctgcaccacattccagacgagtcggtgagcacggcgaaccaccgtgaccgcctcctaaggatggtgaagagcctgtcgccgaaggtactcaccctggtggagatggagtccaacacgaacacggcgccattcccgcagaggttcgcggagacgctggactactacaccg

SEQ ID NO: 25986 - DNA, 6115 bp, Oryza sativa
tcgcgtgcaaggggaagaaaaggccgaatcggtacgagcccttcggcaagtggaaggcgcgcctcaccatggccgggttcaggccgtcgccgctcagctcgctggtgaacgccaccatcaggacgctgctgcagagctactcggacaactacaagctcgccgagagggatggggcgctctacctcgggtggaagagcaggcccctggtggtctcgtcggcgtggcactagcgttgtgactttgtgaggtgatctgacgacgaacttcccttgtaaccatcttggctgggggctttagaaagctatagtgatcatggactggtaagggtagctgtaacaatggtgttgtaatggtaaggtagcggctagggtcaaactcgaaaatgggcaaaatgctgatgaggtgtagaagtgtagtacatgtttgagagtatatgtttcagtttttcttttaaatgtcttgtagtaatgttgtggcacactaatgtctatgatcagaattatcatccactataagctaaaatatccattggaatgctggcaagtagagctgaaaatgtagcatcatgtttcaaccgggacgaatccaacggtccgagcattcgtacgtgttacaggtatcacatttgcatatctttactgccaacggcattgtacatatgcagtgagatacaaagctttgtcacaaaagagaattagacaagctcacaaaaccaaatcaaccataatccatgttctatccacattccactgaaggcgaagatagttaaagaaaaccaaattctgatgatctaattaatcttaacgggttcactgtacaacgaatatagggccagtgccacatacaagtatacaacaaggcctttgccgctccagaagacccatgtggtgtattttgctgcagcccacaggtacagctctcgcctccggttcaactgatgtgtcaatgataggagcatctttctgaagagaatgtcaatacgaagcattggtaatatatgattctcgagctataagcattagtatagactctcacggacccatgactaaattgccggcggtactgtagcataagttagccgaatggtccatcggtgtggctttgaaagtaaaaccttcactaggtttttcttctctcgaaccatatatattgctagctgcattgccagccatagtcggcattgccattgctggaagtcccatattactgtatactgaacccatgggctgcatttgatactgcatctgatcagaaactgaggactgcaattggtttgtggcatcgctgtggttcgggctgattccaacaccaagatcaaggctgatggtgtcactttcagctgcttgagaatattggtttggaaatgtcctaggttcacatgctctcatcatgccaccaaggccctgcatattgctgttaattggatggacaacaggcttcatggggggagtggacatctcatggctcgcattcctcgacgcagggacttcatggttatgttttccttcatatgttgttatgactgattttggatcatgtgatgctctctcaacatgcttcctgactgggcatcctgtatttgtgcacttgtagtaactcctgcaatcatgaaataaaatgaatatacaagttgcatcctgtatatatatgggttatggacacatacacctattcaataagtgatggaaaatatctgattatattgaaccattagagccttaagagaaggcctaatttccaattaagtgatgcccggcatcccagtcttagcattaagcccctacagccttactccccagcagtatcaccggacaatccgacacacatgttttacaaatatgtataaggcaaaaaaatcttatctttctgatttaaaataacatgaccagaagattattgaacattttgttgttactgttaaaaatctgttgacatgtcagagaaaaaaagaggagaatttactaggagcaatagatgaagaaaataacaactaaccgtggattggggtttcctttaactactttctggccatacttgcgccagcggtacccatcatccaagatgtcaacctcactaaccgtttgtactacaacacgaggctcacggttaggcttgcccatcaaagcagcatcaatagcagcagattccattttcctgtttgaacagttgtaaacaacacattcagtagtataaatgggtgattctcgccctagtgtgtaacaagttcaaatgaactgcaccttcgttttgactctaaatcatcatcctcaacagcatcatctccagggtaaggtctccctcctccggcatcattgtcatcatcactagctgagcctggaacaggctcaatcataccagctgtatgtactgcattaccaagaatgctaagaacatttgaagatttgtctgcatataaaaacataacatttaaaaatcgcataaaagaacacaacaaaaacattcatccatatcacacgacttttccttcggtgtatggactggcaaaaatataccagcagtgatgtactggagtgcaaatacagctcagaaaactcttatcaaattttgttttgtatgttacaaaaaaaaatgattggcaggttaaaatggcccgtggaattcaactaagttgagaaaaaaaaccacccaaacgcagtgcacagccaggctgcactcaacctcatgcaggggagttttttggtgcaaaacctgggttcgagcttaggtcggtgactcggcgtccccactattggaggctctaccaccacgctatacgttcattcgctgttttatatgtcaaatcattcatttttttaagaatctaaaggaatatgaatcataattctgcaagaaattcttgagaagcaataagaagttcagagatgacataaatagcaagagaattcacaaaaaaaagggggggaatcagatccaagaagcaggaggtcaagctgccaaaccagagggatccagcatcagtttttaaaacaaaggataaaaccctcaccatcagtagttgccacaccatcatatctttcttcaccctggattggaggaactgcaccggcagacagcctcctattgggttggggcttagggtgattgtgacgccctttataaaccacttcagtaatctgaccatcaagcgaacgctccaatagcttttttacatcacagttaggatgtgtgcacttgtaatagcttctcgggttctcacttcccttaacatgcttttgcccatatttgcgccagttataaccatcctctgcagacttttcagccacactttcaggctgtgactcctgcatagcatttccagagctattcatctgatgcaactcagatgtaccaacttcagcaggtgagctgtcagttaaaccaaccattccaaccagttggctcggggcacttgaaatattgactgcgagagttgactcacgagaacatagaggtatattgtcgatcatcatatcgtcagatgacagggcagtattcaggctttcatttttcatagaagtttcatgctttttgggatcattgatagcagaagcctacagtacaagacacgagtacagcaaaaggttatacaatgcaaaactaagtacaagagaaaacaaggtgtagggaaaaaaaggtaacaagggcacaaggcatagatggatcacacaaaatatgtaatgaagtttgttttccaaaaaagaatccaccattacaagatacttgtctgtacttgtgagaactaaagaagaatgtggaattcggttaacaacaaaatgcagaaggacctgatttcatgaacatatttttatgttaacattaattattctaaagctacagaactcattagattggtccattcaattacttgtattctgacctcaaattttcacatacttctataaatttgcagccagactagcaccactcaagtctcacctagcaaggaaatattgtgtctgttataccctattctcatgatctcaccaaagatctcatttctcctttcacaattaatagcttgtatttatgttgcaagaccctgctataatcaaatcacacaataaagtcggtgtgatcatttattagacttgaagatgtaaccagatccatcccaattttggcactgaaatttcaagacaccgaaccatggactagaaataacacagcctacaataataataaaacgaatttattgtactcctggtgaggtttgcgattcacgtgagaatattttgaattaaacataggaaaacttaaatatcaaaagctggaacctcagatagatttaccaagtaaaatgcaatatagatccaataaatagcataccgtaaggtaacaactttagatcatggaaaggaagttagcataagcacattagaactttacactccttttatgtacatccccaatataaattccactgttttggcgggaccatttgtaaacaacaaatgttattattttctatggaaattttttcaaactctcaaatacagtatacacaaatgaagaattacacgataccaggtaatcactcaaagaaaggatccataccgtcgattgagaggatgaattcagatgaggcttgaattcaaaatctcgagagccaccatcttcatgggtgctaccagatgttttatccctaggcgaaggaagtatgtctggatttgcactcttgttcataattgcagccatgctcagagtaccagttgtcggagagggttcaacctaaacagggaaattttgataattagtttgcaagcaaggtaagcataatctctataattttttgaacattcaacaatgcgcaacagtattacagtgtacatgttgaacagtaacttgcagaaagtatttatgtcatgcttagtacaatacttatgcctctagtatgaaaaattatccagaaacacttgtcaactaaatgttaccttcataaattcttcatttaattaaaacctgtttgccaagcatccctatgttttggaaaaggaaacatcaagaaggtcggcaaagtaacgaaggaaccaagagaaagcaagtgatatgaagctgcaaacaagcactctatgctcagcaagtaaattccaatttgtgggttttcaccgagaagaatcagaaccgccaatacaacacctaaggccagacccagcactcgatatcagtgaagcaatcatttctaaaccaagcctataaactaactctcttgcagtgcttggtgcttcccttacgaaacagcagcattccttagcatgcacaccaccagcacaatagcagccaaagccaagggggcgtttccttatgtaaggccctttgaggccgcaacaagaaaaatgccacatgatgatttgttcccccgagccaccaagtgtgtgcagcacagaataattcccccgaaacgcacaaacaacagctcccacctcactccacagaaaattgacggcgcaggggcgccccaaaaggagaaacagagcaaaaacaactatatccgcgcgaaccccgccaaaagtcagttccagaaaccgcaaggcaccaccagaaatgcgaaagcgcgcagcaaaagcgcattattccgacgccacgagccaattccgcggtgcaaatgtctcataaactagaagcataaagctaatgcgcgcatcggaatccctcctttcccccccgacacagattaatcccccggcacgatgcgggcgccgaagaaattcgtagatcccgcagtaactaggcgcgaggagatgggtgggtgatagctacgctacacgcgcggccgaggtacacagctcaccttgaagttggtgaggaggacgggggactcgaggagagccgaggggctgaagcccgcggggatggtgaggcagggctcccgcgagatcggcagccgcgcgggggacatcgccttgtacctcgcccccgcgcccgccgcgcccggggtgagcgccgcgacgcgccgatccaccgggggctgcttctccggcgacccgccgacgcccgcggggtggtcaccggagctagggtttggcgaatcggccattgctgcggttgcgctgcgctgcgtgggaagctgtctcgtgagagtgaagaggaaggagggtgaggtggtggtggttttgga

SEQ ID NO: 25987 - DNA, 5868 bp, Oryza sativa
  unsure (1)..(5868): unsure at all n locations
cgagtggtttggcttcatgcgtcactggagtgtgggcccccacgtggtggtggtcccagctgtcagtgaggtgtttgcgttgtttgtgtagggggtggtgggtgtggctgggaaatatggtgaaacaagataaatgtggtgggtttttaattcggcgtgggatgcctgtcagagtaccccatgatctccttgaaattgaatgagaacctgaggagtggtgaatctaaattgaatgcaagaggccatattgcgaatgttttttactttctacatgcggttaaatttgtttcgtcatatagaagggaaatatttgaatgctggtgcctaatactccctgtcatagatattttgtcatttatgataagattttattcatattttaaaattacgaccatagtttagtgtaagaataaaagaaatagtatatatggcttccattttttagaggggcgtgatttatatctatagtgggatatgtgtatgtgccttccatgcaattgaacaattttagacgtctctcatttgtaaagatgtcgtgtcatttgaagagatttaggtcctgtttgattcagtttatgattattataatctggattgttagaagtaaattgaaacaaacaaatagcttattatgatagattattataatctataagcacgatttctataatctgataatccactctaaaggtgcttttttagattattgggtggctaacaactaacaaacaactaataattcagagaaacaaacagttaacaacttattctatatcggtttattataatctagcttatagtaatctagctcaataatatagattacaataattttaagcggaaacagacatggccttatttggcagcaatgtaaattaaatctgactatgtccattttcagtgggagtttcatcttgtggtttcctatagtgctacataatctaaaaatatgaaacaaatgtctcaaatgcataatttcattttcgtgattttatattcatataatttaattattgaatggtgttatgaaactatttggtcacagtggggtttcatttccatcttttaaggcataggataaaataattcagtcccaattgggttttattcggtcttcaagcataggtaactgtataaaccaagttttgtttatatgttcattctttatctcttttaataaaattcatggcatgtcatcagtttagtctatatggcatctcatttaccgagattaaaactcaaatgaaacttgcacagtgaatgagctaagaacacgcctgagagagagagagagagagagagagagagagagaatgatctggcagggaaaaatcgaagaaaaacttcgaggaatctacaaaagtcttgggccatcagccacttatcgtattggaccatacaacctcaaggttcactcgtgtacttgcattgggccatacccgttgttgcctaacagcacatggcccacatccctcccgaccgtgcccagcccattcaattgttccgtaggaattgatctgcaggctggtctacaagcagacgagccgttggaagatggtacagagctgacgggttcctattttctactaacatgttgtttcggaggcgagaaatactgtagtacctcctccatttatttccgtatgtgatcagtgatcggttggttaagcagacaaataggctacttacattatgtgtgttaatatgcatatgtaacagtgtagcaagtcttcttttaagcatttttattaagtacttcctctgtcgtatattaagattatttttagctcatcccatttatctcaaaataaattgatttttagtaataattatatcaaagtttataatagtaaagaataattgcattggaagtagataaagtgataaatagttatattaagatgagataaagtaatgatattttagtcttttgatgtttgtattggtatgtgtaggatgagtgaacaatgaacttattttggaacatctgtattactaatatgtatttgtactaatttttttaccaggtatgcatatgtaaaaattactccctttattttaaaatgtattgagatacatatagatataattatcttctcaaacaatcttttcaatattatactttaactactactgttttcttttgtttattatcaatacctacagaatcgatgccatataaaaatagctaaataaaaatctaacaatactactttattatataatgatataaaaatcaaataaaaagtcataacattaatcacatatccaatcctgtacttttaatccattcattagacaagtttttatgttttgatttttctcaaaataaaaatgccttatatattttagaatagatggagaaacaagttagtattcctttatcatacaataatactctattgtcataatatatgacgtttgttttttcttgagcaaactttcaaaatttttcccatcaagaagatctcaacggcagggcaccgttggcctgacctatatatacacatcttttaaacgggtcttaagagccacgcaacacgtggcttatgtggctagtttaaaataaagctacctataccgcttatgttttgtttcacaagtaaagatatttatccatccactctctcatctcaacctattataactattcttattttaatctccatttattttttttcacatactttttctttttaatcaaccgtaactaatacatgtatctaactttaaaaagataattgttacgagtacaataaaactggaacgattttagtactatactaaatagtatggttatcgattgggtggaaacatcttggatcgcatatttaccgcatgcatttgagactactaagtatcgtcctctaatagtttatagcatgcttttttttaaaagaaaatgtttatgttttaggatggatgaaatactatttgaaaacacgggaggaataaaatcaagtcttgtaccgaatcttttgtgcactaattaaccatgccacagaaaatttgacgagttattacacccagaaacgatgtagatccgcctgcaagttgttgcttggtcattagatacagtccaacgaattgtgcagtgtgtactggtgcggaggctatttaaaccgagcccccatgtgttcaagtacttgttggctttgttgcctcctccatgaatggtgaaactctcttgtcacgagacattttgctccaaaaagtcctagtttatgagtatcgggttgagaaaatccacctcgatcatccaagcttgcgaaagcggaattctttttggttgctcaaacctacaagtccatgctttttttaatgttattcaccgaattatttgctcaatggttttatttagaaaatacagcttctaaaaaattccattatattacatttcctatacaacttggttcatttcttaaaatatttaatctacccatataaccagtagataatccgtaacaataaatgttcaataatctaaatcaaataggcattagattattcactgtattaattgctccatagttcaaaaattgcatttttctaaaaaaaattgtattattcaaactgcttattttaagctattttataaagttgatttaccaaaacatctacacatttaagttatgtttataattaagttgataatccacggtcaacgagatgagattgaaaaaaaaaaaaaggccgacgctagcgctcacgatttgtccaaattgtcgtttggaaattgttactccccttgttgcttggccatacatatcgtcttccgtagcaaccaatggccaaggggctgatgacttgatgggtctgtgtgtttggctgttgttcttccgggtgtgtctaatgtgttctttttagttaaggactaatttgatcgtgccattataaattgattatttattttcaaaataccattataatttgtaattttaatcgtgtcattggaacactttcaaaaatgaattataacacgtagtacgtgtggtacgcatgttgaagcgttttttaacttccgcatattcgaagtaccaaaacactctacctcacttccttatactccctatgttccaaaatataaggcacaaccaaccttaacccaaagactaagaaacaattattatcatctactagtttgaatcatcataataaatataatgcatgcatccaatagaattagagatcttgagggtggaggatttaaaaaagtaataatttaatagagaagaggttctaattaattgtatgcatgcatatatgtcttatattatgaaacatcaaaaaaagtagttgtgctttatattatgcaaccctaaccctattaaagcagcgatggcagcacataccattgcctgcatgtggtggcggggacgacgatgaggcacaagtctaacgatggtgcaagcagattagacgtggtgaggtgggggacggtaattgggcgcggtctggtggtggcagcgacacggtgaagtcggggacgctaagactgggtacaatagcagactataagtcagctataaacacattttaaagagataaaaaaaagagagaagagcaacgggctacatatctgtagccagctgcagcatgaactccaagacacaatgtgtgtatgacaggtgggaccatgcattaataatgtagtaagcaactattgtatgaattggctattacattggctatagatgatttggagctagtagttgtgagagcgctacgcgtcggacgtacggcgcgagacgaaaaatcggacgcctcgcgcgaccgtccgatgcagcacgcgcgcgccagccgtccgattggagaaacaactcgcgcccgacgcccccgccgttgcaacacctggacacattaactgtttcattcaatgtgtctgcccgttgaccgctagctcgaggggagatttcggtggcgcgactggcgctgtgctgccaccggcgattctctccggcgccggcgaccctatcccccacgcccctatcctcctcgcgacgccgacgaagcctacaacaacgccgacatgccgccacaccacatgccgccaccgccgccatggctcatctgatacaccaagttgagagggattttccgccgagctcatctagtgcaaatggaggaacaaccccaattcataatgcaatgaatttggtgagtaaaaaatttctagggttttgcttgttttacttttttttttgacaaagtttcaataaaaaattgaagcatagatctgtgaaacaatgtcttccctcatgcaacatttatattcatgtcttatttttaattttaacttttgtataaatttggactggaatttgacttgaacaataatccttaacttgctgaaacataactgtacaaactaatgaaacaaaacaaaatgttacagatcgatgtccaagcaccaagctcatctggtggcttccttgatgtgctattatccgaatccactgggcatgaaactgacttggtgagttgtccttggatttgaaacattgcaaatgtaggggggaaatattttgttttgaaaacacagtatgtaacttagtgaaacttttttgtgtactaggttgtagatgtggaaagtgttgacaacacagatgtggctgctgtgactgttgaaattgatgaacaattggatgaagatgcatctgaaaatgatgaagaagaaaaggatgttgtttattccccaccaattgttccatacattggaatggagtttgatacagtggaagaggcaagaaatgtttacaacgcttatgcttataagctaggatttggaacaagaattgcatcatctnnnnnnnnnnnnnnnnnnnnnnnnnnnnnnnnnnnnnnnnnnnnnnnnnnnnnnnnnnnnnn

SEQ ID NO: 25988 - DNA, 11258 bp, Oryza sativa
ccatttgcacccattgttgaaactaataaccacctgcaaacaatattgctgggatgtgctttgatttgtgatgaacaactgaaacattcatatgggtctataaaacatgaatgcgagcaatgaatggacagaagccaggttcagtgatgacagcccgagataaagcaatgagagcagcgattaaaaaggtgttccccggtacaattcatagatgttgcttatggcacgtgacaacagaagcagatcagcagctcctgcccgtgtatacttcaaagaaaggcttccatgaagctttgtatagatacatatatgactctaaaacaatagcctgatcccttcattcaatgaagcagaatcttgagcaacaccatcttgggcaactgttaacaaccaaatttggtaatatcagcatcgggaaagaaaattagatcgaagcaaagtcggaggcggagatcgagttcagaaacagggcaggaatcggctggagtccagatcggctacgattaggatcggctgggtctgagtcgggctaggtaagccgatgcagccgattccgacaatgcaacttggtgtatgacatcgggttgagttgaggtgtttcaaggtgattgccgcacatggatagagtcctgagaaggcaattgtatatattaattaggatgttttaggtaatttccttagagatatgcttgggcaaaagtctgccgcaaagacttatggtatcttagagtttgttagagatagtagtcgtgtccgttatggacatatcttgtaattttcgggtataaataggcccgagccctatgtaacttttaacacacatgttcaatacaatctcggcgcatcgccacccttttttgctttagttttatttcgacgagttcttgctttcggattgagctgcatcggtttcgatcttcaacaagaggtaaaacttgttatggcggcttgcgttctcgggattagtgcttccatttttatgacactctaatcttgtttatgtaattcgtcgagttatcatatatcctacataatccttggcaatatcgatatccaacctacaatcggctaacatccgtcaatagaaggcagccgattaggttaaataccgatgttgacttagataatataggatatctaccactctatgacatatccaacggcttgattgtctagatattgtccttcttttcatatttatagctgcatcagttaagtttgatcttatgagtcgtgattagaatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattaggcttttgtttagtatattctactcgctttaatatcttaatatagagtggtatcggagtattagccgatacatgctagatctatctgatcggctatgctatgaacgtatatagtctcattattaatatatatttcgatctaagtgatttatactgtctcggcatggcgaccgatctatctcaatcacttgatttaagtatatatcgatataaagattatatattggtaatatctgcagccgatcgagtagattcagtccttccttatttattaatgactgccgatcgatgcatatataacatcggctcaaagataaatgatatgtcattggcacctagccgatcggctatcatttatagatttaactgtgatttctttgcttctatttcttgttcattacatgatcaaatcaactggcacgctcatacattcgaaggcgagctttggacctgcactagagttaaacagatctcccaggcctcgtgttttctgtcaacaacaacaccagccccaatgcctacaccatcttgaccagcaccaattggaacatcttcagcccttgcaaccctagcattctcagcctcagacccaccagcaacaacatgaacttgggctagatatgggatctcattctgtggacggaactgaagaaataaaaagatgaaacatagtcttagtaagtggtgaaacacaaaatgtatatatactaaaacattcatagttgtgaaacataccgggcgagacccatatgtgacatagccaaggttcatcctacaacggtctacaacaacaatatactcaaagtcctcatcagtgacatgacaaaatcttggtgtgctgtagtcaatgatgcggagatgcagtccagttgttggcatttgcaaatgatccatgtaagcaatctaaaaaaaaggcatttgatataggtagttagcaggagcatattggccaaaaaatatgaactagaacatatggcagcggtgcatgaaacatatcatatgtgtaatatgaaacaattgatatattttgctgaaacatatacataggtaattagcatgctagactgattatttactgaaacatatgacaacagttgtgtgaaacaaaacatatacgttaaatgagacaaatggatgtattttgctgaaatattggatcaagcacatgacagtgaaacaataaaaaaatatatatagcaaggtgaaacaataaaaaacttacaacaagcaaggggaggcactctccaatctgaaaaatggaatctcgttgcttagtagagaatccatgatatttcttgatttcccgcatcaaacagctcgccacatatgtgcaccaatcatactgactccacatctggacatcaaccaaagaatgcacatagtcgagattcacataattgccagtggcaggacacaagatggtggcaagcaggtacaaaatgaaagtcctcaagaacttctcttcatcatgcagagaaagcaacaatttctcgcacatgcctgtaccaagtctattgctgacaaaatatggatggtacagggtcctgatctctttcacaacttcactgttggcaccactaagcttaacaggtagatcgccatcatttagcccagtaatcttctgtactaacaacttatcaaacatgataaccttgccacggaacctaaactcacaaatctctgggttcatcttttgcataatccattctgcaagtcgactatggaccttgaaattgcttagcgatagaaaagattcaaagtcattatctatgatgaattgcttttgatcgggttccaactgaagcatagtgcgcttaaacctcacaccaccccatctatgcttgaagttggaaccactacaccaatcaggcatccttgaaaaaaaacacacagaaacaaagtctgagacaaaaatacaacatgtgctctgcaacaaaaaaaaatgtgtgtactactatgtaaaacaaaccagggaatactatgaaacataatattaatgtgtactgcaacattgtatatgcatggatgggaacacaaaaaaacaacataaacacaaataaaaatgaaaaaataaaaaaaatgcataatagattatcacagtgcaaaaatggtaaaacaaaaaaaccaccatatgaaacaatcacagtgcaaactcatattatagattatcaattatatctcataatagatcatcatagattatccttctgtgacaaattaatgtaactaatagagcacaatcacatctaggagaccacatgcaacacagacaataataaaaaaaaaatccattcacatctagggggaatctcataaatgcatcctcatagattatacctaaaaacattctgaaaaaaaattaatgtcattactagaacacattcacatctagtagaccaatgcaaaacacaaaaaaaaaagtcaaaaatcatttcggatttgagggagaaagcatggggtagcaaggtgtgagaggggtggtaaggggtgggggtggaatggggaacgggggtaaacgaagccctcacctcaacgctgggaatggagacagccgccgccgccgctggtcggaaccgcagcaacacacagccgcggggtgagtgtgtggtgggggtagagccgtagaggggaatgcgacgattggagaagccgctgcgacagcttctagcttctccagcgccgcctcgaacatcgccgctgccggtcggaaccgcctcagccgccgccatcacctacccgctagacctaactccaccgccacctctccgcgcgctctatccgattgtgttggagcggttacggtggaaaaaagggaaacccagctgtttccctttggatgttgcaacgggctaaacgcacggagcaaatctcagccgtgcgttctgtcctaacggatcgaacggctcgcgcgtgcgtctgacgatgcgcctcacatcggacggccgattataagcgttttcgtagtagttggctatactattaaacttgctctaacagagcgcaggttcaactgtggaagcaacgtggcgagatcaggcggtattcatcgacgacgatctctccatgagggaaaggggaccctcccctttataccgtgttaattatttttacctagatttaactatttgtaatttgatttggcgcatactgcataaaaacaatatcctctttttaaatggaagcaaattaatttgcaatatccgtctagatctttttggccgaatacaaatggagactatttttcttccattatcttccatatattactttttgcccatatggatctgaaacatatgcaggggtgttttggtttatagaaagaaaatagcaattaatggactatgtattactctctctgtcctaaatataaatataaagagattttggatggatatgatacatctaatacgaatctggataagaggatgtaactcatgaaactcaaaatttcttatattttaggacggatggagtagaatttgggaacatgttatttctatctttatagacaccacttatatggtttatatgttccttatctcctgtgctgtgaacaggaaaaaaatgtgcattgcacggtgtgatcaggacgcgaatgtgaaaaagaaaagaaaagaaatctctagaggtggacccatcagtgttttggtgtacctgagttatgctaagagcaaagccggccccttattattattaaactcgtattcgtatgatgatgtggaggagaaaagaaaagagagaaagaggagaagccaggtaattttcacacatacttcaataaatgagagagaaagagagtactccctccgtaaaaaaaaaagacaaaccctggtttccatgcccaacatttaaccgttcatcttatttgaaaaaattataaaaaaaataaaaaagacaagtcacgcataaaatattaatcatgtgttatcatctaacaccaatgaaaatacgaattataaaaaaatttcatataagatggacagttaaagttggacacagaaacctagggtttgcctttttttaggacggagggagcagtggattgacatactccaagtgtattgggagtagtgtaaacaagtacaatctattgtaaattaatgttactctctccattaaaaatacttaggattgaatgtatcatatcctaatacaacgaatttggactagatatatgtcacatccaattttatgtttgttttttatgggctgtagatagtactctctccggtttcattttaattgacgctttggacaatgacacgctttacaagatatacctttgatcttatttttctattataatatatacaataaataaatgcatgtttacttttattatagtgttttgaaagacatatctatatatgtttttctaatttctttaaactaaatatttttaaagttattgatggttaaagttataaaagtttaacatcaatctttttctaaatgtcaattaatatagaaacagagggagtacatgattacctactctgtccagtaaaaaaacctcaacctagatctggacatcccatactaactaggttggattttttttttgacttaggaaaaaatatcagaaaacctgctctaaaccggcaatataccaggaaaatccgcagcgtcttgccgaatggaattaaattgttcattcattttttttctcaggaatattcgggatacaaaattttctacagaaatataccgtcggtctcgcatacgcgttacgcgaaaataacgtggaataacgtcgcaggcggtatcgcgccatgaaagtgcgaagagaccgttcggtatcgctgaagcaaggagcgatactggtgccatgatgatttaattagccattaattaacgaattaattaaatcactgatcaagataatttatcattaattattattagttaattgttaattgagtgattaattactggagatattggtcagtgtatctgtttgatttcgtgagagcgttcagtctcacattccgcgagacattttcaccgcgcgatatcgtccacgacgtcacgccttcacagaacggttatgggatatcgatgttatatttttaagaaaaattgtatcacgaatatttttgagaaaaaaattaaataaacagtatattttcaaatttgactatcgccgaacggcgatggtatcgatcgattcaattcccaatctttggtttgatttccgcatgtggctttgcccactgatcctccagacctccaccaaccaaccccaaaacaaccggcgacgacgaaatgacaaaataaagaaaaaagaaaagtgccgtcgcgtacgaaggcaagctatctacggtcaccccctataaattcggaaagaggcgagcgaaagacgaaaaaaacagcccgaaaacagaagcaatcgcgacagagaagaagagggccattcccttcgtcctcctcgtcgcctccgctttcccaatccaccatctccccccacctaaatccatcgaatcatccgcccccgaattccgccgccgacgcggtcgatccctccccggccggcgcatggggatcgggcccaatcgccgcctctcccgcccctcatttggggttcccgggatttgacggctttttgcttgcttgagcgcttgcttgctgattcgatcgggtgggaagatttccgtgcctgcctccggtggtggttcgatcgggcttgggggggattgatgggtttgctgttcgtggagtcgctcccggggccgaaggtgttcaagtgcaagttctgcggggtggactcggcgtcgccggacgccatcgtgtccaaggagttccgcggccgccatggccgggcctatctcttcgacagcgtgtaagctgggctatccatccactatttccatttccccctctcttttgattattgcgtttctatgcatgacagtgacgcgatcgtggcaatgtcgctgtcctggaaaggattagcgtgtccatggacggggaattgtggaattgtcttgtaacagtgctgtttaatgatggatttctcgcgtattgttgttttgggatgggagggaaaacggcggtatcttatattggtgcaattaagctagattgcaagcgttcggaagtagattcatgatgtggttgtgttggatttgatcagtactgcgtggctagggcataagaggctaataagagctatgcaaattatgttccacatgataaattgtcttgttcttaatttttttggtctgtcaatctagacacagatggaactgataggaaatgccgaaatgttgatggctagtgttaagctacagagctatagtttggagattaattagccacaatctcttgttagatattacatgatggaaaacaacatcatgcttggtaaagaatgaagatgaacagagcaaggtgtgagttgagaacttaattcattgtagctatgtcaatctgatatgttgcaaaggtggctcttatcttaaacctagtaggacaagggttcatgtactaatcctaataggattttggttcctgcttctatttggactatgtatgccacaatacccaatccagtccagtattgctgctcacaaaatagggtatcagagtataacatgctattatatagtttttcttagtctatttttcatatctttgtaactgacctactactggatgttaaaggcatgcgaaggttatgttttgtgaaatcagttgaacatgtaaaccatatgttgttttctgaaataggcaagcaatataccatgtacttcgtttgtttaaatgaagtatccttgtctggcgtttatttttgtccgatccaacaaacaaacatgataattagggcaatgttgttaatgttgcatcaatttacatcacagtattagttaaggcataattggtcattcaaattgataatttgaacaaccactctcaaccaattcttgtttacatgttgatccggagtgaacatgacatccagggtgaacgtgagccttggtcccagggaggatcgccttctcatgactggattgcacacagtgaatgatatctattgtagctgctgccaacgactccttggttggagatacgtaagttgccagtttccatgttgtttagtgagaattcatttgaacactacaaatgtaggacggtctatgccttcatgatggtcaacctgttaaatattcgatactttatctatatctggataagttaatgtcctaacagaagactgtgagagatttgactaacttttcttattgagcatgatcatatagcattcatgtcttttgaaacaataggagggtagagtttgctacataatgtatgggaatctccaaggcataacctctgcatttctggggagcacataactaagaattatgttggctatagattgcatttttgctaagagccaatgcattaccttatgattcatgggcatcgactggttgtcagactttctatttcctggatctctttcgtgttatcatttctttgatgtgtaaaactctattaatactatatgccttaattgtgaggcaaaatgggcagcaggatgtggctatgctttctgacacaagacaaacatgatctggtttttttgtttcctcattttcgaaatttgatgttgtcagttgagaagatgcatgatgaatccatgctccatggtgcattaccggtagaagtctaacaagctatcactccctctacaaactcatctatgctcgtaggcttttctgttagatcatgtttcatgagcttccatgcggcactttatcgtttgaatgcattcttctgcaacactcaaagtaggtagtaatgcttagtgttcaagtcgtagcttaaacctgggactgtccagatcttaataatatataccgagactagtcgatcactaccctatagttctgagctttataaattaagtacacctcattttctaccactgtgtagtttatagttattttttcctggtgaatttttttttggggaaaaaacaatatgttgcctatgttatgtggttgggaacatctagtccatagtgggtcttttcagctaaggagcatatgatcaatttgttcctccatttctcccttagttccatggtcaggctgccctttccacaggaatcttgcaaattgttaacttaatatgagatttttattgtttggttgcatttgtagtgatgatttcctccaggagcattggctggatgttccttcatgcatgactaattatacctctaaacacttgctactgccagatggactataagaccaatcctgggtcatacacacttgggcatttgatccaaatgtcagcaagtatgagtccataagcgtgaacgaacgaatatgctctttaatgttcatgccatttctctcatgaatgttggttattttttctggatcagtcatcatcatgtaactgtgctcattgaacaatatgcaggagaaagcttatagtgaggaccagaagtacaaagaaggcaagtatatattagagaagcacatgatgctgaaagaaggatagtgattggaaaaccgctgaactattaagtctgcaaatgcaggcatatgaaaccatgtaaaatatcgctgaatattgggtttcaattctccccaaaattgattatctggcgaggaccatcgtcattaaattgcatttatgaaatataatgtcatgtgaaatccactgttctttcagctgaacctctgaaaacttcttgacagtttgcttggttaaccccattcatgaaagtttgcgaatggggagacggttcaatcccattcttgacatttgtatattttgatctcaatcgtcttaaatggccaaggatgggattgagttgcaacctttgactctttgaggcctgtttggtcggacggattttttttttcgcgaacgctctcataggcttgctgcctaaaattgaattcctacatttctaacaagctgcgagcttggtcagattagctcgaaaactagagataaagttaatgtgttccctagcatttctattctgggaatgaccgcatgagcagaacacttggcacaaatgaaggaacagagcggagaatcggcacgcgccgcctgctacgttgatgcatccaaatggctgcattctccgagacgaatcacgccgaaacagcgatcagatcgcgacctgcgtaagtcaaacagcgctaccaacggataagattgtaggattaccgtctgataaacgcggactgcacgttgtgcatatgtcactgcttagctagctagtaggctactccctccatccccatatgtagcaagcacatattaggactacgaatttggatatatcctatgtgactatgttcagattcgtagttttaagacgagtctaattcatatgttcagatttatagtcctagaatctatcctagattgttatatatcgggacatatgagggtgtagtactttggtagtgtttgaatatcctaaagatgaagatgaagattaagtgttttatacaaaacgaggttataataatgtgtaattaattgagttttaattattctaaacttaaaaaatagactaatatgatattttagaacaattttcatatagaaagttttcgtacgaaacgtaccgtttagcagtttaaaaagcgtggcacgagtatccaaaatttaatccaatttttgttggagaaaagaacatggcctttactccattacttgaattttcatctaatatcagtatggcgtaaagtattcgaaaatccctggagaatggatgagcatttggtatctgtacaatcgcctatgagtctcctctgagctgcaccatacccgggctacctcaccttcgcctttctagagagcactggccgtcggcttaactaact

SEQ ID NO: 25989 - DNA, 7364 bp, Oryza sativa
cccccccacccctcattactgcatccagtttcttcccagattagcagatttgacaagctcacctatcccaaaaatttagggctagaattaattacaatcaaaatcatgataacgttcgatctgctagactatattaggagcaaagcaatagcttaattaggcctttgaactgccatttttctttttcaaaatgaaatgtttgaaaactgaaatggtattcaaattttgaattggtagacggtggttggagggagtataatttattggctgttgaaatgtacaccgaccggggcatcacggcattcgggggattagcgggtggctttgccctttccgcctcttttccgtgatgacctgtagtagtagtagctctcggtgtgtgcatgagctgcacctttcgaataaaggaagggaacacaagtgagatgcacgctgatgcgctctttaatttcacactagttttcccaccccttcaaatcgatcaaatcgcgtgggcgtcgcgcaattttcgcacgccatgcttgctttcgcttgtcgctgtctcgcgaatcgagtttggattggtcgtgtggctgacgacgacgacggctcgatcggcctggatcggtcgatggatggatgcaggtcaagatcggggacctcgggctggcggcgatcgtggacaagacccacgtggcgcacacgatcctgggcacgccggagttcatggcgccggagctgtacacggagacgtacacggagtcggtggacatctactcgtacgggatgtgcgtgctggagatggtgacgcgggagatgccctacgccgagtgcgacagcgtcgtgcagatctaccacagcgtcacccggggcgtcccccccgccgcgctcaagcgcatcagggaccccgagctccgcgccttcatcgagcgctgcatcggccagccccggaaccggccctccgccgccgagctcctccgcgaccccttcttcgccggcatcgacgacgacgatagcaccggcacgctcggctagcctgttaaccagctgggtagtactagaaattattgtatgtgaattcgattggaaacaaataaacgttctaaacgaattaagctccagcgagtagcaaatgtttataggttcatgtctcaccggcgctcgagctgtagcctgtagctttggatgtggttaattagtggctagtactgtagtatttattgtactgtttgttctttggtttgtactgatttgattcatgagcttcaaagaaatggaagatgaggagctgtatttggctttggctttgcgtgtcaaatgtgtcacaatcctttcaaaggatggttgtaaattaaaggtgtgagatttccatgagctggatgctggagtttatagttcaatactaaaatcagatggatgtagacgtgagacccaatcaatatctgagatatctcgggcccttttcctcttttgcgctgctctttttttgcttcaagcctcaggaaacacgacggggtacgtagcgtccgttgcaaacaggctgtcagacaacctgtacagagaggagacggctggcaaacggatagctcaattcagttgaaggaaagcattttccaccaaaaagcgcatacatgtcttctgcagttctgcttgtgtggagtagtggtagagcttgcggttatcatgttgccgttggacatcggatacagtggcaatgccattgccgtatccatgcacattccacaaattttggtgctcttggtcaagttcgttaggtgatggggtgttgtgtgtggggcatcgcatctgctgaagaatcattcgaactcagcctgttcgcacctatggattctgaaggacttatcctgctgtatctttgtttatcctcaattttctggatgtcagcttgttcgcacctaggagtatgtgttttccagtatctttggtcaattgtaggcattctaaaggcagatataaatgatttttacgggctcgattgggaggcctaaaatcctaatccgatccatccacaagggttcaagctcccagactcccagtccaaccacagggatgaacacgggggttctgggcttcccaaataggcctcctacatcttagggtagggtgccttgggttgtcatggatacatggaacatttcaagattatacacaactttttttatgagttgtatctataaggaaatttggttgatatagactaaggaggggcataatcttaagggaactaaagtcctttaccttacttgggtagttggactaaccaagacagtattattgacgctaggtgtactcatacaagtgcattttaatggcaaggaaactaatgacataaaatccttgactggattgataattgacttgggtagatgtcctcaaaggttttacaaaaaggaaaaaaaagttcaaaccccataaactattgcaacagtttgaattatcccgccttccccttccccaccaatcaaaccaaagaaccataaattatgaaccctaaactctttaatctggtcaaattaccccctaacacaacccagagcattttgatccctacatgacacacatatgacaataatttgcctgatgtggtattccagtcagcaactagattaaaaaagatctagtggcccacatgtcagtcaatgtctatttcttctctttccctttctctctctctaaccttctctttctctctcacaaaaagcctatggaagtagacttggaggtaggggcttgttgcattgacagtgtacttgaaactcgaaggaagcctcaccatgacaccggtgacctagaacgtagaggcctacggtgacgagatatgcctcctctccctctgttgtggccagatcccctaggtgaccaccaccattgcaacttgtgtcaatatcgataccttcagcgccacgccactgaccttctctcttcgtcttcctccttctccaaccttgtcaccaattttcaatagctcgcccaatgacggcatcgacctcaacaggagagctcaccatcgttgtctcctgctcaccacataccaagctccgccctgacgatatccgcctcaaccagaccaccacccacttctcgacctctagcacgtgcttagcgaaggcaagatctgcctccccgagctagcttgagttcctatatcgtcacccccacaagcttttgcagtggtggaggtggcttcacattcggacgcagctttacattctacaatgtcggtggtaagcttttgcacgggttagtgtgtgcttcgagaagagcatgggatctgcaccaggcggcacctacctacgttgcagaggcaactgcttccacacacacaaaggagatagatgacatgtgggttccttgatttttttttcttattggattgtcgcgtgttttatctcgggtcgaccgaccaatttgtctagtgtcaaaagttgaagggtgtgaaatgtatggcttcgcagttcgcgggtaatccaaactatcacaatagttgactgggtaagttggactttttccttataaaataagttgcattttgtgttgtatgtgtgcatgtgcgtcttccatataattgtgaaaaaagataaattacatgagaagtgcatgttttgcgaagatttctagttatgagagagctcattcaatcagtgcgagaaatacataaggtaattgactatatattgtattactgaagaataaaataaaacattcctttttctgaagggctataagagccgtcccaatacatacaacacaaaataggttgtatctaatccatgtaatctaagacaccattaaagaagttgttcgcctagtgcatagttgaacctatctaatcaattttattacccaatcccaattaatcacctaatgtctagacacattggaaacatgtctcaatactataaatttttgttggagtctccaggtgttcgacacggtcatatgcctcttctgctggatgatctggaaagaaaggagcacaagagtctttgaagccttcacccactagttactgtaggtcgcagattgcacaattgatgagcggaggacatggaagatggctggactaggtgcctagcatagcacaacagattggtaacctgaagtgtagcattgtgccgacgagcccaggtcatcaggcactttgccttggttttatgacagggctcgcttcgcatctcagtctcacgcccgatatgcttcatcctctgtgttttggctgagcatttacaaagtctataaatttttaccccctccctccttaatacaagttcggtcggcattctttgtcagcccagcgaaaaaatagttttgttggagtctttgtggttgtatttcgtaccattacttgttcttgcatctctttgtactaattgtagtgcaaattttatagtacttggcatgctatttaatgctatgaactctcaagtgaggtgaaatgttaactgaacaagtaataaatatcgattgttgtttgtccaagcgttttgctcttttgccattataaattttgattttttttacgaattttactatgaatttatggaacaacagagagagaaaaatgaaaaagtagttcaattataagcatacatgtcctactgtgaaactttattttcatccaagcacctggcggccccatcggttggctttttttctaataagccaaaacggtttattagggaataaaaataaatttgtaggtaaaacttttatatatgtgttctttgtaatttaaaagccaatgctgaaaaaaaatacgttgaaaatatcttaaaatcaatcttaaaattaagtttgaaaattcaaaatttagcttattctttggcttattgggccatccgatgagagcctgggaatggtataaacatagaattctatcactataaacatatacaatgaaacgacgaaaacagtgggcgaaacctttcgccagatcaatctagagtaaccctttcttttttttaactttaacctctgaccctctgagattgacagttcgatacgtaacgtttgccaattggagagagttcgtccattcctctcttgcattgtttctctccgtttcaacgacgcccttgggtgctttaatgcgatcaaaaatcaaaatgtgagtcacgggcgtgagaagccttgcagacccggcgtctccttctccgttgagctgaaacccaagcacgatcgagtcgccagtaaaaatttctcaccaccgatctcgatgcagtcacgagccacgaaaagaattcgggagatttcaagttttcaacgcatcaatgagaataagaattgtgggggattggcttcccgataccccccaaattccagagcaaaatattactggcatttgacgcccttaaattccccaccttctgcagcgtccgatgcacgtcaacgatttgattattaccgacattctcctttatcaatggcaatcttgccattgcagaacttagattcagaaatgcgctgaccatgccggtagtgtgatcgcacataaattacagcactaatcagctaagcaatcacacgaatgctatattctcttattttttaggttcctttttttttaatctgatagctacttctgaacgtcaggagaatacaaaggtgtcaatttgtcatggcaacgcaattgtcaggactcaggagaaacaaggttttctggcgaccacactgccattgcttgctaccgaagcttaaagaaaccatttcacagttccgagtccgaatgggagtctctggcgtgcatgcctggtgaatgatgaaacgcccgttgaaatgaactgacagtgaccttgattaatagtttgataatactatacttcctactatgatattcagagctccgtccgttcgtcaatgtgcacgcttgttttcttttaatctaaaagttgtgtggaagagcatctatctgcccaacttatgctaccggatagtgtacgatttggtcattataagtttctctgaaaaagaagcccatctagagagattagcagaggacagatagtctaatcataggagatgcttagtctcgtggcagttattatatggagattgttacctccaagcaactctttcagtccttcgctttggcgatgctagattgctaaccttggacgttttacgcctaggagtagcacacaacaatgaccggctgttctgcctgttcagagctctgaaagcttggtatgaccccaggcgcaaaaggatccagttttctgccatttggtgagaaatttggacaccccaatcagacgtcaactgtacactggaaacaccacactaattacttacaaaaccgagaatatatacacacatcttttcacacattagacattcacaccaaatggaaagtgtggcctccatttgtgacacatgaaatttttctcgatttctccgataatcgaactgattcatatgaaaatactgtatttttttccagaacacgtgcatataccaaaggccagatggtgcctgaagaggccataagccattccggccattagaggcaggttagctcgagcttaatttgcttaaactagtgctggctccctcggatctttacaaggctgcctccctgtgccctgtggtggcgaggagagagcagtgcagtgcagaggagaacgcacgcgcgcccagggaataaggaaacttgcacgagggggtggagggcgatccgatttcccagccttaaaactggggttcaactccaacgtcccccattcgtgcgccctcagccattgtaccccttttccactcctcccgatgttccttcctccctcactccaccactccggttttatactcctcctatctctctagtctctagtctctactgctactagtactggtaatctgcgagggatggagccggagatggaggtggaggtggaggtggagatgtcgccggcggcggcgaaggccgccgtgtttagcccttactcgagcccgagcacggcgttgctcctgcagaggagggtcgtttcatggtacagagtgttagagcttggaattttggagcccttgggggttctgatggttgggttggttgttgatctggattggattggattgcagggccaaggagaccggttcgccggcgacggtgagcgtccacgtcggcgacaggagcttcaacctgcacaaggttaggagagattgtgtgaagattaattagggattcttggttgggatgaggaggaagaagatggtgatgagtgtgtgtgatcttgtcgttgcaggatcctctggtgtccaggtgcgggtacttgaggcaggcgattctccggtgcggcgacggcgacggcgaggtcgtcgagctgccggcgagcttccccggcgacagcgaggcgttcgaggtgatcggg

SEQ ID NO: 25990 - DNA, 3279 bp, Oryza sativa
ttcctcgacgtgtccggcctcggcgcgcgctgcgacctgtacatcaaccaggtggtgctccatagctgggacgacgccctcatcgtcctgcagcgatgccagccgctgctccccgttggcgaggagctcctcgtcgtcagccgctgcgtcgagtcgctggcgttcatggcgtgcatggagatcctcgaccccgacggcgacgagcagcggcgcgagcgcgaccagccgggcctcctagccgccgccgcggcgcgcggcctagccgggcgccggtgggacgcctagctcgtcaaggagctcgccgcgcgcgacctttggatcaaggacctcgtcgccctccccttggagttcttcaggcggatcgtgctggcgctgcggcgtcagggcatgaaggagaagtacgtcagccccgtcgtgctcttttacgccaacaagtgggtgctctccaagaagacgcacaagttcatggcgagcacggacaccggcgacggcgagaccgacgccaacaggagggccaccgcgatcctgcagggcgtgatcgacctcctcccactcgagtcgtcggcggcgaccggcggcgccatcccggtgtcgttctacttcgcgctgctggcgcggtcgatcaccctcgagctcagcgacgagagccagacgaggctgcgcgaactggtcgcgtccaacctgcaattcgcccgcgtggacgacctcccgctgccggagccagagcaagacgccggcggccaatccatcgccggcagcccggaggtgagggcgatggagagcatcgtcgcgagccatgtctcaatgcaaagaagaggcgcggaggccgtcgcggagctctgggatcggtacatcgcccagatcgtcggtgacccgaagctccggccggaccggctggccgagctcatcggcgtcgttccggccggcgaccggaaatcccacgaccatctctacgaagcaatcgacacatacatcgtggtaaagacgatcgagcagagcactcgtgcgtgcacgagattatttagtccgttaagctgtcgcgctaacgttgtgaagctgtttgattctgccattgcaggagcatcccggcttgtccggcgacgagaaggcgtcgctgtgcggccacctcgaatgccggaagctgtcgcacgaggcgtgcatccaggcggtgcagaacgaccggatgccgctccggctgatcgtgcaggcgctgttcgtgcagcagctgcacacgcaccgcgccttcaccgagtgctccgactcgttccggtgcatgcactcgggggagctcctcgtccccgtctccggcggcgccgccgccgccaccgcgtacaccccgagccccgggtgcaccaccgccgtccccaccagccagccgctcagcaccagcagcccgtacacggacaccgcccacgccacgcgggacggcaggaagctgtccgcgcccgcgccggcgacgacgacgacgacgcggcgtcgggctacgagacggcgagctttaggatccaggcgctggagcaggagatcctctccctgaagcagacgctgcagcggcacaacaccgtgaagaagagctcgtcccggaaggaggcgagcttcaggatggacacggcggccacgccggcgtcgtcgtcgacggtcagtcggcgagcgccggtgtcctccagcagctgcattggctccatgcggtggggatcgcagcgccggtgcgcgagtaggatcctgcgcatcttcgcgaggctccccgtgttcgggagagggagcaggtcgtcgtcgtcgtcgtcgacgtcgaggggaaaccagagcaagtccagggcaagtgcagagcagctcagctcagtggcctgtagaacgaagcacgcagcgagggactgagcgagaggtaaaaaaatgacgagacatttttactacacacgtggaaaagaaattgcagatcatactgtaaaccctgctatgtttacaaaaccgtacggttactgggttatcacgtgaccatgtggttttcacgataaccacgtggttaccatggtaaccgtcaaactgcgggtgacggtaacccataccaaaggtttgatgaactgtgaaccttggctacgagtagtagtgtggtagtagtatgtgagcagggtactatgtagtctgtacatattgctgttgctggcaatgctgaagaattgaagagtagtttgtagttactgtcaggtggcctggtcagcactttttcttaggtcgaaaattctgaatatctgtatagttcatcggtattaaaaaggtttattttccttcaaaaaagttgtttctgatgggagggaactaattcgaaaaaaaaacaaaggaatgcaagtgtaaaaaaagttgactgaaacattgaaaaaagaaggagatgtccgcccaaatgattatttagaaaaacatgaatatggggcttgttcattttgctaccattttcaaccttatcaagttttggcattgccaaattttggtaaggttgtcaaattttagcaagatttcatatgtacttattaaaatttagcaacaaattaaatgtagctattattttaggtaactttaccaagaaaaaaaataagattgtaaatagtagcaaagtgaacaagcccgcccgtgatcctacgtggaagtgacgagaaacgccgtctccgatgataccatcagaagtggcgaagaccatagaagttagccatgtaagattgccctaattctttgtaatggacctcttacaatattgggcccaaaagggtggcctgctaagaactcattaggcaaaagactaggaaaatacaaaaatcttcttgtatatgtccctttcaaacgatagagatgtaccacttgtatatcgaacccataaaacagagatttatcacacattatggtattggagtttctctctccttatcccaaaggtactgttgtcctaaacaataataagaatgtttgatatgttaaaaatatgtactggaagtaaaattacattgcgtggttaaaatattttggttttgtttttttttcatttcacaatggttagatggttagaagttgctttcagaattttgcacatatttgagagggtgtagtttacaacaaaaatttgcaacggatgctgtccctctcaagaaaagcccagcgttgaattttcctagcattgctgatgctgaatacgtggtctcaatccgaagaaaaagatggataggcgcagacgtggaattcagcaaacctactattatgccggcgagctataatagttggcaggttagatttgta

SEQ ID NO: 25991 - DNA, 7251 bp, Oryza sativa
  unsure (1)..(7251): unsure at all n locations
tgatatgttaaaaatatgtactggaagtaaaattacattgcgtggttaaaatattttggttttgtttttttttcatttcacaatggttagatggttagaagttgctttcagaattttgcacatatttgagagggtgtagtttacaacaaaaatttgcaacggatgctgtccctctcaagaaaagcccagcgttgaattttcctagcattgctgatgctgaatacgtggtctcaatccgaagaaaaagatggataggcgcagacgtggaattcagcaaacctactattatgccggcgagctataatagttggcaggttagatttgtattttaatagattactagtaatatgtccgtgctaaacgttacggtgcaattctatttgtctttaataattattaaaatttcatgttagcggaaatttttttatatgatatgtgtatttgaactttaattcaattcatgtcgtacattaaatatacttatttaacgtaaaataaaataatatgatattgcatgggcacaataaatctttacaagaattaagtttatataatcacttcagtatataatacgctattatgttaaaaaagtaagttattttattatttgttgcgggaacaaaataaagcattatttgcgatctggaggaggtgcgggagagaggctgcagtggttggcgatttgacggaggggaaaggaaaccgagcggtgatcccgcgtgcgtgattatttgtgatccctaatacattgcaggggaaatctgttctgggctggctactcaaaggcagaatttttccaagccaatctcattgtcatccaaagtactactgccaatgaactgacaaaagaattgatgaaccaaagcagtgacatacttctagacaaacaacttaggcgaactgagagagctcccatggttatagcatatggaaactgatcctacaataaataaaataatttacattgtaatataagaaaccaacttttctgctacttgaggtttagaaactgaccttgaaaccacggttctggtttgatccacctgaacatctcacggttatccataagtacaaggcaaatatgagtagatggctaattcgctatggagcaaaataatactggaagactggaggttaccttttgttgtttgcatgtaatgatatatgtgacacagaagacctcaagaaaagtttctatgtacggataagggctatggcttataaacatgttcatgttttttttccggtttgcaaattggtattctaacctggaccaggaacctaccatgagttttaatattaacataattgttttgcattggaataatgaatgttatgcaaacattatgcagtctcctgaaatgaatcatccgataataccaaagtaaatgaagcagcaccgcatttatagagaaaaaaatgttttccctaagtagtcctacacttccagttgtaagaaggattcaaactaaagaaaaaccacccttccatttgtattcatgctttaaaattgtaaaattttatcttatattcttttctttttaccaatgctttcatacagtttggggatagacggtggagatgagacgaacatgggttgggagacgccgcagcaatgtggtggtggcggtgcgtgtggcagcgccggtgggtagtggccacggaggagatcggcgtggtgtcactggtgttgtcctcgacggtcggtggcggcacggagatgtcgagggtgggcttcggcggcgccggtgtggccccccgaggtggaggttgccggatgttgtatcaataatccctaatcctatacagcaaaataagaaaatcatgaggaagattacggtggtgcaatgtttcatgaagcttattgcactttgcttaaaaatgaaccatcttggtacagaattagtcaaaagcttactgaagtcataagttcatcttgaccaaatctgtcaagaatccagaaacaattggattgtcctaacatatgcatggtgatggtgatttcattaatcaaggaatgaatctctactatactgataattgacatagatggtgcatcatcttaaatattctgtcattgccagtgaaaatcgaattttaaggtttgacttctgaaatgtgtaaaatcttaaataaccagatactattgttctttggagatgtttagacatgtgcagacagttatgcgttgttcatagacatagatactttagttatcattatctaaaaacatgaattctttagataccaaaacgatgctttcggtttttttttcttttgattgattctggattatattaagaatcgtatgatcaaatcagcggcgactgatggggggagaggaaatatatatagtactggattgtggattaaaaaaaaggagggaggatgatttctgtaccttaatttcggcgaatcagatcgaggatggggcgacactgttctgaaagcagagattggtggttgcacggagacagtcgacgagccggagattgggggcggcacggaggagaccgacgaggcggagttcctggtgaagatcgggggcggtgcggaggagaccagcgagaagggcgatgaacggcggagtggtgagtggaggggacaactggcggggtgggagggcgggtgtggtgtgcggcgtgcgacggcggagtgggcgatgcggtctggacggcgggtgggggcgcgagcgccgggagacgacgggggcggcgacgtgcataggcgcgatgggcgagagaactggcggaggagatggatttcgcgattggaaggaaagtgcgacgatttcgggggcgtaggggtgagggaaggcggatgctatcccggacgttagatctcttggggataatctggacgttgagtgatgaatgaaagaatgagtgaaagtatttgtttaactatagggtagattgaagatcgctgaacagcaccatcttcattgtgttcttcgggggtcataatagttgactgcattggcgtgccagaagatacagtattgcatccatctgttgatttggccttctttcttgcacgccattcacgaagatacttgtttgtatcctctctctttttctttgcagaaagttcacttgtccctaccacacccccttcactctggtttatttcagatgtagttgttgcttgagttggattgacggatgttacagtgctattaacaacactcgactttgctctatttcttgcacgccactcacgtagatagctgttatttttttccctctttgttgaggtggcaatttcagcaacattgacctcggcactatcacattcttcatactctgacacatgcgttgtttgcataggacttgtactacatttcttcttagcctccagatttgcacgatatatacgttgtttgaagtttctttcctttttacgctgagactcattggatagcccaaattgatccacatgacctgcatttttttattaacactatagtcatactgaaaaggacaagacctgcgttgtacacaacgaactatccattatatgtacaccttgacggtggtttgttatatctccgagggatttgcgagctccaccgtcctcccgatttgcgtccatgcgcacctaatttacattttatgtatttttgatgagtatgtagtatgagcacatgactacataataaaaattaatttgatatgtacctcaatgttttttaaaaattaactggcgtaggggatttgtgttggtcgtggtggcgcttgaggcggaggaggtggaacagcgtgttggcggagcagactggcgagagatgcaatggagttgtgcagcggagagcagattggcgacgttatgtaccagaatccgagcgacggcgatctggcggcgtggatgcggagatgaggggcggcagcgaacagggactggatccctgttggaaattgcggggtgcaaaatactaattaatatttcgaggcatcagagaatcaagagaataattttataattactaataggaaaatagttatatttggagcggtacatgtacaacccaaacttagcagttaatttgaggcaaattctcgaagaacagtggcatttcatataaaactcaaaacatctatccaatcaaggtgaaatgttctgaaataggagcctaaagcttattatggctgatatgcaaaatgatgaatccaaactgcctaacggtacggagtcatttaaaaccaagtaataaaaaaaggacctatcctctaacaattaggatcacaagacacgttaggacgaccgaaataaccttgacagctgaattacattgttaactcttttttcacatcgtaagtggctagacaaaattaatgtcgcaccaaataaaacataggatgttaatcgccaatggcacctgaatttggcaatgttaaatacacgatttcctccactgcatttacattcccctcaccatgtttaaactcaggactaaaagaataactcaagagcagattcgaccacgtgaatgatgggtacaattaactatcatgtcgccaaacaatattataatttaaatgttataatacaccacaatatggttgtgcagcaaggtttcttctatactcggattattgaatcttgattactatatattgtacaaaaccatgccaatatataagcaccaggttatgttgaagagcgaattagtagtaagcgatacctccttggtttcctgcacttcacactatttgaattcttatcacagtacttcggaacatctttctccaattcagtttagccctgaaatagttttgcagtcgagtatgtcagtaattgaaatatgatgctgctcgtacattgaaccaatttcttaaatttgccaaattcagattttttaaattgaaccaataggtggacttatcatctactggagtagatgtatttcttgatctcagtttggcagtaaccaacgtcattcagtttggatgttttctttagtaaattcacaactaataaaagaacaacaaccaacgggttcacatgagaattatatattaattctgtacagcaatgacacatctgataaaaagaacatgacacacaaaaaaaaatgatctcacaatattaccagtcagattggaaatctgtgtgatataatggaagcaaccaacaggtgaccactgaaaactacacatgaaacaggttcaattcggaaagatggtaggtttaatatagttacctaggggacatgagtaaattacagcaaatgacaatgcacgtgatccaaataaatgggtaaatgatgaacgcatttaactggaaaataatgtgaatcaacagaaagaattttcttttggtgacatttctcctgccattatacctgtataaaacagaccttagcagttgagcaacttgtacctctaagtttatgactcaatgctaaccatcttttcttgttgaggaaaaaaaaagcaaagaacttcctaaataattttttttagaaaaattgtaatcagatgccttttgttcaatgggaagaaaaacccaacctcgttcaatgctgaaacctaaatatttctgaactaactgtaaaaaaaaaaacatgttcagcatcctcgagtctagtttgcatatatctatatcaacactggctacctcaaccccatgtaaacacacgaatatgccaggcaacaggataatgtaggtgcagcttcaatccagtacaaatgtttacttgacagcctgatgaaagatttgcagttgcagttggaaaattcaccttctcttgttgaggaacaaggcgcagagccccttgaattggagattctacctgccatgacagatgaatatgtcattgatcttcttatatagaaacaaaagactgtgtgggtgtcataacaattatgatcacaagattaacggaatggccgtcgtttgcaactgcttgtataatattgcataaaagtaaatggtgtaacattcaagaggtggtgatgtcaatcttgagtgttcaaggtctatctgggatttcagtgggttgcaacatcacatggtatatgtctgggattttggatcagacgcccataccttctcaactgctctgccctggcggaggcgctgcgatgaaatttctgatcaccgcggacaggcgacggggatcggatcaccgcggaaggcgtcggcggcgacctggcgacgggagcacctcgtgcggcggggatcggtggagcagatcggtgacggcgacctggcgacgtgaggaattcgtgcggcgaggaggcggaggacaggccgatggggatcttggaggacgagccggcggcggagattcgatggcagatcggatcaccgcggaaggcgtcggcggcgacctggcgacgggagcacctcgtgcggaggggatcggtggagacaggcgatgcagatgacggcgcggcggctacctggcgacgggagcacctcgtgcggcggggtggcggaggacaggcgatgcagaggacggcgcggcggctgatacggagcggagcggtgatggcggaggtgcgggagcggtgttctggccgagggccgaggtgcgggagcggtgcgctgattgaggggggtggaggcaggatcgatctggaccgttcggattttaggcggatgatctgaaccttgagcgatgaatgaaagaacggaagaatgagtgaaagtatttgttgaactatagagtagatatttaatagtataattaattattatgtaaaatttaatatatcatttacaacaaatctaatagcctactacactgttaatacacaaatcacctcttaggacatccacaatgtaataatagtagatagcataaaccgcatatagtttattggtagtccatagctatatgttagcctcctttctgggtccacacgggtccacaaactcaacgaatgagaagggggctaacacgtgggcccagctgacaaacggaaatgaaaaatatatttgagaggatgataaatagtaagttctctctccatatgcatatcggtagccataagggataaaataataatctctcacttctctccttacgctctctctctatgcatatgagatacttcctccgtttcacaatgtaagtcattgtagcatttccaatattcatattgatgctaatgaatctagatagatatatatatgtctatattcattagcatcaatacaaatgtgggaaatgctaaaatgacttacattatggggagggaatatnnnnnnnnnnnnnnnnnnnnnnnnnnnnnnnnnnnnnnn

SEQ ID NO: 25992 - DNA, 2228 bp, Oryza sativa
aattttaatatatcatttccaccaaatctaatagcttactacactgttaaacccaaatccacctcttagaacatcccaaatgtaataatagtagatagcataacccgcatatagtttattggtagtccatagctatatgttagccctcctttctgggtccacacgggtccacaaactcaacgaatgagaagggggctaacacgtgggcccagctgacaaacggaaatgaaaaatatatttgagaggatgataaatagtaagttctctctccatatgcatatcggtagccataagggataaaataataatctctcacttctctccttacgctctctctctatgcatatgagatacttcctccgtttcacaatgtaagtcattgtagcatttccaatattcatattgatgctaatgaatctagatagatatatatatgtctatattcattagcatcaatacaaatgtgggaaatgctaaaatgacttacattatgaaacggagggaatatctaatatattgtttttattatttgatgggacccacttatagtcctcttctaaatttaactcttatgagaaatgaaatagctaagagcaagtttaataatatagccaactactagtagctctaaaatctgacacgtcatttacagtcaacctagtcttagtttatcaatgtttctacaatatattattggaacatgtttttttagaaatgcccttataaacatataaggttgacaatttatttatcctactagaatatttagaaaattagaaatatttttgtgtagcctccttatacaacatagaagtttgagtatacgtccctactccctccgtccaaaaaaaagacaaaccctaggtttccgtgtccaacttttgactctccgtcttatatgaaatttttttataattagtatttttattattgttagatgataaaacatgattaatactttgtgtgacttgtctttttttatttttttcataatttttttaaataagacggacggtcaaacgttggacacggaaacccaaggtttgtctttttttgggactgagggagtaagttggaaggtttttcgatcactaccttatttttataaaatattatatatgtgtgtgtatgtcatatgctatatagaatattctttgttgttgtttttaggaaagtacaaataccccgctaaactttggatagaagtttgtctacactctacactttaaaaccggatattcaacccccaaaacttcactgtactgtccatattaccctcttaaagtggttttagatggtggtaggggtgaaaacggggcgggtatttcccgcccgcccgtccgtgatcacattttttcaggacaaattcgggtacccgggacttttcacggatatcgggtccgaataggtattttttgacggatacaagatcatgttcgggaacgtagtattcaacggatttagattatccggtaaaaaatccgggtattacccggatagttatacggatctcttacccctattatgtttttgtgaggcactttttggtacaatatattgattctactatgatgtattgtaccctatttattttcaaaggtcctaatagcctaatataatcgtattatggatatatggaattgttgaatagttattgtctatgtgatatataagattattgcttcgacttgatatccgaataaatatttgtaaccgagatagtgtacgtatccattttggtacgtattcgttccgtatttttgcccgacattatctgagtttgtatccgtattcagcactatctgtgtccgacccgattccgattataaaatatgggttaggatatgggaagggtaaggtctgaccgaacacgacccgttttcacccctagatggtggttttgcatattcctaaagtggctttatatggtggttttgcatattttttggaagcttaaacgaacaactttgaataactaataaaacatatttgcaaatcatcagttataagttatcaatttatccttatatagtgagattatactattattatgttggtacttatttgtaatcagttataacttatcaatttatccttatatagtgagattatactattattatattggtacttatttgtaagtgaaagctaatagagtaaaagatagatttaagtcgaaattttaatatatatgtctaacgtgtggatcatgtggtcaaacccatcta

SEQ ID NO: 25993 - DNA, 1131 bp, Oryza sativa
atttctatccaaagtttatggggtaatttggatttttttccttgtttttaatgtaaatcacccacttatatgtcatgcaaagagactacacaaaaatgtccataatcttttggaacttttagccggtcaatcaattattcataatacatattaacatatgtaagggcattttgggaaattttaaaaaggtacgtggttgaatagctagaatattgttcatggacttaggcggtgttcttaggtaagggttctctccagcacggaaaatggagcgatggattagtgcacgattagttaagtattagctaaaaaattttaaaatgggttagtatgattttttaaagtaactttccacaaaaattttttgcaaaaaatacaacgcttagtagtttgggaagcgtgcgcatggaaaactagggaggagatgatgggaactagaagagccgaacacagcctaatggtatattatagaaaggagaaacactggcaaattgttgaactaggggaaactccatgacatggaataggttctctcttcataataagaggccctccaacaacaaattccacacttttgttcaccgtgaataactcttggcaccaaaatgaacgcattaattaacatatagtatcatttacattagccgcattaaattgagatgtcggcttcgtaagcaagaaaaataagcgaatcagtaacacatatgattaattaagaataaagtattataatttttttaaaaaaattgattctaaaagaaactttggtatataaattttttacgaaaaacattatttcgtaattcggaaagcgtacaaaaactgctgaatcaaataggcccttacaccccttcttgtactataatctaattatgatacattacgaagttagcgcatcacatgcttactcagttattgttgttaagtcgatttgtgggacaggtaagttccaacggtctcaagctggatatactatgcgttctctcaccaccagcattattggtaacatcgtcatggcacaaacaagaacactgcatacatatgcctgtactccccttcattttatcatataagtatttagaaaaaaaaactaagatagagagaaaatattctttttagtctctgtagtag

SEQ ID NO: 25994 - DNA, 479 bp, Oryza sativa
gaaaaaccatatactattttcattttcatttttttctcgaaaacagaatcggaacagtagattcgaagattcaaaaacagtaacgatatcagtatatcggaaatgggaccgtcgaaacggaatcaaccgacattggtcggaagtcgaaaattcatgtcagaatcagaaaagtgtggcctaatacacatttaattatgtacgaagatgactttataacttcattcttgcatcatcacacttcacataacaccgttatatgataattaatgatataataataagtttgatcaacaatataaacaaaatttaacaatatctcaacaccgataagttgagtagaccaaagttcagcaacgtccacatgccatgccctagcgttaacagcgttttcctttggtcacttcccctttctaatgtgctacaaacctgctaggcttccttcattcataggcttccgatatgtttgattggttgagtcg

SEQ ID NO: 25995 - DNA, 2142 bp, Oryza sativa
  unsure (1)..(2142): unsure at all n locations
nnnnnnnnnnnnnnnnnnnnnnnnnnnnnnnnnnnnnnnnnnnnnnnnnnnnnnnnnnnnnnnnnnnnnnnaaagaaaggggattccttgcttccacagccaccaaaagtaaaaccacccggtgcatggtgttggtggccggccgcccatgccatggctccctgacctttccgcggctcaactctcccccatccatctcccacacacacatccactgacagctctgcacgagaaacgcttggccccaactgtcatcgcacgttggcgctgaactggtgcgcctaggtttggtaccaatcgggtaacccatcccagcctcctcgacacctgtatcgtcaaccccgggacgagacgcgagcgcaaaagcgactacaaagatacacaccgcaccaccaccaccacgcacgcaagcacgcctctcgtcgcgttccgtttcgttgcgacgccacgcgagccatgctgccgctgccgcgtcgtgtacgtgtgtatatacgccgcgccgggttgtagcgtagcgcagcgtgggagtactacactgcactgcatcgcgcaaccaaccaaccacccaccacaacacaaccctcctctcctcatcatcactcgctcgctcgctctcgcgctttgcggcaactggcggtgtctcctagcccttgcctgccatggtgtcgctagccggctcccagatcccgtcgccggggcagagtccgtgcgcggcggcgcggtcgcagcgccgcggcgcggggtactccatgcggaccatccggtcggcgctgctgcagccggactcctgcccgggctcgccgcatgtggcggccgcgtacgacgcggcgggggcggactcggacatggagaacttgacggactccgtgattgatttccatctcagcgagctggcggccaccgcggggcccgcgcaccccgcggcggtggccaagtcgtcgtcggccaacgcggcggccacggagatgctcgagctctcgcgggacttcagtgactactcgagcttcaactcggatatctccggcgagctcgagcggctcgcggcggcggcggcggcggtggtgacgcccagatccgacgcgccgcaggtgggcgccgtggatctgaatgagcttgagtcgatggatctgtccgtcgaggcggcgccgctggagcgcgtggagccgttcgtgctggcgtgcgtgcgggcgctggggcccgacgccgcgccagacgcgcggcgcaccgcggcggcgaggataaggctgctggcgaagcacaggtcggacatccgcgagctgatcggcgtgtccggcgccatcccggcgctggtgccgctgctgcggagcaccgacccggtggcgcaggagagcgcggtgacggcgctgctcaacctctcgctcgaggagcggaaccggtcggccatcacggcggcgggggccatcaagccgctcgtgtacgcgctgcggacgggcaccgcgtcggccaagcagaacgccgcgtgcgcgctgctcagcctctcgggcatcgaggagaaccgcgccaccatcggcgcgtgcggcgccatccctcccctcgtcgcgctgctctccgcgggctccacccgcggcaagaaggacgcgctcaccacgctctaccggctctgctcggcgcgccggaacaaggagcgcgcggtcagcgccggcgccgtcgtgccgctcatccacctcgtcggcgagcgtggcaacgggacgtctgagaaggcaatggtggtcctcgccagcctcgcgggcatcgtcgagggccgcgacgccgtggtggaggctggcgggataccggcgcttgtcgagaccatcgaggacggcccggcgagggagagggagttcgccgtggtggcgctgctgcagctctgctccgagtgcccccgcaaccgcgcgcttcttgtccgtgagggcgccatcccaccgcttgtcgcgctctcgcagtccggctctgcccgtgccaagcacaaggtaaaaccttttcaactttacattcctcttgtttgctaatgtcatatcgggattggatatttgggtatgatttgcaagatttctagtatgtcgattttcaagtgtagattttgggtttgagcttttggtgtgactgaagcttttggataattgtaccgaacagtatccaacg

SEQ ID NO: 25996 - DNA, 153 bp, Oryza sativa
acctcaacaacgacggcatgggagcttggccaccaccgtcatcacctcccctcttaggcatcaaggaggagcgggatccgacctagatagtgccacctggatctagcccagcgctaggtggcagcgtggcatgtgaggcagcgcagctcggtg

SEQ ID NO: 25997 - DNA, 1705 bp, Oryza sativa
aaacaagcattcagttcaaaaaagtgagggtaaaaatgaaaatcctaaaaagtaggggtaaaatcaatattagacatcaaatagggttagaaacaaaattgcccctttaaaaaaggtcccgaggcagtatacccgctgccgctcccccaaaaaacgaaacagaagagaaaaagggagaaaaaggagattgctgattaggattgtcgaccccatatttttttcacttacgtgtgggtcccacatatttatttatttttatttttttgttaactaggatgccacgtcagtaaaaccgggcaaaaattgagtcgatactgccatgggacctcctttgaacgatttgaataagtttaggggtaaacatttctggttttacaggtaaggaacctcaaaaaatctcgctgttaagttgagagatatccggtgaacttattccttcttagagcgagagaggtcagctatgttaccccgatatgaggatacggatacggatacggatacgcgatacggggataccgggatacggctattttcgaaaaacatggatacgtggatacgtctatatatacataataaattaaaaagaaacaatgcactcctcaaagaaaatgggagaattgattgccaataattgaaagataactaatagagcaatacatagatacattaaagcttagaattgtatagctttgaccagacctcatgcagtagtactggatcttcaaaaagtcacttatggctttgtagtcttactttacggtgtccaatatcacaaactgatgttctccttccccggccccaacaaatcgagatccaggatgccctgaaccgtcaatacacgatacttacctcacttgaatgaagcaatccctaaccgcgagcagaggtgtgtgctgcgtgcgctaagctaggggggtgcggcatgcggcggcggcggcggctccgcggggcatggcgacgatgcggcgcctcggcggcgtgcggcagcagtagtaggcccgcattgcaaagtggtggctctacctttgcctcgctccagaacgacgacgccgttgggtaggaaaagatggacgcggcgaggattggtatcccgtgagaagttaggattagatcgtaccttgtatccatgcgtatcagagaagtatccctaattatttcatttttctgaaaatcagaaaaatagaggatacgtacgggcgtatcggagcgtatccgaatacgtatccgtattcctttacgtatccgatacggatacgctcccagccgtatcagggtatcctaggaggtcagtattgcagcttttgctcaacatatgcttgaggaattggagtagttagttcaacccaaatctgcgtgacgtctcgttccttccttaaaagaataatcttgtttagaagtaaagcgttttagtattagaaaggggccaaaatgttcgcttaacgagaggggcttattttgctattgtagtgttgtgcacagcaaggtttcgtaagtacaatgtacatatattaacaacctgtaatgttgttccccatcacgcaataccatactccgtattagattagtgctgaaccgggaagccaatgaagcctagttttacacggtaatcaaccaatatcctaaatggtttgctgatatgtccattgctcatatgcacgcttagcttatatcctagcaatatttctggtctagactaacatcataa

SEQ ID NO: 25998 - DNA, 644 bp, Oryza sativa
tgatatgtccattgctcatatgcacgcttagcttatatcctagcaatatttctggtctagactaacatcataacgtgatttgtgtgcgcagccaaaaaaaaaaagagattgaaaagaaatcaccgtcctgtattgtgtggttaacaacaaaagcattcacctgtcaccccctcccgcactcgccgtcgccatcgttcgtggacgcactcccccactgaatttttttgagaattaatattatttttatggaaaatcgcaaaagtagtggccaaccggggaaaatcgcgaaagtaggtccctgtcgaacgggtgcaattcgatagggcacctatcgaacgacgggcagttgacagagccctgtcgaacggctggcgttcgacacgctcgcctgtcgaacggagggagttcgacagggcccaccaccccgcgccgccaggcctgtcgaaccgggggcgttcgacaggtccctccaccgaccctgtcgaacaatgggcattcgacaggccggtttaaaaccccgtctccccagcccgcgatgcttgttcgatttgtttgaggaccacatcgccagccgccgtcgagagtcgccacatcgtcgccgtgagcgccggagggagcgaggggaggggatagcaggccggaga

SEQ ID NO: 25999 - DNA, 684 bp, Oryza sativa
aattcggactccaaaccagaaggaaaaaagacatggttgatgatccatcattctcctataacctttccaagccaagcaagcataccaccctagcatcctgtacacatctaaaattcaacgtcaccttagcagttaccaacaatccaaaccctctgtccccaccccctggatggctggatcctcctctcagttgatgttagttataccaactaaccatccgtcactcgcaaaccacatttgtattcacattaccaaaccaaagccatcaaccgttatttacagatgatcatctctacccctccttacacagctactccattctccaagaacagagcacacgaggttaaataagagcgaagcatactgcgaccacatgattacagcattacctggccaagctcgaagctgccacgggttcaaccctgcagccaccacctccttgccgttgctcgcggagatacccaagcaaagtttcagcctgcaaatcacacagctaaacataagtgtctccaaaatttggaagcagatttcagattcagtaaatctagatagctaactagtgaagcacacattcgggggtgctctttccaatccgactgtacaactaggcagataaagcacgacaggctagactatggtggcaaaatgataattgtcatataaataattaatatacttattgtt

SEQ ID NO: 26000 - DNA, 1813 bp, Oryza sativa
tttttttgagaattaatattatttttatggaaaatcgcaaaagtagtggtcaaccggggaaaatcgcgaaaataggtctctgtcgaacgggtgcagttcgatagggcacctatcgaacggccatagcgcgactggcgaggagatcggaaggctgccgttcgacaggactcgaacagcccccgttcgacaggcagggctgtcgaacagcccccgttcgataggctgggctgtcgaactgccgcagttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacagaaataactaaaagcttaatacaaatagataagtcaaggacgatcagtgcccttcgcacgcttgctaggtcctcccttcttcctacgcctaatctgctcagtgggatatgtcaaattatcaggggggtgcctatctctagctgtctgctgtggtgtcacgtctggcccctgaccggcctccgtctcctgcgtcggctgtgtgacctgaggtgctgcgtgccagtaatccatccctacttcctcctggggaggatcagtggaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcatgacttgactcccccgatcgatcaacacatgttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactaggttaataatccaaataaaatataacacctttgtacatattttaacacacaacatatcaataatatgtactaactaaaaactaatttaaccgtacaattacttaaatacctctaccaacatttagcaataacaaatatgtgctaaccatacat

SEQ ID NO: 26001 - DNA, 2309 bp, Oryza sativa
aaatcgttcaaaggaggtcccatggcagtatcgactcaatttttgcccggttttactgacgtggcatcctagttaacaaaaaaataaaaataaataaatatgtgggacccacacgtaagtgaaaaaaatatggggtcgacaatcctaatcagcaatctcctttttctccctttttctcttctgtttcgttttttgggggagcggcagcgggtatactgcctcgggaccttttttaaaggggcaattttgtttctaaccctatttgatgtctaatattgattttacccctactttttaggattttcatttttaccctcacttttttgaactgaatgcttgttttgcccctactttggatggtgaagttaatagtgttaagtaattgacaaaatggcatttataccctctcatgtatgttcattaataatgtttttgtccccattttatacatgtagctttagaactttatttttgggagtatatttaaaattagatgacccgcattgactaatataacaatttggacaaattctgaatttgatggaattttgacaaaatttcagcattttgatagaacttaaacaacattttaacaacattttctaaaatgtaattatctgttcctttagatactagtcaatgtgcttcatttaattttaaatatactcacaaaaataaagttataaagctacatgcataaaatggggacaaaaacataattaatgaacatacatgagagggtataaatgtcattttgtcaattacttaacaccgttaacttcacctctaaagtaggggcaaaacaagcgttcagttcaaaaaagtaaaacgaaaaaagtaggggtaaaatcaatattagacatcaaaataggggcagaaacgaaattgtcccttttttaaatggttttacatagtttagggatacacatttctagttctatggttaagggacctcaaagaatgttggtgttaagttgaggtatctccgttgaacttattccctctaagaaaaaccgaacccatttccagacggaatgagctcatctcaggtcccttaacttgtcaacgaatccaattttcgtccttcaactaaaaaaaccatacaacgggtccctcaactgtcaaaaccagtgcagatgaggtccctcggcggttttgagagcggttttggctgacgtggcgtatacgtggcaaatttgacttggtcttcatatgatgtggcattgacgtggcaattatgtggcaaatcaatcccaaaaacaaaaaaaaacttcgtgggacccacatgtctgtctcacacacaaattaacaaaaaaaggtggggcccacgtgggccccacaagtccctcttctcacttcctctctcccctgtttctccctctccctgctagctatggagcgacggctgactccgggcgtgcgcgcctggtctctccacctccggaatatgaacgacgcggcggagctgtccgtggggaccgcgtcggcaacggacacggcgtcgtggtgcttcgcaatggcactgatcaggcttgtgttgtgcacgctccacgctgaggccgtggtccgtggaggtccgcggccggcggctaggcggcgcggcggtgaagccgtgcgaggaggtgtacgtcgtcggggaagacgagatgttgcacaccatcagcctcactcctcccgtcatccctctcccttctctctcttcttccctctcctccctctctctcttcttcgcggggagcgccggaacggacgggctggtgggcagtggagcagcagccggcgacctcggcgaggcggcgccctcgtcgccgccttccctctccggcgatggcctttacgcggcacctggaccagtagccagtaacgacaacgacgacatggttggctcgtgcaactgcctgtggctcaagcgacatccccttgtctgcggcagcatcatcgtgatcaacccggtcaccggcgagtccctccatatcccgtcgccgccggtggcgaccagccgcagccacgcgggtatgatcagcttcggctaccattcgacgactggcaagtacaagatcgtccatttccttccaatggcgggctggtggatgaagtcacgctggggggcaccgcatcgtcgtcgtcccctcccgccatggcggcggcaacggtgatggggtggtgaatatcctcacgctgggagacgacaccaccgccgccggcggcgcgcggtgggggcgtcgccgtggagcctgtgcgtcgcctggggcgttgtcagcgtcaacggcgccacgtactgggtgcccgagggcaagtagatcatgtcg

SEQ ID NO: 26002 - DNA, 10070 bp, Oryza sativa
  unsure (1)..(10070): unsure at all n locations
atatgaatatagaaaatgttagaatgacttacattataaaacggagggagtatttgctaaattctacctttcaatcaccagtgacttatctagatcagttatatcgtaaatgctgtgttgcagcataacgttatacacgaaaaatatgatttcttctatatgactagtaaaccaaacacaacacagatagaagccacagcaacaggaataattttccaacataacaaaccagaaaagcgcacaaagtacagatcgaactggtgatagaatttctatcatttacaaccgtggaaaataaaatatcgtgcttaacgacgctacagacttacggcaacgtaggatgctgcctaatacatccctaatagatggttagtttgttgtgctagacatatttaacattagctaatggtcaaggtgatgtcaccgtggcagtagacaacaaaatgccacatcaaccattctggtgcatcccttttcatccttagattgactcctggaacatccatttgtttttcgactggaggaatcagatgaagaatttacaccttggttgtataggagtaaaaaaaaaaggaagtctcaactgaagttagtgatgtatctgtgatattgatatatgtgtgccgaaatgctgatgattgaatacaaggcacagcagnccagcgccttttcctgcacaacagtaatttcagtcnagcantngntntgnnnngnncacactccgactccagactcaactcctggagttaaatttaggagttggagctgtaccaaacaggccctgagagggaaagggaagaagagagagaagggagagggatgtggggcccacttgggccccaacatttctaattttctttttgtgtaactaacatgtgggcccacgatttttattattttttctgtgatagaattgccacgaaagcgccacatcaatgccacgcgtaacgaagaccgagtcaaattaaccacgtggacgccacgtcagccaaaactgctctctaaaccgccgagggaccttatctttaccagttttgatagatgagggacctactgtatctggttttctggctgaatgacgaaaatcggattcgttgacgagttaagggacctcagatgaacttattcctttccagacttcagatccagatccaagttccaacccaacagctggcctattttcccaaggccgtcaaagctcgtaagcccaaaaggccacaagtctacgaaactaggccttttaccccgatctgacattccatcccatttggcccatgttgtcccagcccacagctccacacgtatgcaggcatgaaccaaacatttctccgggtacgcctcggtctcccgctgacaaattgcactattgcagggcatatctcctcacttgttcatctccagctctcctggcacactccaagcacaaccttctttcccgttctgcatccttccatcctcgccacctgcgatgatgggctcgggccgttccttgatggcgcctcgcctccccgcctcctcctattcctcgctgctggcgccgacgtcgtggtcgacgccggccgcgcgttctccgccgggggccgcgtctacgagaggagtgcagcgagctggaggagctgagcgccagcgtgcactggacgcatgtaccaccgaggcgaacggcggccgacgtcgcgttccgcgtgtccgcgctggcgatgatgaccagaacggcaccaacgtttttttctgcacttctggtcaggttgcaggatgccgaattgccgatgcccattgacgatgctcagagcaagtttaataatataacccactactagctaattcatacaatagttgcttattatactattaatacatggtctcacttgtcatacacacattacattttagagttcgtgctgcagctgggctacagatatgtagtctgctgctcttctctctctttctttattattttaaaatatgtttatagctggtttatagccttctattttacctattttacctgctctcagaatggtgaccgtgtagccgacggaccaccagtacaagttccagtcgaagcgaaccttaacggtcgtctttggtggcatcagcagggcagaaacccgagacagagagacagaaacaccacgttttagcacgtaaacgcaataacgaagttgctgaattttgtgctctcagttctcacaggtagcatcactggactgtctcattcaccgagtagctatctcaaaagcatcgatattgtggagtactgaagagttgctagggggaaatgtcaatacgcgcgattcagagcacgactgtttccgaaggtcaggccgacccccccatccggcggctccgattagtggtgaaaacggtacgaaaatttttaagattttcggctgccgtttccaatgaccatttcagtcagtattggttaccgtccgtgttagaaatggcaacggtaatatcttccggaaataggatgaaggtttttctgaccgttttatcgataaccgtatttgtatggtaattttcgtcaaaattctaaaagttccatagcgactcaaccaatcaaacatatcggaagcctatgaatgaaggaagcctagcaggtttgtagcacattagaaaggggaagtgaccaaaggaaaacgctgttaacgctagggcatggcatgtggacgttgctgaactttggtctactcaacttatcggtgttgagatattgttaaattttgtttatattgttgatcaaacttattattatatcattaattatcatataacggtgttatgtgaagtgtgatgatgcaagaatgaagttataaagtcatcttcgtacataattaaatgtgtattaggccacacttttctgattctgacatgaattttcgacttccgaccaatgtcggttgattccgtttcgacggtcccatttccgatatactgatatcgttactgtttttgaatcttcgaatctactgttccgattctgttttcgagaaaaaaatgaaaatgaaaatagtatatggtttttctgaccgctctcatccctgctccgattatgtaaccacagcattggcattttggcaggcgccatggagatagaaccaagcgatggaaacaccatcgtttacctcgccagtcgccagtatgacgcattgacgccgacggaacagagcgccccaagcccccccaacccacagcattcagaactccatggatgggtttgtccttgagattttcaccttgaccgtttgcttcaagaagagtggaaaaggctccaaccaaggtggctccatggatggcacgtcaccttctacttttcaatgtacgccgtgtttagcttcaaagtttttcttcaaacttccaacttttctatcacatccttctaattttaaccaaacttccaattttaatgtgaactaaacacagccgtattctaacaatcctgattattttttaaagtataataatctgcatctgttattatgtgtatgtgcaatttcagtccagtttctcgtatgtttggtctattgtgatcaaacggatatggcttcctatgtagacaaggaacagtacctcaaagcaatcgaggcttgtttggatcaatgccaatacctatcctcacaaaaaacttacgcaggggcaatgtttggaagttaccaaaattttgataattgtctggactaagatccatacaaatcattggttgaaatagactggtagctgcgcttggcacaagagcaagtcttatggaaaaggtagatttcacccctaattttattcatgtagactattcatcaattaaaagatagcatatacaataaatcacacatatattaattgtagtgcactaaccctaatagttttattttatttgtttgatcaatcttctcttccttttttttcccttttttattataatttatgtgaaggttaccccttataggaggggtgactatttctctcttctcttctctccagctcatcatacgagtgtatgtggcatcttggagtaaatgtttagatgcccatagcacttgctctaggcccattcatagcgcctcctactcataagaggagccccggaaagccatgtaggctagggctacgggtctaaattttgagttctttacgatgcaagtggctctaggagtggctataattctatatttcagctccccaacatcttttgttttagttctcattttttttcaatttgtatggaggtccaaaatttacactaaacaccctaaaatctaaaaaaaattatattaaaacccctctctcccttatcctcacccccctccccggcatgcccacctccttcggttaccacgagcccatggcgccctcctctcctctcctcatgtcgcggcggtagtcaaggagattgggggcacgatggcggtccaggaggctgaggcggcgacgaagccaccaagcggacgatgacaacaagctcaggggtgcgtgacccctcccgaccgacgatgaggagatggagcccctcagaaggcgacgacctcaacaacgacggcatgggagcttggccaccaccgtcatcacctcccctcttaggcatcaaggaggagcgggatccgacctagatagtgccacctggatctagcccagcgctaggtggcagcgtggcatgtgaggcagcgcagctcggtggacagtgtgtccggtgagcttcagccagcaacgcggattgaagtggagaggacggtggggaagaagaagaagagaaaggggtcgacgtggacaagctcaaactctctcctcgccgacggtgtcaagctcgaagtgaggccataggcagggcgatgccttccatagtggttgtagcttcgccctccgaacgacctcgctctgactcttctgacaaggttcatgcgttcttagcaagaacgatgagccttgcaggggcatcgtggagccacatcaaggatggggcgtggtaaggaaattgccacatccttacattgtgaatggcttaatcatatggagaggaaagtcacttgttttccgcactcacgttttccgaactactaaacggtatgtttttttataaaaaaaaactatataaaaggtgcttaaaataatattaattaaaatttcaaatttaaaataattaatactcaattaatcgtgtgctaatggtttagcgtgttttatgtattttcttaatcttatacaatcattctctctccaacacttcctatttagtccttttgggatatgctaacagaatctgtgttttttttcaagtacaattcctcttgtattcgtactaagggagcattcgttttggaagaattttaacacataggaatagggaaggtggaggaataggaatgtatgcacacttcgatccatagaaattttcttagaggtttgagtagatggaaaatttccacgaaaaattttcgttggttttcctatacatacatttctataaacctaatgacactaataggaatccaaatactttgattttcctcaaaaaacgaataggccctaaaacaagtaattcaaaacgtgggtaaaagaattatcaacagttcaaaatatacgaaaaatagttaggtggagcgccttgcacgtataggtagcagaaagtcataatgtaacctaaaagttatggtgacgtttccgtgatgaagaagccaggaagcagatttatagaagcagaaatcatgaactaatttctagagcaagtacatatatgccatgtccttaaggattaactacctaaaaagggtactccgtccacatgaggcccaaagctactttccaaaagacaacgaacagaaaggcacgaaccacatgccatgctatgaaaggctacattaaactaaaccaacaggcaacagcagaacagctatatataagctttacagcaaatatacaatgcacaaattggaataatcaaacccaaagttctattttaaaacgaacagaagcatatacatatggcaaatcaaggtagaacaaataagtatgcacttttggtggctttatttctgggagccaactgcaaagataggatcggcgtccccgaatagtttcactagtaagtcaagcagatctctagtatacaaatggaattggttaaaaagggaatgaaaacaagcgagctaatgtagccataaatgggcaagataataaagcattcctttggtatacaagtttgtccatatgacaggattccagcttatgttggaacactctaagtatgtgccgcaatcaccactgcacatctcattcaaaaaccaagacctaatacatgtaggaattaaactaaaatctgaaaccttcacaaaacgtttgtattcgctcctctagcatggtggtgtccataaaccacacctctggttagctagaaacaattaactaacccgtatattaacctgatatcaccaattcatagtcatgcacctgaatacctgatataatgcttctttcatctatcccaagtcatatatgaatataatagtactctcgctaggaagtgatacctgcaaaaagattcaataaaaccattgtgagaaagaaatgttgtagatatcttcaacagggggtttcactgattgaagatataaagcagccttatttacttcaccaatcgcagatcatgtgttaaattactggtaaatataaaacattatactgaaatcaagtactgtatttgatttattccaaaacatattcataccgctctaagcttaacaaatgcatgccattccagaaattgagacgattcctaacacaatttgtacaactaatttctgccgacaactgcactatatttatattacttacaaatgatttcatgcatcccatctgataatcaaagtttcaaaagtttgattgcacttatgtataaacatgtatttgtgactggaatgagcagtagatactcaatttgatgataataacatacatgaggcaagggggccatacaccacactgaaatttagacttggaccaactgaatgatttagtgatgacgatgaattgggctaccagtaagcataattgtccaaattaacaaccaaaacattacagctccataaaagtatctgcgcaggataggtagatgactcgcgtccgagttaattaaactataggaccaaagttcttttcaattttctataaaaggaccatgtagaaccacgtgtattacaaaagggcagcttatcacactagcgtacaatcaaatgcttcatccactgctcatttttaaaaagtgcacaactgactaactacagaggcgctaccgctttcctagtgatgtaggtcgtattgcccccattctgttcatttccatacaaataattcagatgcataaattaacaaatgcaacaccttattaggtttgatgtgaagtggaatgaggtcaatatgagccaactggcacccacatgcatccataaaatttaccaaaccatctaagacatgattattttattttaacaaatggttaacctattgccacgtttttaacacacgcagaggcaagacaagagtatcacagttcaaattgacaaattagctgtggcaagagattactacgagattaggtcctcagctaatacaaatgtttcaaaattctgtggtgacatgtaaatagagatcagcaatagcatatgttgatttgtccaagtgtagtgctcaactctcattaagtattaagttcgggcaacgaatgaaggaatcttgtattgaacaaaggcatctagaatctagataaacaccaaagtgtggattgagaaatcaaattacattttaggcatagatttaagaaaatatagaaagcataataatagatatagaatgtggattgcttttgtgctcatgcaaaatttagccattatcaggtcctaactcctaaggctaaattttgctggattggaaactcccaagaaaggtctttttttatatatggtatcaccagtctacttgagtatactccctccggttccaaatataggtcgcattatagttctttactcttcattaaatataagtcactatagccacttgtcccgtggatttttcctcttatgtccttgctaattgaatgccactactctcgtgaacaaatgaggtattttttccaatgtttaataacaatagggcaacgaggtcactttaacactttctaattcctgtgcacaactctaaaacaacctacattcagaaccggaggggagtatatgatttatttgcttcattaatggctaagtaagtgagaaagcattgatttggttataaagaaatagggaatatgtgtttagctcagcaaaatgttgaagtgattactgacctctgcttgtctgattattattaacagtatagttgcccatgtaacttgctggtatgtttgatttgatatctggatcaacatttccaaggtcattaccaaaaggaggcatatcaatctcagatgacgtgaacctccaagttgagtctccataaatggagctgctgccatatgtatctgcattgttcacttcatatgcattgggtggtgcagagaagggttcaccaatggtaccagttgcattgctccttccatagctgccagaaggcaagccaaaactgtctccagctccacggccaaggttagccagcccaaggcttgaaatgttgcccattccatggccaggagtaggccctccccaattaataccgtcactggtaatacccatttgacctccagttccagatggtgcaaaagaactcatgtttgtggggttgtttgggtagttcagattttcattaccccaaacattccttgacattgaactcaatagtgatcctgaatcatcattaagaccaacataaccaataggactacctaatctgtttgaactaccattgtagaatgaacctatctgccgcccattggagttattgacaaaactagaattggcgccaaaattcgcattcatcccagattcagaattcatgcccattccataaccagggccaaatgaagagaatccattccgtgcgcctgtaagcagaccataccttccatcaaccctcatgccataacctccaatagggtttgggttataaccctggttgaaaccattcaagaagctatggaccctgctcatagcatagttctgccctcccgcaggtgaacgtgcagcaggtccaggtgattgctcctttggaacagctctcttgacctcaaccatcttaccattcagctcatggaagttcttgtgcagtgccttgtccaccgcatcttctgagtcataggtgatgaatccaaagcccctaggcctctgcgtgttgtggtcgtacatgacaaccacatccgtaatcacaccaaattgctcaaaataccttctaaattcaacctcagtaacattagaggccaagcctccaacaaagatctttctagtacggcctggtccaggtgaccctatgctgctgccattgttcttgctggtgatgctctggtcgtccctgggaacagctttcttcgcttccacctgaatcggtatgcacaattgagctcagacaatgaacagccgcactaggacagaattgccaccgaaatgcacaatacttcactagcagaggaaagagcaggggggggggggggggggtcaggtcaccacatgatttaccatgcgcccgtcgatcatgtgcttatccatggtgacccgctcggcgacgcctgcgtcggtgaagaccacgaagccgaacccacgggcgcggccggtgttgcggtcccgcatgatgacggcctcggtgacctccccgaaccggctgaagtactcgcggaggcggtcctcgtccgtctcccacgagatgccgccgacgaagagcttcccggagtccgcctccatcgcgtcctcccctcccctcctccccctgcaatccacaaacgcaagcccaattgataccagccagccatagcaaatgcggacaaaaccccgacttatccacaacgccaccacaaaaacgcatgcgcccgcgcgcgcaggacgcacatcagctagatccgagctgaaagcaacgccgcgatcgggggccgcacccaccct

SEQ ID NO: 26003 - DNA, 4966 bp, Oryza sativa
ggggcccgggcacgcagcgggatcggatcacttaccgatcggctgctgcggcggtcgtcgtcgtcgtcggctgctgctgctccggctccgccggcggcggcggcggcgagaagagggatcgggggcgcccgcgtcgccgctcctccctctcgatctccggcgcggctaagatctcgatgcgggcatgggaggagggggaggaggaggaggcggaggttggggggatgttacttgggcttcgacgcttcgtctcctcctctccttttatcgaacttttgctctccacctccctccctccgctcgctcgctcgcggtgccgcgatgcgctggtggatggttgttttgggttttttacttttttgcggggagaggccaaacttttttattcggcctccggaaccctgcaattgcggtgctcgcctcgattgggaaagcgggggaggagggtggggggacgcggaaatggtataaataatggacagcgggggcggggcaggtcggcctactggcccctttgccgcgctggacgcgacgcgactctacgtggctggaggaagaagacgacctcacctactgctgcttccgccgccgccgtcgccgatgctgccgtgaagcaatctcgctcgctcgctcgctagcggcgcctttaaagcaggggaggaggaggtgacgccgcggcgcgcgcacggctgtggtggggtgttgggtttgcggcgagcctgcggcgggagtggggccagtagcagtgtgggggcccaccaggcagtgaataggagtaggagtatactgtatactcctccaggagtttagtacgctacagaagggggttggttttgttttcctggaatagggagagaggtgaggacgtggagggatgtccgcttgaacaagctccccgcggacaggacgacggcctgcacgtttaaattgcgtgggacaacgaaaaagtggggatttttttgaggatttgaacggtaaatacaaatgtttagctccatttggaactttcaaaataagtttgcagatggatatgagattactcagtcggagatactccgtagatgagaaaattatgtatataccataaactgtaactagctgggtggtcggcgcaattgcgtggctagcacccaaacaaaatcatatatttttttagtatgattttacttaaaatttattaaatagctatctcactgtcttaagactttgaaagaccaaaccttatcaccctcgtgtttctaattataaagtttttaaaagtcacaccagttgctaccccttatgtcatctccttctttatttgcttgctcaatctactattatttctatttattcttcttggaacctttaaaaattagattttatagtttttagagtttattgtcacgttgagtttcgtatttataatttctagatgttccgtcaaacgttgccattatactcctctacggcccatccattgtttcttctctttattgtcattgagattttaaaaatcgaacataattatcgtttgggttcattttttactttctagaagtcccgccaaactgtcagcggctttgccattgtactcctctacggctcgtccgctgcctcccttctttattgtcattgagattttaaatcgaatataattatcattgggttttttttactttttggaagttccgaacctttaaaaattagacttgtagttttattttttataatttttagaagtcccatcaaacgatgccattatgcccctctatagcccgtccgccgcctactctttattgtcattgtgattctaaaaatcgaacataactatcgttggaattcattttttattttctagaagtctcattaaccgtcggcggctctgcaactatactcttatacaccccgcccgctgcttctcctttttattgccattgagattttaaaaatcgaatatgattatcaatggggtttatttttttttactttctagaaatcccagcaaccgccttacttgtttgctttacggcctgcctgacatccctcctttttttttagaaacacagtacaaatataggcgctcacaacgtgcgcacactcacccctatgaatgcacacacgcacaccctacccctatgagcacctccgaaagactgggccggcatatcttgacatccctccttttaatcgtcattaggattctattggtgttttattaacaatttttatacgtcgtctcaaccgccaccactctactcctttgtaggcctgttacttaatttatctcgtcatgtattttagatggtcttattttttaatagtctttatttttatcacaaattttagttatttataaattatattcctaattgaaatcttatttttctttttctaatttcataatttattttttaaaaaaattagttaataccgcattgtgtactttttaatgtttttattttttatttccaattttagttgttttaaaattgtattcctacatgaactctgttttaatttttctaattttggatattattttattttttatttgaaattttaattaatctcgtattgggttcttatatggattcttctttcaatattgcttatttttaattccaaatttcagctaattttaaattgtatgtctacttaaactcttcttttgttttcttttgctaatttcggatttatttttatttttattccgaattttaattaatctcgtattgggttcttatatggactcttcttttaatattccttatttttaattccgaatttcaactatttttaaattttattcctacttggactctcctttccttttctaatttattttttttatttttattttgaattttgactaatctcgtattgggttcttaaatggaaacttcttttaatattgcttatttttaattccgaatttcagctattcttaaattgtattcctacttggactctccttttctttctaattttggattttattttatttttatttcgaattttgattaatctcgtattgggttcttagatgaaaaattctttcaatatttcttatttttaattctgaatttcagttatttttagattgtatttctacctggactctcctttccttttctaattttggattttattttatttttattttgaattttgattaaactcgtattgggtttttatatggaaacttttttcaatattgcttatttttaattccgaatttcagctatttttaaattggacttctacttggactcttctttttctttttttctttttcttcgattaatgtaagaatttctagccccacagcgaacgtggtgcctcttttcaaagctgttttagtaatataatagatagatgccatcatcaggtttgctaaaattccactatcaattcatgggtgttcgatacaatgttattttcatccttttaagtatttgcatatcgttttgactctatttctcactacccatggctccatgttttctctcttctcgaaaactggtcatctcgtcattgttttcccaacgagctgaggtaggagtgtgtggcccactagtgcaccgcatcccgctattccgtagccgcatcggcaccccgcctcagcatccatcgaagtccgccgtgtcgtggaggcggctcatgctcccctgtcgtcaagctgggacgcatcctcctacgggggtgcatcctccagagcggggttgagcagtgactagcgggcggcacaggggtgagcggccaggcatgccggggcggcaagttgtcctgggtggtcgagtctggcgcttgggcggcggggacgtcaaggaatccttgcatcactctctgctgagccgcttgccacctctgcctcctagttcgccactcgcattcatcgtcgtctcatcgtttcctcaatcaatttaatgttgctcctttttgtttcttgcctcgatgacggtggttgattcctctccactgttgcctcgacgtggtaggacttctttttttcttttgggtcttcggaggaggtgtgtggatctttcgacccaacgatcccttccatccatgggcttgttgcggcagcggtgaggtggggcggtgttggcgtgtacgtggctcgctgcctcagccaagagaggaagaaaaacgtgagaataacaagtttggttcgatggagaaaagaaaaaggaacaacctgtccaggtccaagggcaactccagtagaatacaactaaaaagagtgcaaaatcatttctatttatataataggatgaaaacaacattatacggaacgccctccgattgactatggcattttagcgaaatccactaagtgatggcattccagcgaatccactcttttacgatggtgcatatgcaaattttcgtggatagactgcatcaattagttcccctcccggcagggagactcttgcctataatcgcaaagtaatatgctattatttccaaataagtgttaattcaactttatcaccaacaactcttattaaaatggttaaattaagaggatgggagttttaagtttttcatagcttgaaacaaagtgcgggattatccactattaaaaaaatgaaagttttatgtttatgattatgaattagtataatgctacacactttggtattattgtatcctttgaagtatttatttttctaaaaaaacaagtgaatggtcaaattttgaggattagtgttgttaggtgacaattactttaaaacaaattaagtatttgtactccttgttcccattctcttcaaattaaaaacagagccactaccattttttgtctttaaggtatataatgtaggaaaaaaagaacatttagtttaatttgaaatattttaacaaatgagagagctaatgatccgcatataaaaatggtcatgtttaaaggagcttctagcaactacgattttatagagtcttagactccaccaaactatccgcattattatccaag

SEQ ID NO: 26004 - DNA, 896 bp, Oryza sativa
accccccactatgaattctcaaacatttaatgttgagaaaaccacaatatctcaaatctcagatacctgagataatctactgtatctaacgaaagaagatcgccagaaaactacatagaatctatcctacaacaatactgagtatctgatcagaactgaagaaagcgggcatgccaaagtacatgttggactgtggcaacttaacttgggatcaaatgtcatacatgcattcttttctgccaaataaaactaagacgagcagaaaccttagctcttctaaacaagcatcattatgatgtgaaaacatgttaattccgctaataaaagacgaaacaaaaaagaaacaactaagaaattaggttgtgcaataccaccaactattttggcatcctagtcctaccgacaagtgaacaaaatcaagcagcatgccgtaacgctgaccgtagaacaacgtcatgaatggatgggtaccgtacacccatcgtacaagaaggttcgaccaatccgtgtgccaacaaaacagagggctgtagatcaagtcgtaaagtatccccctctcccataattttccgacaccaaaacagagggcaaagtttgacactttgacccgtttagcgcaactacccccgggtcccggcacaagattattacgaacacccaccttaaaaaaattcactccaagtcagcggtcaaaagcttcaagatctaccttgctcagctaccactcgtgcgctgctatgacgcggtccgtctctctcggtgattaacttcacggcttcaaccaaaccacgattcaacggggattaagccgctgcatgcgtcgctaaacacgctcacgaatgcgtagatgaacaacgatatgcctagaagaatcgccaagctaccgaaagaagcaa

SEQ ID NO: 26005 - DNA, 1760 bp, Oryza sativa
tagcctacgcatgattgaatgaagtatcctctcagtagtagtagtagtagtaatagattacggcattcgcatgtccaaattggtagttttaaatattgtctcatctaattttaggttggttctttctagaatggaatgattcgttatactgggtaggatcccatctatttttagatttgttttttcgaacggaggggtatgtcgtaggtcacttatacgtgggtcagtaaaaatatgatttttatataccagttatctctctactattataaaaattaagatatttttaccgttactttggtagatcattcgaatttgagtcggttgttaagttcgttcgtttttggaaatatagatccgtgttagagtccgcttttaagtctgatcacttttgaaaatacaaaaggagtcatataagaaatctctttaaaaaaacctcgcacactaacttgggatgctttttggaaatacagaaggagtcgtataagaaatactttaaaaaaaaactcgcatgctaacttgagatgagagatagactcctaattgtagctcatagttttctaaaaaaaatatccaagcaaattcccacaataattttcactctaactgaaccgtataataataataataataataataataataataataataataataataataataataataataataataataataagactaaaatagccttcatctgttgcaacacatgggcattttttctagtaaaataaaaaaaagtatcatctagttgttgttaccgctggtttttcagtaaattttaagttttagtagtaggttaataggattaaaagtatacttttcacttttctttacttagaaaaatggcaactaattgactcttcaagtttgtctaggccaaatattactagcaagtaggagtataggatatattcttggaagatgacgctacctaaagagaagcaaactagctaggcgctaaataattatctcacggaatcaggaatttcataccgaacatgcttatcatgaaccactaaggttttagtattttgacttcttgtaatatttatgtgacgctcgtgtagagaaaaatattgacgattaaggttttagtattaagttatgtactccctccgtttcaaaatgtttgacaccgttgactttttaattcgtgtttgaccattcgccttattcaaaaattttaagtaattatttattcttttcatatcatttgatttatcgttaaatatactttcatgtacacatatagttttacatatttcataatttttttttgaataagacgaatggtcaaacatgtgctaaaaagttaacggtgtcaaatattttgaaacggagggagtatgacataggacctagaacctaaaggagatatggaggcttccgaagatagtgaatactagtatttagtatttgtcgctctcatgtaactgtactagaaaacacgtgtttgagatttttttttccttggaacagcccagtcaaagcttctcgaggcattttgttctggataatattatcccacagtacattactagcggaattttcccatctatttttacaccgagatattctttttttttgaatttgatacatgcaattttgcactggacacaattatcctagattatgtttctatacatatatacatttgtattggcgctgttctacttaatttcactcttgtgcagtcaacacacagtgtgttgtgtctgccaggggcggatccaatatgggtgcag

SEQ ID NO: 26006 - DNA, 12146 bp, Oryza sativa
  unsure (1)..(12146): unsure at all n locations
ccttttggctaatattttggctcacaacacaccatgcatgcgtcgaatggtgggcccaccgagcgcggaaatgctgctagtgtggtttatgactaagatgatgaccccggtaataggacaccggtgcacttatgttcagagaacgacatggctattccgcatctttgtgaccacaacctgacgagacactgcagccttgtatcttgttccgtcatcatagcaaaaagccggacggatgcataaaagagtgttgatttattgcatatatatctgatctattcactggagtggggagtgtaaacatcaatggctgtggataatatttatgtttggccgatctcatagtggtaccatcctaccagctggttctaactagaagaaaacttggaggctcatgggaatttcaggtttgttggtttttatcgaatgttttgtgtttacacccaaatttggcacctaaaattaagataggaaagatcgccaagatttggaagtataccggttttctccgagtgggccggtctgaccgccgtgtgtcgggcggtcagacctcctgttgaaggccggtcagaccggcggtgtgtggctggtctgaccggcagtgtccgagtccgactgtgtttcatcgggtttcgggatttccttgcttgggaaggtatgtttcgagtttcctttggtttttatcccgagttgaacgtggaggagggcctgtaaagggcaagaccaacccctatataagggacatggccggttctattgtaaaaaaccaatctacaatcaatcaattgaatcgtttttcatattgcttttagtttctcttagtttgtccatctttgtcggtttgcgccgtaaaccgtccgccgccgctgcgagagtgcgacatctctttgtaggtttgtcctgaaaaccttccgttttgcccacgagacgggtagttatctaaaatcggctccgctagccggtttattcgtcaaaacccatctaagtttagctctttgctagattgaggtggttggcgactctaggatcactgcaaggcataaggtgctatgatcgtgcttgtcaacttgtcacaaaaagttgccaacacgttttgaacaaaatgtttaagtggattttgaatttggacataataattgacatttttggtgaaatttaagggaaaagggactagtgcagattgagaagccatcacattggtaggttggttaagacttaagagtatcgttcttagggtgaatggaggagtcagcggtaaggataaagatgctgctgtaatgtcatgagtgccacctagagggtggggctgaaagccgaagggatgcatacagggttcgacattgatgaaaaaccacgaaatttgaggtttgggcacgggaaagaatatattttgaggcaacttttgaatgtttttgagaaattcaaatttgaaacagtaaattcaagcaaaatgtaatcaaaatttatggaaattcgttgagaaaatggtatactaccaggagttaggtccagcagtccatcgaaaatgtaaaccctagatgcactacctaattagctgttgattgagctcttagccatcccatactacaacttaagtgtcgcactgattaataggattctttgtgacttatcaagttatcatttaaactcataattttgatctcatgcgtcggattgcaaacctgatcagcaaaactcaatccatttatatatacctttaatctcagtgatgattcagttttatttatcatgattgaattaaatgtacatcataactaaaaactaattgacagtggaccaacagtacacgtggttggaagaagccctggacaagttaactcgcgagtaggttggagcatgatggtaactgtcaacttcgcaatttggtcaataaataatttgatcctgagataatttatgcgcaattcgaagaaaaacatggccctcttccttttataaagtgtatccaggttcgctcacgaaatcgtcatgcgtctatctgtttacgtagcgtagaagcgcataaacatttggatataatatgacagtggatttgcccactcctgcacaggagtagtcgtctcaaactcaaagaaataacataacatggccatatgcccatagctcagtcaggcagcagacaaaaaacgggggctgaaaaccgtgtggcagagagaaaagttgccgagttgttgagctgatactggtcaacctttctttggtcaatgttgtggtcaacatgaatgtacaaatgaacagcttcggtagattagtatagaacacgtcgtggagcagttgctagttgctactgcaagtctttggttaaataaatgcagacctcgccatcaaaacataagttactatatatacagtcgcttatattagcttcagagcaaagtcgcagcaataccacttaccctccttgcttttcctcgagtctgactgactttaacctaataaaaattgaagctaagatcgatctcgattctccgtgtcaacatgcgtgttgcgttattcctcccggctgcatgccctgcattgtatataattcactaggctccgtgtccacgaggaccacgacctttcccggcctgatgcaatatcatatcaaaagcctcttcttaaacagcagaatatatcgaagtggccgtgacgaaaagcgagtgccatacgagtcacgcagcaatcagcatgattcgattcgacgccgctccactactgtagctctgctgctgctgcttcccgcaggtcgtgaagcggacggctaaaagaccaagcgaagcgatgattttgtttgttcctcgcgtgatcggatcggatcgcgtcgacgcgctttcgatcgggcgatgcgaggcggggccttgggcagtacatgttgttggcttgtcccctggagagattccacagccggtcgggcaatcggccgcggcgggctgcgggcggcggcgcccagggtggttcgcagttcacacgtgtccggcgccgggcgctgcatgccgaccacgccgggcgccgctgcggacggggacgtgcgagtgggagcgtgttgtgtgggacgggtttagatttttatgttgctgcctttgggagaggttctaagatcctggcgtgcggcgtgccccttcccagttgcccgcggcgaaaccgataggctgcctcctgtggagggggtgtgcgtgtgcgtgtgcgtgtgcgtgtgtggctgtgtgcggttgcatcggcatctcgtgacttgtggcgaaacagcgtccaagatctccttccttccacgcagacgcagcctcgtcgaacggcggaataggcgggtgttccgacttccgcgcggcgcttgctgaccgcgggcggacgagtgtgcgttctgggttctatatgcttctctgctgctctgcaactttgatcggaaaaaaaggttaacgcgacgcgcacgagcacacgggcagaggctgtctgtccctttttgtaggtttgtgtagtcgtgtatcgtcgccgtcgtagggagactggtcgtgcttggtgcgcgtcgttctgttcatgtccaggggcgccggaaacggcgtcacagataatacaatggaccgtcaaagtttggctcacgctgtcacgtactacatccatatctatattttaaggtaggatgccgtttattttttacccaacgtttgaccattcgtcttattaaaaaatttttatgtaattattatttattttattgtgacttaattcatcatcaaatattctttaagcatgatataaatattttcatatttgcacaaaatttttgaataaaacgaatggtcaaacgttggtcgaaaagtcaacggtgacatacattaaaatacggagggagtactcgtctgcgaggtacttgtaaaaaaaaacacgaacgataatacaagaacgagaggaccgtcgcaaatttcccccgaaactatcggcttgtttggtaactcgagggaaggggattgagagtttacacgaggaaattgatgatgagattaagatgggaatttgatttttaatcctaatatcttgtttggtagaggtgatggaaattgataggaagtttagttggagattaggtcattaataaaaatggatggctgagatttgcttagaaaaactaaaggagaaattacttcccaattacctgcccctaccaaggtattgaaaagaagggagtttcttactcaattccccatccccatcccaccaaaattatcatgtctcctaaccaaacaaaacacttaatagcctcatccctctaaactcccaatccctcttaaaaactcccccaaccaaacaggccttataactattgtcgatctggacctatttacagcggttgacttgatctaccaatggtaggctagcgatccatgacacggtggcccgagcagaggcccaagtcaggacacgggtgggcaaaaagcttccaaagcccaacaagcagagcgttcgattggacccgcctcggcctgtaggcatactcaggcccatcgaagccgatggatttatgcctaatccgtatatagggaaaatccaggtactgcatttttctttgccaaataaaccagcaaaatttgatgttttcgcaaatttttttcttttttgacacctttcccaaaagtcttcggagaactatttcagatgattttgtttttgtgtaattctaaatgtgaagatagagcaaatcaatctgatgggccgaactagaggcccaaatccgtgcaaaccgaggggaacaatattttcagcccaatattgaacacgacctcttccttctccaaacgaacgaccatgctcccaaatctctttcttgttcgaggtcggcgaagcgcgcgggcggcggcgatcggctaggtctcaatgagcggcggcgggtctccgacggacggccggggaccgccgccgcttggcacctggctccggccgccggcgcaacgggtattctcatcctcattctctccgatcccatttcccccctcctaaaaccacacctccactgggtttcaatcgctgcttataaatacactcttccccctccaatcccacatccattgggtttcaatcgccggggtttatacaaattccccctctaatcccacctccgactggtttcagtcgctgcgatttatccaattttctcctctgctaatccctccccaactgggttcaaaatccagttctttcccaatgtatggcattcccgggtggcatttcgattcccgacatccaaacgggaatcgactcgccgttgctgagctcggtttagcgaaccgccttctcccccccgcgcgcatggcgctatataaaccctcctcctcctcccaagaattaggagagggacaccaagtagcgaaatccacagcctttttgatcgaattgccatccgcgcgggaatccatttcggtaccaagcaagcaagccggtgcgagaggcgtcgcggcattagcgtcagcggccgcttcgtcgtcttcgtctcccttctcccccctgcccccccttcgccgctcggtgtcgcagggtggtgcgcttcctggacgacaatgtatgtactagtaaattggggagctagcgcggcgttgcatttgctcttttctgtcgtttgcttgatccttgtgcgttcttgaggtgttttgtggagcatctggtacaatcaagagcggttttggttgaattccggggacgggtgggttcttggctagaacgatccttcgcttcttgtcttttctttacgcgggtgaattcatgtagcggttcgtggattatctggtacaatcttggtggttctagttgaactctggatactgattcttggccgggacggtgccttttactcttgtgattctttgcgggttcagctgttctaggggttcgtggattatcaggtacaatcttggcggttttagttgcactctggatactgattcttggccagaacgatgttttgtactcttgtgattctttgcggggtgagctcttctaggggttcgtggagtatctagtacaatctgagtggtattggtttaattccgagattatgttcttggctggaatagttcttgtttgtagatatacaacttctcttttcttcttttggtgtgttcttgtggaggcaggtctatggattacaggaggagtagcgttcggctagttttggttggattctgagaagggttattggaaagaacagttcttgctcattgggttcgttctcttactatggatattttggctgggttggtgggtatagagtttctgttttgcatccaacagataactttgcactttgttcttcagatttggaaccaggaaaacataattttgggtcaatgtggaaaaacacgagttggtgcaaatgtttcctcttttgtgggtgcaaacagagatagatgcaaggtttcggttttgcttgcactaattttctctactgccaaattttggtttaattgttatccttgtaatcttttagaaataactgctgatttttccaatcataaatattggcttgcagtgggtttttatattttgtcccttgtgttgcaggaacggggggcatatgctccaatgtcaactggttttgcggcacaagccaagttggatcagttggagccatcatgtgcaaatgctattgttcagtacgccaacatatcaaagccaagttggatcagttggtatgcattttcagcccgggatgaggcaatacaagccttgattaatgaggcgaagtcatactacatgaggttccccccaatacaacacctccagcagctacccttactgcagtcaccttcaacgcggtatgattatgaatccccatcgctctatttggagcctcagtttcaggtaggtagttgttatcatggagttaagtttccatgcctccccgttggtcaaagtggaggttttgacatcccattttctgcgcatttgcagtctttgaacattccaggtgatggcttgccaagggattatctaaatgcacaagttaatgttctcgggtctgatgtccatgagatgcacaatcagaggcaatctcatcctcgtggccgacatagggatttctttggtgaaggttccgattttacgatttatattaccatcaactttgatggcggcagattaactaaggaaaatatttgggactacttcaagtattttcttctaacctttgtattatgtttactagtttggaggacaatactaggtgtaatatgatttaaagtttcaaattataccactacattcaattcaataattttacgatggtatttcttccaggaagttcgggcctgtgatcaatgtctaccttagctgtaagccagggaatgaaaagtacactttcggttttgtgacatttgaaaatgctgatacggtgagccttctcttatcaaagagcacacctcatttcatctttggagtaaaagttagagtcaagcgttacctggaatggaccaaacaagagcaaaggtctgttatctaactttgctgtttcttttgttgattgcttctcgcagtttttttaattaacctacaatgtaaacctactgttgttttcatccaaacgatatctgagttatggtttacaaactatactgttgagcgcctgttaggaggagtacatgttaacaattcccaaatcgatccctatgtcctggcaagcagcttggtgtgcctctttttcagtggggttatgtaacttacgtcacagtatcctgctgctaattgcaggctttgagtttgatgtgttctgtttgttctgaggtccaaatggcagtctttccacaatgtaactctcccttttctgatcttcatttatttggccggcaaaagatcaatccctctcatccaaggacttgcacaaaatcttccataagtgcattctttaggattctaaaattagttattagttgaagattctttctggaggtcaatttgagagttcctgaaatatggttgttaataaaagtatgatctattatcggggcctccttttgcatggcaatggttggtggggactaatttgattttaatattcattcagtctataggacagagttcatgcttttatgttatcatgcactcatgcatgtgcaggtgtgcttcataaatcatattgacagtttattcatttggttacttattttaaatgtgtagtcaaatcgtccattttgttccacatgtaccgtctttgcgaaaaaataataactagcttttctggctgtacttaagttgcagattgaatttttcagtaattatataattacgtacatcttaaacaagtacctgcaaggtatccgtttaatttttgggcacatggaaatagtttgttttcactgtacatttaagtttcacgagacatttatttactgatttaatggttggaaattagtttgcttttattgaactaatatttttagcttgttcaatcgtttttgctctcttatttacacattcaaacctaacatgcttactgatacaggaagcttcctcaagaaaacgaccattttgacaatgttgcacacaggacatcatgtgccaatgccttcgatggcatgccaagggattacctaaatgcacaagttctcgggtctggtgtccctgagttgcacaatcagaggctatctcatcctcgtggctcacagagggatttctttggtcacaatcagaggcaatcccatcctcatggctcacagagggatttcttcggtcaaagtaccgagtttacgatttatattaccatcgctaagaacatattgacttggaaaaatattcgggactacttcaagtattttcttctaaacttagtactatgtttactttgttttgaggacaagactaggtgcaatatgatttgaagtttcaaattataccactatgttcaattcaataatattatgatggtatttcttctaggaagttcggacctgtgatcaatgtctacatcccctttaagccagacaatgagaagcacactttcggttttgtgacattcgaaaatgatgacacagtggggcttctcttatcaaagagcacatcgcattccatcagtggagtagaagttagagtcaaagccttacctggataggaccaaacaagagcaaaggtactttatctaacttcactgtttcttttgttgattgcttctcagattgtctttaattaaccagcattttaaacctgctgttgtttttgttcaaacaatatctgattcgtgatttacaaactatactgttaagaacctgtttggataaaggggttagactcaaatctatagtaagtacattttaaccattcccaaatcaatccttctctgtcctggcaagcagctgggtgcacctctttttcagaggggttatgtcacggtattctgctaattacaggattagagtttgatgtgttcttgtttgttctgaggtccaaatggcagtcttgccacagtgtcctctcccttttctgatcttcatatatatagcttgcaaaagatcaaatctctctcatctaaggacttgcacgaaatcttccataagtgctttcttgaggattttaaaactagttattagctgaagattaattctggaagtcaatttgagagttcttgaaatgtggttgttagttgaaatatgatcttgaccagggacttctttttcatggcagtggttagtggggactaatttgattttagaaataattattggtctatgggacatcagtttcacgcttttttgttatcatgcactcatgcgtgcttcataaatcatactgacatattactcatttggttaattattttaagtgtatggtcaatttgtccattctgttccacatgtaccgtctttgtgaaaaaataataactagcttttctgtctgtacttaagttgcagattgaatttttcagtaattataatttatacgtacatcttaaacaagtccctgcaaggtagccgtttaatacatggaaatagtttgtttttgctgcacatttaagttccacgagacagttatttactgatttaatggttggaaattagtttgcttttgttgaactaatattttatgcttatacattgtgcaattgtttattctctctgtatttacatgttcaaacataataacatgtttaccgatacaggcagcttcctcagagaaacgaccgttttgacaatgttgcacacaggacatcatgtgacaatgccattgagggtcactctggtgagtaaatctgtaaatgcccttccttggctttgtgctgtgccacttctgatttagttctagacttatggttgtgattctatattttgacttattaagccatttcttttgtcatttctgataggacaaaaaatgccgaatttcattgaactttcccaggagacactgacacatcaatttggagattttgattcacctctaacacataacctctctgagaagaaaacagaatctccagaaggtattcatgtggaatttccctactccatattcatccttgtttttcattaaactgttatagtttttatattagtaagtcttagggcctgtttggcacagctccagctccaactccacccctcctggagctggagctcagccaaacagttttagctccaccaaaactaggagtggagttgggtggagctctctcacaaaatgtaatagagttgtggagctgggtttaggcagttncacaactccactccagactcaacttctggagttatatttaggagttggagctgtgccaaacaggcccttacttgattctgtgatgttttagatgatcatgcgacaaaagagtctaatgtggatgaatcttcagaattctcagctatgtgagtaatgagtactcctgtttctatttgcagattaaacagtcttatttcaacctgtacgatgcattattgcttctgagaacattattctttaagcaacacggaaacaaattaatgaaattaagagttaatacttttcataatttattcatgagaaagatcaagatatgttggaaaattggagcacttctgatgctgctgcacagttgtacatctgtaacgttgaagtggcatttttcattctttatgcagcatagaaacttttttgagtaaagttcacagccggtccttaaagttgtagcgaggtgtcacttaggtctatgatctaggaaaattgtcaatacggtccgcgatcttgtttaagtgaatcatttannnnnnnnnnnnnnnnnnnnnnnnnnnnnnnnnnnnnnnnnnggccgtccacggtggcagcatttttgcattttagccccgccgcatcttgcctcccctatttccgatccaggcagtctcccccaaatcctcctccttctacacgcgaccaaaattgacccccattctctcgttctggccgagctaggagcactccgaggaggggcggcgattagggcggagtcggcgatcggggtcagggtggccggagacgcgttctgggtggcgcgtttggccgccaaccgattgggcgccgtcatcggaggcgtcggaggcgcgagatggacctgaccttgcgagatgaaggcgcacctgcgcctgtttatagtgagtgtcgtcgtcatcttttaatccctttcatttggtaagtttaatctgtgattgagaggtttggaagtttgtttcttcaagaaatttgggacttttggtcggtggcaattttttctagggtttcatctagaatgcaattagttgattttgtgttggtaaatgtgtgtttttttagctattgtgatgtaatgtagggtttagtatgttgtctcatcccgaatgtgtgcactatataggtcctggatcaaagtacttttcaattgagtttcatcatggggggtttttctgtggtatgggagtgaaccgcacatatatggatggcaaagtagactggtttgacaatattgattctcgagattggggtagatgtctacatttagcagactttgttgccatgcttggatatgactctgatggaaagttgaaaacttattggttattgcctggaaagaacatgtctgatggattgaggatcatagacagtgaagttgagatcaatgtcatgaaatcagtgtnnnnnnnnnnnnnnnnnnnnnnnnnnnnnnnnnnnnnnnnnnnnnnnnnnnnnnn

SEQ ID NO: 26007 - DNA, 829 bp, Oryza sativa
  unsure (1)..(829): unsure at all n locations
agattttggcgttgttaggagatttgcacgctggtgtgaggaatctaactttcactgctaaagatgtctcaaatttgaggacaaaattgagacaacaagtttcactcaaagatgttgcaatgactattgattatttccaaaaaaaaaaaactcaagcagataacccctccttcttctatgctgcaagatatgatgaggacaacgtgttgaaggcgctgttttgggtggatggcagaacacggaaactgtatcaaagctataaagactgtgtcttctttgacacaaccttaatgactaaccgttacaacatgccatttgcacccattgttggaactaataaccacctgcaaacaatattgcttggatgtgctttgatttgtgatgaaacaactgaaacattcatatgggtctataaaacatggatgcgagcaatgaatggacagaagccaggttcagtgatgacagaccgagataaagcaatgagagcagcgattaaaaaggtgttccccggtacaattcatagatgttgcttatggcacgtgacaacagaagcagatcagcagctcctgcccgtgtatacttcaaagaaaggcttccatgaagctttgtatagatacatatatgactctaaaacaatagcctgatcccttcattcaatgaagcagaatcttgagcaacaccatcttgggcaactgttaacaaccaaatttggtaatatcagcatcgggaaagaaaattagataaaagcaaagtcggaggcggagatcgagttcannnnnnnnnnnnnnnnnnnnnnnnnnnnnnnnnnnnnnnnnnnnnnnnnnnnnnn

SEQ ID NO: 26008 - DNA, 1117 bp, Oryza sativa
taaagaaatccaagaaataaactagtagccaaaaactagaaaaacgagtttctccggattgtcaccatcttctaagaatctctagctcccaaaacatgtagttgaggaacataaatacagagcacgtcaagactggaacaaacatgaacatccagattaagcaccaagtataactgggtatatatcgatctgttatctgtatgacttaaggcacggtacaacgacaaggtaacatcatagcgaactagctatgccataagtttctccttttggagtgacgaacagctacatatatcaaccatgttcctgaaggtaaccgagactatatatataagcggccactacagttctcagaagtatccagcattttgggctgtcctgatgatctgaaagagagctgcacaaagaaaagagtagaaaacacaatgacttggtaagatgttcataaagttatgatgaaaaagatggaaactactgccaaggctgtaatgaagactgaaatagttgcaggatttttcatgcaaggagttctattttaccaacattagactgtctgttccatttgaatccttaactagggtaacatcaaaccttcctcttctattttccaaagtcttaaggagaagcatatatttttttgagaagtttataagcatataaggatttattgcctggcaacagattagtagctgatgtccatgggtgtggtagctgcagcagttaacaaccatatctggagtaaaccatgagactatttttggaattaatcagagcaggaatctagcttcttattctttgaaaaggatttgactaatctaagatcaaaacaggaaacacatagatactttcccacaaagtgataacatcctaaagcaaaactaatgatgtgtactacagctacccccatacacgactactgataatagtactagattagcactttcgcaatttagcacagtttagtcctggagagagcacagaagcaatacccataaaaacaagaactaagggtgaaaatagttaaaatctatttaggttggtaaaggcattctgagttatgaagagtatgagtgaagataaatagctcaaccattcaccacaaatatataaaaaaaga

SEQ ID NO: 26009 - DNA, 478 bp, Oryza sativa
tgtgactgaagcttttggataattgtaccgaacagtatccaacgaattcacctgttagagtttgattgaagtctgattaccattataataagtactgaaaagtacattaaacctagacggaggaaaaggttcactgtgcacgtacctgagtttaggtagatttctactacctgattattatcaaagctgtttaattcagccctggtttctattaagaaaaccatcatgctagctaacacgcaatgcagatttgcagtacactagttgttgacttgtagattcttttcacatagtgcagatatgcactttattaattatacatatcttaggtacagtcttggatttgctaaaccttcgaggtacaagaggatgcacgttcactcttctgcaagtcaaaactgcagtacctttgctgttagcttggtccttcgatttaagaaacattgcttagttcttactacctccgtcccacaatata

SEQ ID NO: 26010 - DNA, 743 bp, Oryza sativa
  unsure (1)..(743): unsure at all n locations
caatcatttatcctgcatacgttaaatattgaacataaacaagaacatggacacactgaatcaaccttagtagtctacctctacttcattatctatgtccacaagaccagttgatctgctagctttactcttggcatgcagagcatcgactttttttgaagtgtcacatctgtctcgtgttttaggttgtcttccttcccagttttgtttcagcgctggtttttcccggcctggagaataaagtattaatacaaagtaaccactggatatcagggattttcacagcctttcatacctggtttcttgattggagcacgaggattgtttgaataaagtacaccaggatactccaaacctgatagatcatcctgaaaagagtaagagaatatattagaatgctggaaatgtagaatattgccaatggtaagtttctcatatttcattctatgagaaatgaatgaaagttagcatcacaaaactttatccttttgaatccaataatctgcaattctgcctggtttggcatgtggactaaacacccagtgatgcagtatactatatattgaaaactcaatgcagaacagatcatatagtcagggtggcagaagaaacataactgattctctctccctctctcttttaagtcttcactaatcagcagaaaagcgagtttcgctgtttctattggnnnnnnnnnnnnnnnnnnnnnnnnnnnnnnnnnnnnnnnnnnnnnnnnnnnnnnn

SEQ ID NO: 26011 - DNA, 576 bp, Oryza sativa
  unsure (1)..(576): unsure at all n locations
nnnnnnnnnnnnnnnnnnnnnnnnnnnnnnnnnnnnnnnntaagggtccattccctcttagctcctttgtgcctacagatgagcgattttgcaagaggtgggctgggactagcttagaaaagtatcatacatttcgtcagagcatgctgctcaaaggtttttcagagaagactggaaggaaaacattaacatcgaggcggtagatacttcatgattgagaagtaggttgtttttgaacctatgccacgctgtaagatgatcatttcacgcagtacctcaaatattttgagtttattttacagaagttgcttttcatagcaatgctgattgatttactgtttgcaggaaaaggcctgggttgctgtgctggtattcaatcatcagcattcggcacacatatatcaatatcacagatacatcactaactacagtttagacttccttttttttttactcctattacaacaaggtgtaaattcttcatctgattcctccagtagaaaaacaaatggatnnnnnnnnnnnnnnnnnnnnnnnnnnnnnnnnnnnnnnnnnnnnnnnnnnnnnnnnnnnnnn

SEQ ID NO: 26012 - DNA, 1580 bp, Oryza sativa
  unsure (1)..(1580): unsure at all n locations
nnnnnnnnnnnnnnnnnnnnnnnnnnnnnnnnnnnnnnnnnnnnnnnnnnnnnnnnnnnnntgcaactaagcccacagattctggtccagcgaatcgatagtgcatggaaatctcgatttctttttctatcaaaagaattaggggctccaaaagataacattgttaaaatggtcacaaaacacccacagctgcttcattacagtattgaggatggaatattgcctcgaatcaatttccttagaagcattggcatgagagatactgatgttctcaaggtattgacgagtctgactcaggtattaccacattcaagttccctatccttttcatttttgttttgtttttacaagtatcttcattgttcaatgtagacagatgccattataataccctctaatatttgtttcttttcaggtgttgtctttgtccttggaggaaaatctcaaaccaaagtatctttacttggtcaatgaccttaaaaacgatgttcaatccttgacaaagtatcctatgtacttgagcttgtcccttgaccagagaatccgtccccgtcaccgttttcttgtttcattgaagaaagctcctaagggtccattccctcttagctcctttgtgcctacagatgagcgattttgcaagaggtgggctgggactagcttagaaaagtatcatacatttcgtcagagcatgctgctcaaaggtttttcagagaagactggaaggaaaacattaacatcgaggcggtagatacttcatgattgagaagtaggttgtttttgaacctatgccacgctgtaagatgatcatttcacgcagtacctcaaatattttgagtttattttacagaagttgcttttcatagcaatgctgattgatttactgtttgcaggaaaaggcctgggttgctgtgctggtattcaatcatcagcattcggcacacatatatcaatatcacagatacatcactaactacagtttagacttccttttttttttactcctattacaacaaggtgtaaattcttcatctgattcctccagtcgaaaaacaaatggatgttccaggagtcaatctaaggatgaaaagggatgcaccagaatggttgatgtggcattttgttgtctactgccacggtgacatcaccttgaccattagctaatgttaaatatgtctagcacaacaaactaaccatctattagggatgtattaggcagcatcctacgttgccgtaagtctgtagcgtcgttaagcacgatattttattttccacggttgtaaatgatagaaattctatcaccagttcgatctgtactttgtgcgcttttctggtttgttatgttggaaaattattcctgttgctgtggcttctatctgtgttgtgtttggtttactagtcatatagaagaaatcatatttttcgtgtataacgttatgctgcaacacagcatttacgatataactgatctagataagtccctggtgattgaaaggtagaatttagcaaatactccctccgttttataatgtaannnnnnnnnnnnnnnnnnnnnnnnnnnnnnnnnnnnnnnnnnnnnnnnn

SEQ ID NO: 26013 - DNA, 717 bp, Oryza sativa
  unsure (1)..(717): unsure at all n locations
nnnnnnnnnnnnnnnnnnnnnnnnnnnnnnnnnnnnnnnnnnnnnnnnnnnnnnnaatcagtgcgagaaatacataaggtaattgactatatattgtattactgaagaataaaataaaacattcctttttctgaagggctataagagccgtcccaatacatacaacacaaaataggttgtatctaatccatgtaatctaagacaccattaaagaagttgttcgcctagtgcatagttgaacctatctaatcaattttattacccaatcccaattaatcacctaatgtctagacacattggaaacatgtctcaatactataaatttttgttggagtctccaggtgttcgacacggtcatatgcctcttctgctggatgatctggaaagaaaggagcacaagagtctttgaagccttcacccactagttactgtaggtcgcagattgcacaattgatgagcggaggacatggaagatggctggactaggtgcctagcatagcacaacagattggtaacctgaagtgtagcattgtgccgacgagcccaggtcatcaggcactttgccttggttttatgacagggctcgcttcgcatctcagtctcacgcccgatatgcttcatcctctgtgttttggctgagcatttacaaagtctataaaattttaccccctcccttctaatacaagttcggtcggcattctttgtcagcccagcgaa

SEQ ID NO: 26014 - DNA, 807 bp, Oryza sativa
attatgtgctggaaaagttagatctaagaacaaatggagatgctcttacagctggatagaattatactatatgtactgatctcttcccggccctcaacctaaagtcatgtttttctttaagaaaaaaaccatgaattcgcagcatttttatggaacaagattagtttttctggaaaaaaataattaatcctctatatatcagtatattccaaaggacctctgaatggtttcgtggtaaataatattttacataagaagttcatataatgcttaatattgggctgttgcacatatggtatataagaacttttacggtaaaatatactaccagtatatactggtagtatatagaagggcatgttaagaatttgatagaaaataaaacaacactctagtaatttttgtttcagattaaatctaattggagtacccggtcctggatcttatcatgcgctaagagaggagcatcgtgagcgctatttgatgacgaatcacgtgacgataacacgatttgatgaaagaataacgaagaaaagacaaaattaccctttcaaactttatactgcaatctaattaataaaaaatcaaattaatctacactgttagatcatatatacttgcagtatatactagcagtatattgtaccgtaaaagtcctcatagcatataggctagtctattataactcgttaatctaatatattatgaaggtagcttgaaaaactaaccatgttcgctctgaacaagtactataaattctcacattaattataaaaaagaaaaaaggtttggaccattaaattatat

SEQ ID NO: 26015 - DNA, 746 bp, Oryza sativa
  unsure (1)..(746): unsure at all n locations
ctccgtgaagaaggtgtaccgcgggttcgaccaggaggaagggatcgaggtggcgtggaaccgcgtgcggctgcgcgcgctcgccgaccgcgacccggccatggtggagcgcctccacgccgaggtgcgcatcatccgctccctccaccacgagcacatcatcggcttccacaaggtctggctcgaccgcgacgccggcgtgctcaacttcatcaccgaggtctgcacctccggcagcctccgcgagtaccgcgtccgccaccgccacgtctccgtcaaggcgctcaagaagtgggcgcgccagatcctcctcggactcgaccacctccacacccacgacccatgcatcatccaccgcgacctcaactgcagcaacgtcttcatcaacggcaacaccggccaggttcccccccacccctcattactgcatccagtttcttcccagattagcagatttgacaagctcacctatcccaaaaatttagggctagaattaattacaatcaaaatcatgataacgttcgatctgttagactatattaggagcaaagcaatagcttaannnnnnnnnnnnnnnnnnnnnnnnnnnnnnnnnnnnnntttttcaaaatgaaatgtttgaaaactgaaatggtattcaaattctgaattgatagacggtggttcgagggagtataatttannnnnnnnnnnnnnnnnnnnnnnnnnnnnnnnnnnnnnnnnnnnnnnnnnnnnnnnnnnnnnnn

SEQ ID NO: 26016 - DNA, 1617 bp, Oryza sativa
aatgacattcatgatgccagtaaattcatacagaaactttcatctattcaggaaaaaaaatgttactcaagatgcaaagcacaatggtgccatcaccagctaactgatgcctgctaccaaatatttctgacaacatgttgatctgtccgacttgcatgttaagggagtaatttttacattaccccctagaaccagtaagcagggtttgaaagttgatcataactaaatccatcgaaattataaaatcaagcgtattgggtgagttatatgtttttgtgcctttattatatgtattagatgatactcaatggcacgtgataatgctgacaagaaaattagaaatgctttactatatcataaaaatagtaatatcctctgctcgatttggtggaccctgattccaaactactctctctgtcccataaaaaaaccaacctagtactggatgtcatcctagtactacgaatctggacatacctctatccagattcatcgtactagaatatgtcacatccagtcctagattcgtttttttcgggacagagccacagagggagtaatccctaatcttcacatcttatcctggaacacattttcgaatcaaagcataggagtcgaaaacaataaaaccatacattaaaatatatgctaaattgaagttacgcaggatcggaagcgttgtagtgtgctagacgacaaatgcaaaattgcatgggtcaattaatactcttcgtcgacatttcaaatgcgttataaagtaatctatatactaccaaatatgatggctagcccacgtaaatgcataaccaggttttctaggtctttgataggccaatccagaatatgcggttacatgaagtgatgtaatgcaagacaactagtgaatgttcgctctcggatcaggaaaatcaatctctgcgtcactgttattctaaacctgacattagttagtcagcaacaaaacttgataaacttgttaccagatcctctaaatcttgccaaaggataatattgaagcatagcctaaaaataaacatatcttttgttacgaaatgaacggtttaaactacaggtaggcacgatcatcatagaagtacactacactatctacatacaggagaaatatgaattcaaaagcaaacagatgtgcacagccacggatcttcctgcgaagattcagaagaagaggaacagaaacaagtaaaccagaaatcaacatttcgtcggttctatttcacaaaatcatcgccaggacaggggcggatccaacttgggacacccaaacttttcggggaacaaacaaactgttacttgtattaaggttaaggcactgaaattaagggaagagcttcttccagatctagaagagaagctagggttaacgaacgaacacaagcaaattccagaaccgatgggagagagagatgaatcagaaaaaggatgtgatgctcaccatgatcctctcccctgctctgctcgccagatggagatcgccgccactcccctgttcagccgcgactcgtcttggcggcgcaaggaggaggagacgagaggttttctttctgttacgccacaaagggaaggggaagacactcggagaaaaggggaaatttaact

SEQ ID NO: 26017 - DNA, 2661 bp, Oryza sativa
ccggagagaggggaaagggagagttgtgtgactgacgagtgggtcccacggcgaattttgcaccgcgctgccacgttggcatgccacataggcaaaagtggcaaatagttaaaagggcacaaccttagaagggcaagaaaataagggcaaatataagaagggaatttggatatttggcaaacctaaaagtggcaaatagttaaatttcccacagatatggcatatcttcacgtatgcggattgttctcgtgtacgccgaaggaatttatttcgaattatggaaaatatctctacgagtcaagtgatttccaaagtcctgcttggtggggataaagtttatgttatatcgtacaagatccgatgtctctgagttttacttggagatcaagatgatccacggtattaaggggcccaaggaggggtgcaaggcatcaaaattcatcaccaacacacccaccatagtttacgaagccagagtactcggagctaggtcaccgggagatctcgtcgggaacatcgactacgatctcgtcagtatcgtcagtttcgactactttctttgtaatctgtggttttccatcatcaatcccatataaactggagtagggctattacctgataaggggcctgaaccagtataatccttgtcttctatttgcttgatgtcatattacgtaaatccttgttccaacgtatcccaatacccaaatcatccggtctacgagtaccactcattgacagtggcacgccaggtaggggaacttggtgctcaaggttctacaaatatgacttcaagccatcccgacaacagtaccaacaccggcgtcaatcaaggagcctctacctcgacatcgctggtttggactcaagtcgggactattgtctttccggtctacaccgtcatgccgatctcgacaagcccaatcactattgggaacgagaacggcacggctatgacttcgagaaatgacgcttcgctgacaattcctcccacgcaagtggagaatggaacatcgacggccttagtacctggaaggaatcctcaagcggccgagttctgtcctctgaacaagagaccagagccgacaaggatacccatccagaaaccgaggtcttggtgtcccgtccataagacatccaagcatactctggaagattgcctcgtgatacttcacgcaaaggctgaactctacgcctgctggaaacgtgggattcaacgcacttcaccaacgggcaccacttattgcccgattcatagatcgagatcccacgatctcacaagttgcataatcttccttaggacattcaagtcgtcgcatcctcacatcccacaaccacgagatcaatctcagtgcgttgtcgaggaacgagacgcagcgactttagatcggttcgtaggctttatcggtgtcaaccctagcgagccatccatgctgcacctactgaaagattacgagtcttcttcagactcaccacgagacgtgaacgtgatcaatggtgtcgagacaagtgcttccgcggccgcgagaacacctccacaacaactgcggaacctcgacgcaatattaagagagagcccctttgaccctgtcctaaaccccgatgtcgatcagtgggcggcacgactacgagagactgtgaccaacctcaacagcgcattcgtggatgcagcagtcgagcctccaccccaagatccaccgggagggaacggtgaaccagctaacgggaacgcggaagcgcaaaaccctactagggaaccaccggctcgagacccgactccatcgcgtcgtgaaaatcgtgaccttcatgaacatctagatgaccggcggagggacaggcgagattggaatgacaatgatcgtcatcagcatcgctctccctccagacgaggagagaacatcgctcacgtcaacaccgtcaccgttccctttcacgccgaggtgggaacgcggatcgaggaggccatcccaacggtgaccgagatcggcaggcccgtagcgaccaccaagacaatggagataacaattgagaacggaggcgaggcagcaacaacggacgagaacgtagctcccggtctcccgcctctaggcgagatcgaagacgtgaccaccgttcgagaagctgggctcctaaccctagtggaccaccgttcgagaagctgggctcctaaccctagtgatccctcgtcttcgtcttggtcatcttcttcatcggacaagcctcctcgacgacatcacaaccgcgggccacctttcgcccaaggaggcgtgtgcagagcgtttgcgcgcacattgcgagatgtgcgatggcccgaaaagttccggacaggggcgatcgagaagtatgacggaagcacagacatagaagaatttctgcaagtctactccacaattctctacgctgctagtgcatacgacaatgcgctggcaaactatttaccagacgcgttgaaagattccgctcgttcatgactggttcacctcccaccctactcaatctcttcatgggaagacttgtggtaacagtttgttgtcaacttccagggaacatacaagtgtcacgcgattgaggacgaccttcatgccctaactcaaaacccagatgaatcatagagggactatattcggcacttcaatgagtgcaggaatacgatccccgaga

SEQ ID NO: 26018 - DNA, 1255 bp, Oryza sativa
ttgcacatattcggcggttctacatcgtacacctcaaaaagggagtacaaaaagatagaacacgaagtctgctccacgtcgcagggccctacctttaagatgagatggtcccaacacaagatcgagttctgggagacggaccaccctaagatggcgaccacacctggtagatatctgatcgtgatcgaaccccctattggaaatgtcaaggtagcacgggctctcatcgatggcataagttccattaatctactcttcgccagcaccttagatgccatggggataccgcgaagcgagctgacgcccacagatcagcccttccatgaaatcactccagaatcatcatctaagccgctgggtaagattacattgcccgtcaccttcggacaagccgacaacttccgaacagagcagatcacctttaatgtcgcagagttcgataccacttacaataccatcattggaagaactgcactcgcgaagttcatggcagcatcccactacacttaccaagttctcaaaatgccaggaccaaaagggacaattactatccagggaaacgccaagttagcggtgcagtgcaacaagcggagcctcgacatggtcgagcatactcccaacccgcccgccacaattgagcaccccaagaaagtgagcaagcccaacaagaaaccgaagttagacggcgccatcaagattattccgttgtccaactccaaccccgacaagaccatcaagatcggggcaaagctggatgacaaataggaactcgcgttcatcaccttcctccgcaacaatgcaaacgtgttcgcttggcaactgtaacgccccgattttcgttcgggaataaaaatcaattaataatacattttctagaaattaaataaaatttaaatcaacttaatcaagtgaattattgagggaattaaaaatttcctttaaaaatcattggccgagaatattttgtaatattctttgtgccctaaaatactctccggatttttccgcaaattttcgaagctcaagaaataattttaaagtcacaaagatcatttaaccaattaaataaaaagaaaacaaataaaaatctccttccttcccttttgggcttggcccaagccttccccttctctcccgcgggccgcgcgcctcttctttctctcggccggcccgcgccttgcgaaagtctgctttacgtcccccggtttccctcctctctctccatccggccgacaggtgggaccgtgggccccac

SEQ ID NO: 26019 - DNA, 2819 bp, Oryza sativa
cctttgtaaaaataaataataattgcgcaataaatcgagtttaattctagaaattcatttaaatggcttaaaacttctaaaatgcatacctaattcattcgaactccgaattgagccattcaacttgcaaaattcatctaaaattgagctctacatgtttgtttagtttttatgtactgttttcttggtttttattagagtttttcctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagctggtgttactttgatgacctagctagaactatatgcttagccatgcttaattaccactagctcagtcgatgggataattgcagtattagacattctagtatcttgttgagctgcgtgctcgagacatctggccattcttcagggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggtctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatacactgtagtttaggtgggttggttgggcctgttcaacgtggtgtagcgttgatcagtggagatttaaggttactttaattactcaacagttttactgtgttgctcaataaaatgttttacaaccgcctttatgcaaatagccacaaaccatccttgtatccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcatttttttttcgctgctgctgcttttgtttcggtgtgaggactaaatgcctcttttgaagtattttacgcttattttacgtttggaactggatattacttgtcggtttgtgtaccctggctggccctggacagggatttaatacgcaaaatagtctggaaatttgggtgaaatttctgggcgtgacacaaaccggcagacatgtcgggagtttccagggaggggattgagcacaaactgatggtgcaacccgaccccaagccagttaagcaaaaactatggagatttgcacctgatcgaacacaagtcatacgaattcgacaaacttctcaaaattggcttcatcaaagaagccctccatccagagtggctcgctaatccagtaatgatacatgaagccaacgggaagtggaggatgtgtgtcgacttcaccgacctcaataaggcatgccccaaggaccatttccctctccctcgaatagatcaactggtggattcaacagccggctgctagttcttaagctttctcgatgcttactccggctaccaccagatcaacatggcaaaagaggatgtggagaagacagcgttcgtcacgtccttcggtgtattctgctacaccaagatgccgtttggattaataagcgcaggcaacacatatcagtgcgggatccagggagcactaggtgatcagctcggacgaaacgccgaagcttacgtggacgacatcgtcgtcaaaaccaagacgggcgactcattgatcgacgacctaaggaaaacgttcgacaacctccgacgatatcaaacgaagctcaacccggagaagtgtacgttcagagtaccgttagggaaactactcggcttcctggtctccgggcggggaatcgaggccaaccctgagaagttcaaggcaatcgagaacatgaagtcgcccacaagactcaaggaggtccaacgattgacaggatgcatggcttcgttaagtcgtttcatcgcaaggatgggagaacgaggacaagctttcttcgccctgctcaagaagcaggacaaattcgagtggacccaagaagctgagagcgcgttcattgcgctcaaacgctacttgtcaaaccccccggactagttgccccacaaaataatgaagaattattcatttatattactgccacaccttattctatgagtacgtttatcgttgtagagagggaaagagtacaatacccagtgtttatgtcagcaaggccctccacgatgcaaaaactaaatatccacagatccaaaaactattttacgctgtgatcatgacatccagaaagcttcaccacaactt

SEQ ID NO: 26020 - DNA, 16038 bp, Oryza sativa
attaaagatgagttgtctattacctggtactcttgtgatatactaagtcattagtacaattaaagatgagttgtccattactcaatagtcttgtgatatattaagtattgttgggtcagtgtacttggctattactaatagtctcatgatatgttgatgcatgaagatgcatacttctactaacacgagataattaattatggttatatagattcagctaaaaaaagataaaattaatgccatcaatttttctcaacaataaagcattcgactgtggtctccttttctcactgcatgatatacgattgtaggtattaccgtaattctttcatattatttttttctacatatacgttaatttggactaatattttttctcataattaaatatttaataaatcatttttcatatttctactataaaatgtgaagagggcattgtataatttgaaaattatattataagtgtatgtaatttaatgtgtaagatatgaacttatagtataagatttaactttttataaaaatgctgcatgatagtagataggtaatgaactaaacaaccataaaatatatagtgaatccattgtgtgttattgattttgtccttattctacaatatgtcactaggtttgtcaagttctaatatgccatcgcattttgcttaacttctataacataccatcgtcgtctagttagcttctgttagtattgtataattttatcataatgaccgaaatagccatgggacgaaaaatttcaaatatctcattgtaaacttccaaagtttgagatggatatcttctctgccttgtttataatattatattttggaatattctgtcaaattttggaatttctgtcccggggatatttcggtcattagaacaaaattatacagtactaacgaagtctaaatggacggcgacggtatattacagaggataagcaaaatacgatagcatattgtataacttaacaaactcagtgccatattatagaacagggacaaagtcagcggcacacagtggattctcttaaaaaataatctagtcaaaaaagtttctttattttattcaaaacaaaacattttttctaccaaacacgttaggagaacttcgaaagaagataagaaaaaaaaggaggtttagtcattagctcaaacacacgtggggaaaagctactcacatccatggtatggtatatactcacattaatcgataatatactaatattattaaaattattcttcgtcttaatacggtgtaaaactaaaactttaaccttatattcttctgttattccatcttcttctcgctttctcattcttatttatttttgataataatattgctacaatcaacactagtacttgcacatgaatactagcagctaactcatatgtgtgtgctccgtaatatatattatctatgtttttacatgagtaaacaacaattattatatttcttaatgatattgtaattatataaggtacctaactagttttctaagaactggaaagatatttttgttaaacataatctagaatgctataaagattaataatattgaacgatatataaccatataatttttttataaatgaattagagatcgactcttgttaagaatccaatgatcataatgcactatatatattgtttaagtgagttatgatattctatttaggatgtgtttgacaaatgggttatgagaggtgggattgagaaagggaaatggatgaatgattaggattaaatgaggtgtgatgaatggatagttaggatacaatactaccctttggagggtggaatattatttccctatcctatttgcaaacaaagccttactagttacatgtgtatgcattaaagtgggatctagagataaaaatcagacactgctcgccaaagaagcacgaatgcacgatataaataaaccctctaatcaccggatcaactaacacgaaaaatgatatatataaatcctctaatcaccagatcaactaacacgaaaaaacacggccctcactggcgtcgccgcgaattggggagatgacgaaatggtgtgaatgcgaagtggggtggtcgaaaccggtccgcctttatttgggttcatggagagagacccaagcaagcggcgagctcctctcgtgcttcccgtgtgctatctggctggctgcacagtggttcgtccgagcggtgagccggtgacgcgcttcggtgcttgcttctgagcttttgtgaatcgtgactttgtggctgatagataatgccataatggcacgccatggtagctttattgccattgctaacttcttgctttggctgctatgtaggcaaggcgtaaacaatttctgtaatgaagaatagtcaaaataatcaattgtgataaaatatcccgatgtaatttattatatgaaacattgtgaaaccctaacgattaaattgctattattatttacattcattttcgtggtgatttttggtgagggagattgaatgtgactatgttgaccatagggagagacgtaagcaagcttaaagcaaccagggcttttgcctacataatcacaattaggtccttttaaatcactattgaaagtttttttttgaaaaaaaagaacttaaaatctagtagttgagccctatgtgagttctaggttttggtaatttctgactccctctctgagcagcaataggttcttagtccgataacatgttttttagggtttgcatgggttagttaaaaatatatgtagactgatggatatactgccaagaaaggggagacaataaatgtaccttttttttattgttttcacaaatggcattagctttgttggatacttttattctctcgccggctcccgcgtcatgtaattgagtggtagaatccatcgttgtagtggtaagtagtcaggcataatctacttttggcatgaaatgtggttgtgagtattttacttactccatttcaaaatgactaaagttttaatattaggagaaaaagggaaataatctaaatacccctcattaaatgagaggtggttgggggtaaagcatgaagaaatttaaacgagggtggttggagaggaagatattactttcaaattacacttatttaagacaatttcaatgataaatttctaggccagaataatataatagccattaggttttgtgaggtgctatgtgtttctttttctaagtgaaaatataatattgcataaaaaggtagatcaaaggggaaaaaaggccaacgaaccaaactagcatggcatcattataatcaacaaagacacccaaattgcatacaaaagtacccataatcatcagctgcttcttatgttgacatcacagaaaacaaaatggataggatgtgcagatgcaatgcaccacactggcctacaccaaaagtctctagacatgcaaacactgatcaatggagtagtatcaacttagagcaggtataatagtaggtggtaagactttaaatattatatctgtgctgacatggaagggagaaaaggttaggaaacgcaaaggcgagcgcttcagttagcgctagctctagcacagcctccaacgcaaagtggtggggcccataagtgggagggcatggccagccaattggatggagctaagccgagtgatacgtaaagttagttgaataaaatattaaaagtaactatgactagcttaagtagtatttcttctttttatttacttttgctgaggtggattattttgcagcggctgcgctattaaccttgctcttattagtatgtcataatgaatggccacatgggtacatggcaccagtcaccctcttgtcaacagtccaaatgtccaatctctcgagtcttgagaacgacctttcactcggttcgtcatttttttttcactaacaccttgctcgttgaaaaatatacccttattaattccattattattagggagtactggagaaatctaagagattgttcaaataagcataacattaaacgctattccttctcaaggatactattaaatccccactaataaaaagatatttggccccttactcaaatcccatctaaacaatcactgaggtggcattaattaatgtgtagggttagatcaatggcaagatgaagggtgaggatagagaagcagagcaggattttgggttcggatttacccaaccctcttatccggttcgatcatgtgtttcttataagttatatgtaacatgtgtccataaactaatatatatcactcgagtgatttttaaagtaaaaaagtccatgaatataattataacgcctatattttttttacatggtcttcaataacatagtttgactagtattttatttcattctataatctcaacaaatataaaattagcatcacatgaaagtaattcaaaatatgaatctagtaatataacatgcataatacttagtatagatatagttaggccctgtttaaatcccaccccaaaatttttcaccatgtcacatcgaacgtttgaacacctgcatgaagtattaaataactgtcgacgttggatgtcgcgattccggtatttgcatagtatggggatcgttggtactaggatatacgcgagacttaggtaaaagagacggaggagaggatttttatacaggttcgggcccctgaattgtcaggtaatagccctacatcctgttggccgaaaccggtcgttgctcttattcaccataatcacaccagtacaatatttggggtagcctatctatctgttgtcgacttggcggtctgaagtgctgactcgtagtcgacaacagggtagtcttcctcctcgaatctgtgcccgacgaggtcagagatagcgctagattcctctctttggttcccgtaggtaccatattgggttttcccaggcttatctctgatgtcgatatctggcagtttgtcttggcgtatgtaggcttgtattggcctgtggctttgtggcgtctatgttgtctgtgtccctctcctcctaggcggtcttgtatttatacccataggtgtccccttgtccaagtagaactaggaaaatcagtatggatacaatccgagtagtccttgtcgttttcatatagaactctagttatctttccttatccggaactccccctatatccgaaggttgtttccgtataagacatggtatgtggtgggtcctgccgagatttagtcaactactattaggtatgtggtatccataaccctgacaataactaattacacatataggctaaaaaaataactaattacacatattgcgactaatttgcgagacgaattttttaaacctaattgattcatgatttgacaatgtagtgctatagtaaacatttgctaatgacggattaattaggcgtaataaattcgtttcgcagtttacatacggattcggtaatttgtttcattattatactacgtttaatatttcaaatgtgtgtccgtatattcaatgtgacacaccaaaattttacagccctaaatctaaataccctttagtatgattattactcaaaagctaccaagtttattttttaaaaaaaaacagggcgccctataattttgggcggcgggagtagtaaaagctatttttttttacactcaaaccagtccgtgtatgtgcgcgtagctcgcctgtctcaacgtaattaagtgaacgataaatcaaataaggcaaaatcttccaaggtcaaaatggaggaacccactatccccagattaccacgggccaaaattcggcccaacctgtgatgaagcggcccagcccaagtcggctaaacccctctcctcttctcgtgccctgcctgattccgctgcctccaccgctccacgtatccccgaaagattctcctcctcgtcctcatccatcccccaccgccgccgcggataaaaatccaaggaatcgaaggccccaacgtgtagtactacgcctacgcgccccctcccatggcgccgcctccgccgctcgccgcgctccgccccgcgccattccctctccctcgcctcctcccctgccccgcctccgccgccgcccgccgcggcgccgtcgccttctcgctgcagaccaacgtgcggctcctcaagcccaaccgccgctcccggcgatcccggtacccctactacgaccacgacgaggacgaggacgacgatgaggcggagttcgagtttgaggaaggggaggaggaggaggaagacggctacgagaccgatgtaagttccctcgtttggcagtagccgcttctagctttgctactgtcgtgagaggttgcctgagtggctgggtccttagctaaaattgcttgcgtactcaagctcgtgccatgggataagtgcaaggctgtgctatcacatgatatcatcatccaattgctgctcattatgtaattagagctccggaaggaatatcattcaactgctgctcattatgtaactagagctccggtattccttttgttttggagtacattagagatgtgataccattttattgcgtcaggctagagagtttcagaaattgaactaaccaacatctcattaggttgtaggatgtaatgttgtatgcacattgagttaaagaggcataagtttgtcaaaggaatcaacaaacattgtaggatgtaatgttgtatgcacattgagttaaaagaggcataagtttgtgaagagcgcactagtggtaaatcatcgttcctgtatttaatggtataacaccttaaccgctcatatgataaactgttttaaaagttttctgcctggctgccacagttaaacaattcttatttatatggtttatttgttccatgcatatttatgtgcttaaatactcaatggtatgctcttaaacttaggctagctgggtaacagtaggtagaggtgggcattagggtgagagactaatttgatttctgccttgggtaaaccatatccaacatacggggaccaatagaaacagcgaaactcgcttttctgctgattagtgaagacttaaaagagagagggagagagaatcagttatgtttcttctgccaccctgactatatgatctgttctgcattgagttttcaatatatagtatactgcatcactgggtgtttagtccacatgccaaaccaggcagaattgcagattattggattcaaaaggataaagttttgtgatgctaactttcattcatttctcatagaatgaaatatgagaaacttaccattggcaatattctacatttccagcattctaatatattctcttactcttttcaggatgatctatcaggtttggagtatcctggtgtactttattcaaacaatcctcgtgctccaatcaagaaaccaggtatgaaaggctgtgaaaatccctgatatccagtggttactttgtattaatactttattctccaggccgggaaaaaccagcgctgaaacaaaactgggaaggaagacaacctaaaacacgagacagatgtgacacttcaaaaaaagtcgatgctctgcatgccaagagtaaagctagcagatcaactggtcttgtggacatagataatgaagtagaggtagactactaaggttgattcagtgtgtccatgttcttgtttatgttcaatatttaacgtatgcaggataaatgattgatttattttcgcagttgaaaaatgaaagtatctctagaagcttgtttcagaaacttcaagaagaatatgactttgatgataaatggttaccactaatcgattacttgtgcacatttggactgaaggaatctcattttacaaacatgtatgagagacacatggcctgctttcaaatcagtcaagcttctgcagaagaaaggttggagttcctgctaagtgttggtgttaaaagcaaggatatgaagaggatgcttgttagacaaccacaaattttggaatacactctcagcaacctgaagtctcatgttgcatttctggtgggcataggtgttcctagtgcacggataggtcaaattatttctgctgctccatcatttttctcttacagtgttgagcagtctctgaagccaaccataaggtatctgattgaggaagtgggcattgaggagagtgatgtgggcaaagtagtgcaactaagcccacagattctggtccagcgaatcgatagtgcatggaaatctcgatttctttttctatcaaaagaattaggggctccaaaagataacattgttaaaatggtcacaaaacacccacagctgcttcattacagtattgaggatggaatattgcctcgaatcaatttccttagaagcattggcatgagagatactgatgttctcaaggtattgacgagtctgactcaggtattaccacattcaagttccctatccttttcatttttgttttgtttttacaagtatcttcattgttcaatgtagacagatgccattataataccctctaatatttgtttcttttcaggtgttgtctttgtccttggaggaaaatctcaaaccaaagtatctttacttggtcaatgaccttaaaaacgatgttcaatccttgacaaagtatcctatgtacttgagcttgtcccttgaccagagaatccgtccccgtcaccgttttcttgtttcattgaagaaagctcctaagggtccattccctcttagctcctttgtgcctacagatgagcgattttgcaagaggtgggctgggactagcttagaaaagtatcatacatttcgtcagagcatgctgctcaaaggtttttcagagaagactggaaggaaaacattaacatcgaggcggtagatacttcatgattgagaagtaggttgtttttgaacctatgccacgctgtaagatgatcatttcacgcagtacctcaaatattttgagtttattttacagaagttgcttttcatagcaatgctgattgatttactgtttgcaggaaaaggcctgggttgctgtgctggtattcaatcatcagcattcggcacacatatatcaatatcacagatacatcactaactacagtttagacttccttttttttttactcctattacaacaaggtgtaaattcttcatctgattcctccagtcgaaaaacaaatggatgttccaggagtcaatctaaggatgaaaagggatgcaccagaatggttgatgtggcattttgttgtctactgccacggtgacatcaccttgaccattagctaatgttaaatatgtctagcacaacaaactaaccatctattagggatgtattaggcagcatcctacgttgccgtaagtctgtagcgtcgttaagcacgatattttattttccacggttgtaaatgatagaaattctatcaccagttcgatctgtactttgtgcgcttttctggtttgttatgttggaaaattattcctgttgctgtggcttctatctgtgttgtgtttggtttactagtcatatagaagaaatcatatttttcgtgtataacgttatgctgcaacacagcatttacgatataactgatctagataagtcactggtgattgaaaggtagaatttagcaaatactccctccgttttataatgtaagtcattctaacattttctatattcatattaatattaatgaatatagatatatatatctatctagattcattaacatcaatatgaatatgagaaatgttagaatgatttatattgtgaaacggaggaagtaacttctgattctggaaaaggaacgaacgttgggaaaagctatctaaagactgataaagatatactccctcattccttaaatatttgacgccgttgacttttttaaacatgtttaaccgttcattttattcaaaaatttttgtgaaatatgtaaaactatatgtataaataaaagtatatttaacaatgaatcaaatgatagaaaaagaaataataattacttttttttaacaagacgaacggtcaaacatgttttaaaaagtcaacgggcgtcaaatatttaggtaaaaaaagtcaaccggcgtcaaatatttagggtcaacggcgtcaaatatttaggtaaaaaaagtcaccggcgtcaaatatttagggatggagggagtatgatttttcgaaaacatagtggccaattgtttgcattttgagcaactggaactggtggtcaggtgctattccggggagaaatccccaaaagggaaaaatcgacgcatcacaagtaaagaaagcctcaaatgttgtcaacttatcaggaaaaagcacgtattacatgtctaggtagtaagcaacatgacaaaaaaatagactggatctcagggctatgcttatgtacgtcaagctgtttctgctttactgctaactgcaaaataaccctttctataacaacctacttgaccatgcttacttgtgaatcctaagttctgtattataagtataacccaaaaaccatcctactactactattaataataatctgtggaaacctacttgacctcactgcgtctgtgtacctatttataatctatggcaagtaaataattaataataataataataatttgtgtaccaatgtataatctcttgtcagtgtgtttgtagtattggtgaagaaataatagcgctcagtagagaccaaggctatctggaagaatgatctcatcactgcaaaacagttcagacgactcggatgttataactagaaatgccagatgaattatcttggaaaacaaaaaagaattaaagagaactgaaataacataagtaggaacagttacctatcttcatatgctgaagcttcatccaaatcatccgacctgtgtgatttttttttcatgttgttacctggaagatttacatgagacaaaatcagacatgacaaggaaaacgactgaatcgtaatcattccctcagaagtgacacagtacaaatctaagtgtaagaatttgctaacctatataatgctcattagtgacaccgaaacctgatgtcctgtgttcacgatagtcaaattgcttatttttccgataaatttttctgtatcagtaaatgggaatagaatgttggttattcctcaagttgaagatataaagagcaaaagaaaattacacaaggtataaccagcaaatatgaaatattagttcaccatttctctaaaaagaatagttataaagaaactacaccaataaagtcttcactgatagacaaaattcagtcaacaattataactgagcaagataggctaatgattttacaaacgatggtatgtgtagaacagtgataaaaatgcaaattgaacccctaatctgatgtagtgctgtaaatatgaagtataagcatggaatcaatctctgcaaaaatgatattctagatctgtcctgattgtgagatcaaattagccccactgattactgtaatgtaacatggggccttggtctttgctacactgttctttgacttctttcttttttttggatggtgcctttgctatagtgtggccaatggtaaccttcaaacaactatcaacttgacttccagaaacactcttcagccatgtcattcttcaaataaaataaatattattgcatttatggaattttcatgtgtgtatggatgaggggtattgttctgtatgttgtaaacccgcattacataatcagatccttaatagtaaaaactataggcttaaattgggtaaaccataaaggggaagcaaatatcatttttcatctttaacgtcttggtctgccacgcatgaaagcaaggaatcattttaatgaaatcgatagtggtttccaatgcgtggtagtaataatgtcagaaacagcaagcgacataaaacagccctattgaacagtagagtgttaccttagttcagacttttccatgtagcgcttgacaagaactcgcaatccacagatgaagtgagctgtcccctttgataagataagcctcactgtctcagtgtataggaagctcacaaaaccaaacatccgcttctcctgatagggaattcgcacaccggagacaggcccaaattgcctggcattatcaagacaatattgtcatcacagtaacataataacatgacaaattgacaattcacacctagtaacaataaagttaaggcaatacttgaagtaattctcgacatcatcatcagtgaatttgctgtgaacagggaaggtcatataaatctggttagacccagtgccagtatccatcaagttgcaactgtgagccaagcccaagcaatccatgtacttcttccgagcatcttccaccaggactacatgatactgtccatgttctctgaagttgaaaacggaaagagccatgatcaggatgtgaagaaaaaagaaaaataatcaatcatgatagagccatatcagaaattcatagaagaaaacctctcgaccactctgatggtgttaagccccatgagcagacttgtaagactgcaaccagtccttccatgctgctggctctcagtgagccatccatcaggccgcaggggcttaccgtacttctcaaagtacatcgacggcaaacgatcgactgcgactggtggtggtattccgatcaggagttctctgatctccatatccagcttgctcagcgacgcaaaggggtgaacttgcctgggattatgcagctcagggacggacccatggaagaactgacagttgacacctttcttgcagtaacccctgaagaaatggaaatggcaaggcttggaactcgacttcgagctactatgaggatgtccgacgagatttcgaccagcatttggagaattccttggcatgctcaaagactgcaactcttcctttaagcagatggattcaggaaatgagctctgcaatgctccagtttgatcaattaatgggcgacgttgagcttggattccacgataattgccgcttgattgacgctgagccctcaagtaagccagtgggagttcttgccccggtggaggaggcagcagtgagggtaaggaacgtagatgctcgtcaggactagctgcatactgtctgatctgcgggtatgaacttgttgagaggatgtaaccaccgtttgcacgcgatggctcgaattcccgagctctattcagcagcactgaacatttgttcatagccatttcttgattcctgcaacagaaacgaaatgatgggattttcattctataaaaaaaagttccacctagaaaaagtaggagattgttttctgataatttcactgcaatgcaaaacaagagtgagattgttttatgattaattaaaaggttaagatgcaaatactgtgacaatatagaactttagtccaagcaaaaacgaaaaattgcacattccactgtttccaccacaaacaacaccgagttcgtgttctcccagttgctgcttccaaaaatcaaacgacaaaaatgcagaaacaattctggataacaaattacaactctaccttaactaaaccaccaaacctcttcagaatacgagaagaacccatgattaacaaatgctgtaccaaaaaacccatccctataatataacaaaaccgaacgaatccaagatcaagaaatgccgtaccaaaaaacccatccctataatataaccaaaaccgaccgaagaccacgatccttcgcatgaacacgccaaaaagaaaaggcgaaatttcaataaatttaacatatatgcaaccaagaatcgttctgggcttctggccaagaacctgtcccccagaattcaaccaaaaccactcagattgcaccagataccccccacaaaccctcccaagaacccaccttgtctcgcagttctcctaatgcgcggatcccttcttggtccaggaagaaagaacgccaccatgtgaaacccccaagcgggcgcgattgcgcgaatgccgtacgtcgccgcgtgtgcaggccgcggggcttgccgcgtaggtgggatttagcagatgggaatcggtccagaggttggaaagattgtagctttcgccagttggtgttccctaaatcttgggactgagggtttatagtgccattttcgccggaagggagagcggtttgcggaaccgactgacgacgagagaggaggccctgcgccgacctgcggttgttcttcgtgtgccaagtgcgaacacaaacgtgtcccttttttttttttgaaattataaaaactacctggtgggccgtgtatttacgtggccatagctcccgtacaaaattatttaagcttttttcacgtgattttctcaaaatttgttaaatagtcatctcgttgtcttagcatattaaaagaaattgaatatttgtttttcagttttatagctcttcaaagttacaccagccatcacctgttacttttattctgcctctatttacttgtccgacatgtcacgacttatttcatccttaagacatttaaaaatcatatcttataatttttagagttcattgtctcgttaatttttctttttattgtttttagaagtcttgtcaaatgttgttactgtacttttttatagccagcccgctcttactctttattgttattggaatttaaaactgaacctagttatttttactttttataagtcccgtcaatcgccataaccttagtgcttcacggcctgtccgttgcctttctcttaatcgtcattggattctaaaaatcaaacctgctcatcattgaaggattttatttatagtttttagatttttcatcaaccgccacgacactaaccatgtatagcttatccgctaccccattcttttttggcatttgccactgttgtgttctagatgtattgttttttatattccttttttattatttctatattgtatttctacttgataactcatttttatctatttttagaatttatttttatttataactttaattaatatcgtgttgcgttctacgcggactattttttaatattccttatttccattctgaattttagttttttctaaattatattcctacttaaacactcaattttatcttatttttatttctgaatttattttattatatatttcgaattttaattaatcccatgtaatattctagatgatatatcctttcaatatttctttcatttcaaaatttagtatctctaaatgaggtagcttttgtaaatttttttcttttttttttccgttagtggcatgccactggcaaagagacggtatccgtaaatggtttaacttaggctgtgtttagttcacacggtgtgttagaagtttggttgatattggaacgatgtgacggaaaagttgaaagtttatgtgtgaaggaaagttttgatgtgatggaaaagttgaaagtttgaaaaaaaactttgtaactaaacacggccttattctcttcttccatattttctctcctatttggatcagaggtgaaggtggttcaattttctctcttgatttttttttattaaagcggttcaacattttctcctatccggtatttttctctcatttaaccttttttcatatgctattttagatcgcggatttttgagcggtttctctcttttttttaatggtttttcagaatatttttatatgtgggataaggtgggaaccagaaagatggctatggctagtaccggatatgacacatcttagcattacgaatctagattcgtagtactagaatatatcatatctgatgctagattcgttttttatgggacggagggagtagtagagactagatttgaattgctaaaactttctatttttaggatactaatttatactccctctatttcaaaatgtacttgtgccctttttaataagagattaaggctgggtgtgtggaaaatgactgtgatgggttcagatgagaaaatatatgagaaagattatgcttggttgagatgaggagataggtagagaagtagctgtattttttgaaaaatttaaataacacaagtagttgtgttttgagacaaattttaaatcctagatgtcgaagtgtgagctcctctatcggggtaccgcgaggcccc

SEQ ID NO: 26021 - DNA, 3795 bp, Oryza sativa
tcacagatcggtcacggaccggtctgacgcacccccccacaataaatgttgcacgtggagcgctcgctcagaccgccttaaacgcggttaggtgggcgctaggaacgcccgtctagcacggcacacgtggcgccacgtggagggggtcgaggtggcccgacccccaagcgaggagggggcagccgccactccaccccgggcctgaccctcttcggggaagtgtcatgtgggtctaggggcagtctcctcctttcaaactcggtaccctaagctgggagggggcagccgtcgctccagcccaggcccggcccccctcagggggggcgccacgtgggttcgggggcggcctcctccctctaaacatgataccccgggcccatatcaccaaccctagagcattgatttcaatatgtgggaataacattttcagcaaatcaggttctttataggaaaatctaagcaattcaaaaaattaattgctgagataattgaaagatattttttctcttaatcttaattttactaaagaacgtaaaaatatcttaaacttaatcttagtatttgcaaatgtttgcataatgtgtcacagttctttcagcccgtgggttaggaaggctgagagaagatgcaactatgcaagtacattaccggagtccggagacaggaaggccaataggctgcgccctgcgctgtgcggagatggagtcgagtagtcgaccgcacgacgctgaagatttagtaccatatgttgacgtaatatactcgtcccgttccaaattactcaaaatttatacaatataaatgtttatatagatatttcctatcaatcacaagttatccttaatttctactaaaactttataaaatgcctatattttgatgcgaatcgagaagaagaaaaaatccagggtcgatagatgcagctataaccagttatcgttgctttttctatcttttgccctatagctaaaatttaaattttaaattttacaactaaattttaaagttgatttagtatatattttctaccgtagatcttctgcaatggagtataacgttactcttcccaacaatgacattttcccctcaaatgaaaaaaagaatcagaatatgttccctctcgtttatcttccagcatacatttcagaacgacatcatcagctatggcatgctgcatctggactcattctagcatttcaagaacaaaactccaccgtgcaaattcagtcactcccctcctataaaatactcctgtaaatttagatgcttcactgaaacacaaaatacattctttttgtgaaggaactggtctaaacacttctttttttcgagggaacgggcagcctgccatttcattaatagaaggatagataggtctaaacacttctccaattataataacaattatatacaatgttaataagatgcaaccggtttaacccacatatctgagcaaatctacactcgataggcattcaaccaccttgtcaaaaaataggtaatcagccccccaaagaatgtacactcaagaatgaaactgtcacaagattaacacagtttcattcttgtcacagaaagattaacatgtattgtatggctacactcttaagtgcactaagctgtttcagcattaacatcaactgctacttaaccatgtttacgtgtagtagtatatcctaacgacttcagtgtgacgccaaaatcaatcaactaagaaacattcctccgggccactgtacacaaactttcccttttgtttgactggcttaggtggcttggaactagcaaagtcatacaagtgctgcttcaccttcactgttcctcactaaataggtcatctggaagacagcgctccctgcaaagcagttggcatatgtcggatgttacaaccagattaattagttgggggcgaaacacaatacagtatatgagtaagatatgaaatacaatggctgttgctattgtacattcaaaagcacaaagcatctgaagtgcgttgccaacatattttgacctctcgcgagaacaataagatgggagtgttcatttgcattgactaaaaaagtttgagtaaagttcacagccggtctttaaagttgtagcgaggtgtcacttaggtcaatgatctaggaaaatcgtcaatacggtccgcgatcttgtttaagtgaatcatttaggtccaaagcacctctgatcgggttgactggcttacgtggccgtccacggtggcagcatttttgcatttagcccccccccccccccccccggcatcttgcctcccccatgtccgatccaggcagtctcccccaaatcctcctccttctacacgcgatttctagggttagtgattgcagcggcaataggggcggcggccgtgaggacgagacccacgacgaggagggtggcgcgcacagaggcaacggcatgggaggcggcctcgggttcgtgaagtgcgctggtaggggaggccatgggtactcgaagtagtgggtcttcttcaagtgcccagaggagaaggtccgaccttcccctgataaagtgcccttgctgctgcgtgaagaacatcgtggagctcactgcaacgacagatgctaatcgcgggcgcatttttttcacatgtcctgaccacgaggtaatggtccgattgatttggttttgggttttttgagttcctttattttcatgaacatgacagtgcttgcaattgatgaatgtgtgtagaaggatggttctggatgcaatttctggtacaggaaagaagggtatgtgaagtatcttgagaggaaaggctacattgctgacaaggagctaagagatgtgaagcacatgtcagagaggaagaaggctgtgaacaatgaagatggtggggaagatgaagtgaagaagctaatgttatctctagtttccattgggttggagatagttcagatcttgaagggcatgctagttggttttattttacttgttgttgctttagtgtgtttggtgcttgctgtatggctgaaataagatgatgattatgggtggattatgtagtagttgtcagttgaggattatgcagttttaacatgtaatggcaatggccataattcactctagaatcaatggccataagtgtatgcagtttatatatgcaaactggattgactggttgtagtggtgttgtctgaatgtaggtggcaaaacaaatgcagttttaagatgtaatggcaatgggcttaatttactctggaatcaatgcaaattgggtactataatgttggcttgtatgattgcatttcaactcatgaattcagtagcaaataaaaattggcaatgatccatacaagaatgaataaaatcacaggtctgcaagttgaaaatcacaatttcagttggagaaaccatagatttgaacccattaagtttgcattggcataacttgtttgcatccaagcaagttcaagcaacaaaatacaatcccagttaaaaattttcaaatggttaccttttgtttgtctgtcataatggtccatggagaggtgttcactatcccaagttcagtcttcaaggtatcaagaaaccatgtccatgtgctgaaagactcaacttctaccacagccattgcaatggggtatatgcagtcattgggatcaattccaactgctgtcaacaattgacctccaaatttggtcttgatgtggcaaccatccagacaaatgattggcctgcaaccactgaggaatcctctcttgcatacatctagtgagaagtacaagctactaaatttgccctcatctaacctaagatagaaag

SEQ ID NO: 26022 - DNA, 1097 bp, Oryza sativa
agtttgcattggcataacttgtttgcatccaagcaagtcaagcaccaaaatacaatcccagttaaaatttttcaaatggttaccttttgtttgtctgtcataatggtccatggagaggtgttcactatcccaagttcagtcttcaaggtatcaagaaaccatgtccatgtgctgaaagactcaacttctaccacagccattgcaatggggtatatgcagtcattgggatcaattccaactgctgtcaacaattgacctccaaatttggtcttgatgtggcaaccatccagacaaatgattggcctgcaaccactgaggaatcctctcttgcatacatctagtgagaagtacaagctactaaatttgccctcatctaacctaagatagaaagaactcccaggattggacctccttagttcattgccataatcccacaacaagttgtattgggctatttcatcaccatatatctcttttagggccagcctcctagctcttgcaagcttgcttcttgaaggagtcaagttccactctttttgtactgtctttgcaaagctaggaatggtcatcttcccatcagccctaaatgactcagtgtacttttcagctaaccattttgcagtacacctttttagaatccactccttcttgcatttgtgatggggctcatatgtcttaacaatgaaggcctttgccctgctgtccattgaagcataaaagttccaggggcatccttctgcacaatgtgccttgatcctagttctatcattcctgggcatctttatgtccaccctgttcttcatgctatattcagagatagcctttctaactaattcaactgaagagaataccatgcctactttgaagattgggttgttaatgtcttcaggattaaaagacttaaacttcaagttgaactcatcatcatcatcatcacttggcaagtgcagttgttcatcatcacttgtgtcaccttctgacaaatctgccacaactttcttgcctttcaacacactacctgcagccttcttatggttgaatttcttcctatccccctcttccacatcaccatccacattttcctcaaagaggtcatg

SEQ ID NO: 26023 - DNA, 432 bp, Oryza sativa
  unsure (1)..(432): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctaaagaaatccaagaaataaactagtagccaaaaactagaaaaacgagtttctccggattgtcaccatcttctaagaatctctagctcccaaaacatgtagttgaggaacataaatacagagcacgtcaagactggaacaaacatgaacatccagattaagcaccaagtataactgggtatatatcgatctgttatctgtatgacttaaggcacggtacaacgacaaggtaacatcatagcgaactagctatgccataagtttctccttttggagtgacgaacagctacatatatcaaccatgttcct

SEQ ID NO: 26024 - DNA, 120 bp, Oryza sativa
aaaaaaaaaaaaaaaaaaaaaaaaaaaaaaaagaaaaaaaaaaaaaaaaggaagaaaaaaaaaaaaaaaaaaaaaaaaaaaaaaaaaaaaaaaaaaaaaaaaaaaaaaaaaaaaaaaaaa

SEQ ID NO: 26025 - DNA, 628 bp, Oryza sativa
agctttctgatttacaaggactttgaagactaaccttcagataggagcagaagtaagcaaaactgggaacaaattttggaagtaatctgacacgtgtgggaaacactgatatgagctgggaaacaatgcaagctccagaactaggaagatttctcagaacccagattgcatagaactcacatggtaatttgcctgagatgtcaaatgatttaatgtcctgcccagtgacaacaaaaaggggttagctagattttgttgctgaaatactacttatttatgtgatttagtggcaaattatgtttcccgtgaagcccttcatttcgaaaagagtgccttcgattgataaaagggttgattttacagttctaaagttaatgagtagctaaaagttggaacagaatctacactttcagtgccagaacatcttggattgaatttaaaagctatctaatagaatagaagtgaatctgacgcccagaaaaagagaggtccaaactacctagaaatgaagtcttttcagatctagcaactcatctaaagtctgacattgcacacattgttggtgggtctgaaagacttttggttattctgctgcaatcagtatgttgcaacagttgactagtaggag

SEQ ID NO: 26026 - DNA, 688 bp, Oryza sativa
catgtttaaccgttcatcttatttaaaaacttttgtgaaatatgtaaaactatatgtatacatataattatatttaacaataaatcaaataaaaggaacgatcaaatatattttaaaaaataagcggcgtcaaatatttattaacggtgtgagtatagtcctccggcgcggccgtttgggagcttaattaatttggcgtcagcttcagcagcaggcccagctcgccgccggcgactcgtcttggcacgacgacgtacggcagctgagcacaccatcgtggccacctcttgcatcgtccgaaacgattaggaggagagaaggaaatacatgggccggaaacgttaagctatataaagaaaagcccaactcgtacgcaactgttcaagaatgtttgcgaaagagaaaggccaaggtgtgtacttttaagaatgactctggtccaaacaaagggtcagctaattaggccagataagaaaatgtccgatttaattatctcaaatacaggtcaaatctcattcgtaactctcaattgcaaaaccgttaaaacggctgtcccgcgcgagatcgtgcttggacactcgcctgcgaaagaaggtaacaacagggatgctggcgagccccctacaagcttgagctcgggtagcaccgtcatcatcgatcttcatccaaccctgaaaacggtatggaa

SEQ ID NO: 26027 - DNA, 663 bp, Oryza sativa
ggtttatgcaacaacttaataaggcagtaggcaatcttccaaccttagctataagctcagatgcttgtaaggggctagagaatgctgtgaagaatgtttttcaaagggcagaacatagagaatgcttttggcacttgatgcagaatttcataaagaagtttcaaggtccagtgttcgggaacatgtaccctgcagctaggtcttatatgccagaaagattttatcattacatgaataaaatttatgaggcaaattcagatgtgaagccatacttagaaacctatcacaaattgctttggatgagaagcaagttctcagaagagataaaatgtgacttcatcaccaacaatttagcagagtcatggaacaaatggattaaagatatgaaacatcttccaattgttgagcttgcagatggtattaggtcaaagacaatgaatctattggctaggaggaagaagataggtgagaaattggatggtgtgatgctatctattgtggtttgtcaactcaatgcaatgactagagaactgggccacttgaaggtagttcaaggtgatagagaccaagctgaggtgactgagatcactgctgaacatcagattattagacatgctgtcaatctagtaaaccatacatgcacctgtagagagtggcaagttt

SEQ ID NO: 26028 - DNA, 448 bp, Oryza sativa
ctattccaacttcggctcctccttgccgtcgttcatggctagcaactgttctttctgctctttcctcgtctcctcaaatattcgcagcaggggtcggcggctggcgcggtgatcacaggcgcccgcccacatgaggacatgccttcctcgagcacggccgccgctgttgccgtcgatccaagctcggccacggcagtcaccgctcatggcaatttggtcctagttagcattatactccgtagcttgtagacatggatcgagagtggcattattttatcgaatatcttctgcgaagtgatattttggtgaaatccactgttgacaatggcaccatgtcatgtcagatttctcttacatagcagtatgatttcaacaagaattttttggtggattagagaacgtactagagtgtgtatgtatttggtgagagtgcatgtgcgtcataaac

SEQ ID NO: 26029 - DNA, 706 bp, Oryza sativa
aacaatgcatcatgcatgtattatgagcacaccgattagtgcgagtacaaatcttgaattgtcggtgtgtacagagattttgggtcccggagaattgaatatgactagtagtagattctacagacattttaacatctgcactgagtgacatttgagaatttagcaattcccataaaacaatatgcatagcatacagaaatttgttcaaactactcaagatatggttccaatgaccgagcttttttgttggtttacatgaatcttgtagacttgtactccgtactgtactatactacttcatctgaatttctgatctgatggatgggcaagggatggatgcagcaggtcctactaccggcagaataatcttggattcgagatttggattcttggtctgatctgacatgttgaccttgtagcagcattgaactccatctgtatgactggatgtgtgtgtccgtcttgcattgcaatgtgcagcacagagatcatcatcatgacagagccaactgaagctggcgtcaggagttgcattttcgtaaagggagatctcatggcgcctatagatacgagcaccccatttctgtgagttgtgatcaagacttcctgctggtagttgatgattctgcatctcctctgacaacaacacaaatgcatcctttgcatgcattacttgagagtaggtaagggcgtgtttaattcacgc

SEQ ID NO: 26030 - DNA, 530 bp, Oryza sativa
  unsure (1)..(530): unsure at all n locations
nnnnnnnnnnnnnnnnnnnnnnnnnnnnnnnnnnnnnnnnnnnnnnnnnnnnnnnnnnnnnnnnnnnnnnnnnncattgtttattggcactagttactcgatgtgcttgccagtgaaggattatccacacttgatgccaaatcacatatatttcgacgatgactacgggtacttggttcaccgtaaacatcttcgtcgggacgttggagtttatgattatacgaatgacactgcgatcgatgtggagtatcctcagccgtggctgaattggccactagctccagtttggattactccaagttttactaaaactgcaaaatatagttgactatataaatgcgtgtaatgttaccctttgtgtacatttttttaagtaaattttaccctcgagtgtcgaatcgtttgagcgatggctgacgatctataaaaaaaaataaataaagtagtaaaaataatttataggtaaaacttatttacgacttaaaaaccaattctacaaaatacactagggtaccgagctcgaattcgcc

SEQ ID NO: 26031 - DNA, 607 bp, Oryza sativa
ggggtttcaaggtgggagtaaaaccgtcgcggaggagagcgcgcgcggtggtgagccaggtggcgcgaacggtgccacaacgaagcaggtttgagaattctagcgtggtgaaaatggtgcagagcatgtcggccggtaggtctaactagttgacgggcggtggtggtgacgcggcggccatagtgacgaagagctagcgctagagccgacaagaagaattaatatccctaacaactaacaatgaatcggtggggcttgacctcatgtcaatcttgttgttgtggattattttgctagcaatggaacagagaaggagaacagaggagagaagctctgtgtttgtttcacaaactggttatgctttgctcaagtattgcacgttacattgattgttggacagcagcatcacatctaggacatagctgcctatttataggatggctaggaacttttctgaacacaactagtactggtacatgcatgaaaatactagaactccaaaagaacatattattgtctacactactctagaaatttcacagaggaaggacttgctccttgacttttgtttcatgagtagtagagaaagagttagagagtaggctgg

SEQ ID NO: 26032 - DNA, 643 bp, Oryza sativa
gcgtcagagagtacaacgatgctacgcgccatggcgctccagtctagaaaattccagaaaactccagaccagttagctagggtttggatcgcgagtggatgagatggggagaacgaggagcgcggatgcaggaacaggatgctaagttgctaaccttaagctgcgtgctcgtcgagatgcggagatggacgaaggcggtggctcgtcgaggtggacgaacgcggcgtggtggtgggtgcactcgccggagcccgcggccggagaggtagaagacgacggcgcgcgcggcggccgcgctctctctctctctccgtcgcagcaaaggagctcgcctcggctccgcgagatcggggggtcctggtctttatagccgagacagaaggcaaaagcttttttttctccctttttttctttgttttttttaaacatttcttatttccttattacttcctctcgaagaatggaagacttcgcacgaaatacaagcccaacacaacacggcccatctcctctgtcgccatcgcactgagataaactctctctcccgtagcccaagcagtggacagttactgagtgagtttagcatttgcttggcagcaaatggaaatactggtacacaatggccataacaaaagctacacaa

SEQ ID NO: 26033 - DNA, 219 bp, Oryza sativa
gctgtttttaatgccacatccgatgatcaactcgaacagatcgaggaggaggatttggctttggttgctaacaaagttgcttgagctatgaataatgccaggaacaggaaaagaggtggtccaaatcgttgctttgaatgtggttcaattgatcatcttcgttcgcattgtcctaagcttgggagaggcaaaagataagacaaagatggtgagaagacc

SEQ ID NO: 26034 - DNA, 742 bp, Oryza sativa
ggtaatattcattggatcaaactcccacttttcaaaagcaacaagcaaatcacgatgtgttgattcataaatgccttgctgcctagatttattctgaaaaatcaagaagcaatcagtgatatatatatgtcaacattccaaacaattgctctttaaaaaaacaaatctaaaccgatagtggtatttatggtttgcgatagtattattttaggttaatttgcatataacatgttccacttttcagtttattttctcttcttgattttttttttcatgtacccaaactggaccacattagtgtaaatcaagcgattttttgaaatctactataataatgcaaaattcattcaaaaccattcttaaaaacgcataagtggtggttcataagggttaaacaatctgattttacctcaatgagaggcattgccatcatcttctgaagaacctccaaatcatgcttgctgaatatttcagggtggcgcatggctgccgcagaagaagggagccacttttgggtcatccactggtagagcaaagatggcatgttgtgtgcaatccagagtgtcctctgctctggcacgatgagcctcttgaaggcttgcctggatagctcagctgggaatgaaggccaccagtagttgataattggcacaaccatggcagctcctgcaagcctgcacataggtacacagtatatatagtgaagagttgcgaatatgggtaccgagctcgaattcgccct

SEQ ID NO: 26035 - DNA, 665 bp, Oryza sativa
ccgatttttccgttctgcaactccattttgttgagtactatagcctgccgttagctgtcttcggatgccagcattttcacaatatttctcaaattcttttgagatatattctcctccttgatcgctgcgcaatactttaatttttcgattactctgattttccaccatggccttgaattttttgaatatctccaaggctgcagatttttcttttagaaaatatacccagatcattcttgtataatcatcgataaatgtgataaagtaccaatttcctccttctgaaattgttggcactttaccaactatatcagtgtgcactagttccaatggtgcacttgctctccaagctccactgtggggaaaagaagcccgaatttgttttccaaatacacatccttcacatgggtcagacttgagagtaataaatggaaggccttgaaccataccttttgtcctgagtagcttcaatgctctgtaattaagatgacccattcttttgtgccataaatcggaaatatcaatttcactcctgagagccatttgagttggatgattcatccttaatagaaaatttctgttcttctccatatttattttggcaaccagacgattatttttacggtccaatattttgcaagaaaaatcttcaaaataaaccgcgg

SEQ ID NO: 26036 - DNA, 766 bp, Oryza sativa
  unsure (1)..(766): unsure at all n locations
nnnnnnnnnnnnnnnnnnnnnnnnnnnnnnnnnnnnnnnnnnnnnnnnnnnnnnnnnnnnnnnnntgtcatgtgatgctgctgtccaacaatcaatgtaacgtgcaatacttgagcaaagcataaccagtttgtgaaacaaacacagagcttctctcctctgttctccttctctgttccattgctagcaaaataatccacaacaacaagattgacatgaggtcaagccccaccgattcattgttagttgttagggatattaattcttcttgtcggctctagcgctagctcttcgtcactatggccgccgcgtcaccaccaccgccggtcaactagttagacctaccggccgacatgctctgcaccattttcaccacgctagaattctcaaacctgcttcgttgtggcaccgttcgcgccacctggctcaccaccgcgcgcgctctcctccgcgacggcttctactcccaccctgaaaccccctgcctcctcctccgtcgccgatgccgagctctgcagcctcgccgacaagaccacctatgccccctccttcccaggcccacccatcagtgaccgatacatcgtcggctctgctactcccatcagtcattgccgacgcccgctctgagctccacctgctcaacctcatcaccggcgatcagatttcgctcctctccgtcaccaccattgaataggtaaaccccaatctgaaagatgacgccngcaataatgtcaccgcctataacggcttcttctacgacaccaat

SEQ ID NO: 26037 - DNA, 8775 bp, Oryza sativa
  unsure (1)..(8775): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnncaaaccttgagaagacaatttcagaatttgctaatgaaggagtcagagaaggtaaaagactatttctcaagagttattgagatcgttaatcagatgcgcctctatggtgaagatataaacgaccagaaggttgtggagaaaattttaatcagtctgcctgaaaaatacgagtacattgttgctgctattgaggagtcgaaagacttgtcgactctcacaattcagcaactaatgagctcgttggaatctcacgaagaaagaaagcttcagcgcgaagggagctctattgaaaatgcatttcagtcaaagttgagcttcaggcctcaaaactcaaggtttcgcggaaattttcaaaaaaaatggatttccaatgcgagaccgtggttatttttagaaaaatggcttttccaggcagaaggaagatggtcaagagagaagagaaaaaggtacgtccagttcaaatttgtggtgtgacatttgccaaaaatctagtcatactacagatatgtgctggaagaaaatgacctgcaacaagtgcaaaagaaagggccatattgcaaaatattgcagaactcgagaaattaatcgggctaatttttcacaagaaaaggaaaaatctgaagaaatggttttctcttgccatactgctcaagaagaaaaagatgatgtttgggttattgacagtggttgtacaaaccatatggccgctgatccaaatttatttcgagaaatggattcatcatatcatgcaaagatccacatgggaaatggctctatagcccaaagtgaaggcaaaggtacggttgctgttcaaacagcagacggtccaaaatttataaaagatgttttgttggtacccgatttaaagcaaaatttgctaagtattgggcagcttctagaacatgggtacgcggtttattttgaagatttttcttgcaaaatattggaccgtaaaaataatcgtctggttgccaaaataaatatggagaagaacagaaattttctattaaggatgaatcatccaactcaaatggctctcaggagtgaaattgatatttccgatttatggcacaaaagaatgggtcatcttaattacagagcattgaagctactcaggacaaaaggtatggttcaaggccttccatttattactctcaagtctgacccatgtgaaggatgtgtatttggaaaacaaattcgggcttcttttccccacagtggagcttggagagcaagtgcaccattggaactagtgcacactgatatagttggtaaagtgccaacaatttcagaaggaggaaattggtactttatcacatttatcgatgattatacaagaatgatctgggtatattttctaaaagaaaaatctgcagccttggagatattcaaaaaattcaaggccatggtggaaaatcagagtaatcgaaaaattaaagtattgcgcagcgatcaaggaggagaatatatctcaaaagaatttgagaaatattgtgaaaatgctggcatccgaagacagctaacggcaggctatagtactcaacaaaatggagttgcagaacggaaaaatcggacgatcaatgatatggccaattctatgctccaagacaaaggtatgcctaaatctttctgggctgaagcagttaatactgcaatttatattttaaatagaagtcctaccaaggcagtaccaaaccgtacaccttttgaagcttggtatggtaaaaagcctgtcattggtcatatgagagtatttggttgcatttgctatgctcaagtgccagcacaaaagagagtaaaatttgataataaaagtgatcggtgcatatttgttggctatgctgatggtatcaaaggctatagactttataatttggagaaaaagaaaattatcattatcagagatgtgatttttgatgagagtgctacatggaactggaagtctccagaagcctctagtactccattatttgccaaccactaccatcacactaggccaaccacatatgcatggcactcatgaagtggaagatcatactcaaagtccacagccatcaagtccaatgtcaagctcaagtgctagttcagattcaagcccgaacagtgaagagcaaatttctacaccggaatcagctccaagacgggtaagaagtatggttgaataattagaatctacttctccacaaagagggtcagaacaacatgaattttgcaattattcagttgttgagccacaaagtttccaagaagcagaaaaacatgataattggataaaggccatggaagatgagattcatatgattgagaaaaataatacatgggagttggttgatcgtcctagggacagagaagttattggagttaagtgggtttataagacaaaattaaatctagatggctcagttcagaaatacaaggcaagacttgtggcaaaaggctttaagcaaaagcctgggattgattattatgagacatatgctcctgttgccaggctagagacaattcgtaccataattgctctagcagctcaaaagaggtggaagatttatcaacttgatgttaaatcggctttcttaaatggctatcttgatgaagaaatctatgttgaacaacctgaagggttttcagtccaagggggagaaaataaggtattcagactcaagaaggctttatatggattaaagcaagcgcctagagtgtggtatagtcaaattgacaagtactttattcagaaaggatttgccaagagcataagtgagcctactctatatgtcaacaaaacaggtacggatatcctaatcgtctcactctatgttgacgatttgatatatactggcaatagtgagaagatgatgcaagactttaaaaaagatatgatgcatacatatgaaatgagtgatctgggcttgctctactattttctcggtatggaagtgcatcaaagtgatgaaggaatatttatatcacaaaggaaatatgctgaaaatattctaaagaaatttaagatggataactgcaagtcagttacaacccccttgttgccaaatgaaaagcaaaaggctagagatggagctgataaggtagatccaacaatttacagaagcttagttggaagtttattatatttgaccgcaacacgaccggatattatgtttgcggcaagtttattatcaagatatatgtctagcccaagtcaattaaattttaccgctgcaaagagagttttgcggtatatcaaagggaccgcagattatggtatatggtataagccagttaaagaatcaaaattaattggctatacggacagtgactgggctggatgtcttgacgatatgaagggcacatcaggctacgctttctcacttggttcaggtatgtgctcctggtctacaaaaaaacaaaatattgtcgctttatcttcagccgaagcagaatatgtagcagcatcaaaagctgtttcacaagttgtttggttgaggagaattatggaagatctgggcgagaagcaatatcagcctactacaatttattgcgacagtaagtctgcaattgcgatcagcgaaaatccagtcagtcatgacaggacgaaacatattgctatcaagtatcattatatccgggaagcagttgatcgccaggaagttaaattggaattttgccgaactgatgagcagttggcagatatatttaccaaggctttatccaaagaaaaatttgtccgcgacagagagctcatcggagtttgcaagaaataaattaagggggagtttgttggagttaatttatttctagaacataccagcctactctctaactctctctctactactcatgaaacaaaagtcaaggagcaagtccttcctctgtgaaatttctagagtagtgtagacaataatatgttctttgtgagttctagtattttcatgcatgtaccagtactagttgtgttcagaaaagttcctagccatcctataaataggcagctatgtcctagatgtgatgctgctgtccaacaatcaatgtaacgtgcaatacttgagcaaagcataaccagtttgtgaaacaaacacagagcttctctcctctgttctccttctctgttccattgctagcaaaataatccacaacaacaagattgacatgaggtcaagccccaccgattcattgttagttgttagggatattaattcttcttgtcggctctagcgctagctcttcgtcactatggccgccgcgtcaccaccaccgccggtcaactagttagacctaccggccgacatgctctgcaccattttcaccacgctagaattctcaaacctgcttcgttgtggcaccgttcgcgccacctggctcaccaccgcgcgcgctctcctccgcgacgccccctactcccaccctgaaaccccctgcctcctcctccgtcgccgatgccgagctctgcagcctcgccgacaagaccacctatgccccctccttcccaggcccacccatcagtgaccgatacatcgtcggctctgctactcccatcagtcattgccgacgcccgctctgagctccacctcctcaacctcatcaccggcgatcagatttcgctcctctccgtcaccaccattgaataggtaaaccccattctgaaagatgacgccggcaataatgtcaccgcctataacgtcttcttctacgacaccaatatcccaagaaagtaggacatgattccggcaatctaccagctcgacgagctccacaacttcatctacatgaaggcaatgacatcctccgacccagcgactggcgatttcaccatcatgctcatccacaatccttacatgcagctagatcatcagacaagcaatggaataagatcaccttccacaacaacatccgcttctccgactgcatcttcgatgacggcctctttctacaccatcacttaccacagagtggttcatctcatcgacatcaatccggattcttcctacgtgacaggagtgattgttcaggagactttacccatgatgtatctcattgtctaccttgctcgatccccgaatcatggtgattttatacaaatattcagattcacaagctcgttggagacggatcaaacggtgacacgcactactgaaatttctgtgctcatgcttgatcttgatgataattaaggacaggtttgttgactatgatttaggggacaatgatgtgttcatcggccgcaattacaccgcctgcctttctacaaaggattatccggggttgatgccaaatcacatctatttcactgatgatgatgagtgctcgcttcaggcctttaaaggtactcctagggatattggtgtgtacaactacgaggacgatactttgagtgaggttgtgtctcctcagccatggttgaaatggccgcctcccttttggattactcccagcttcaaagacttcccaaacacgtatagacaatgaaaaattttatggtccttaatatatcaggtacctctttttcaagataaattttggtactttgtgatacatgaggtaacttaaaaaaatatggtatcaaaatttatattagaaaatttggtatattctcaagtactgtaaaataactggtggatcatcacaatcttccctataaatttgtaaattttgttgaattcatttagatattatttggaccgtgaaataatcatgaataatgaaaatcttccctgcaatatttttttcgatttattcaatcttattgctttagatacttcgcactatgtgcttattatattagctaacgggctgttcgatttttatatttttgcatggggctactggatttggtatacaactcttatttttaaaaattttgactcgacaaatacaactgtaatttatatacaatagttttgaaaaaaatcaaattggatttgatatacaactctcaacatatttttcatagatacaatttttttttacttgataggtttatatgattgggttatgtatacaactctcttttctttccataaattacaaatataattgtaacaatcaacattttttttctttttctattcttaatgttagaatttctaggctctaaatgacatcttttttaagctatctttagatagatagacagacagacagacagatagacatacatatagatagatagacagatagacagacagacatatagataaatagatagctttctttttatagaaaatgtacaaaaccatagttagatatagatagatagattatatatctgaattttagtgacctgaagaagtagcttcatttttttttggatacgcacaaatgaaattgtttcgaaaatttctagttaaagaacagttagtaatgctttcatgccttcgttttgtgttaaagattttgaaaatggacaagaaagacgaatgcatcgaaaagagcattatttcccattatatatatttcaaagcaaacaccatctcccattattgttttcgataaaattgcaaaaaccaacatgaaagtatgttgttctttttgtaattaagacatgatacgtgtgttaactggaactttaattcttccaatcttctatgcaataacatccggtgtcaaaagatcatctgctgatgaggaaatacactatgattatcacttatcatgtatatatggtgatccaattatgctcctggagcacgcaataagttcggcacggggaaatcttttcggttttgcagagtgagaacctgacaaattttgctgaattttgtcaagagagtactgaaaggatgaagtcaccgtacggttcagagagagaaatgcctgcaagtttaagcaaagaacgtttatcttttcgtacttggctttgtatgtggcgtacttgcagatcttaccctatgcataaacatacttatccagctatcctcttgattaattatctaattaagagcatttcaattttttgggagatcctaaaaaggaaaacacggcaacgaccatcgtacgtttatataagaaataatctcctgatcaaactgccttccttcgttgaccacagaaattatattgtttagcatgcttgatggttacttatttcaggcatggtcggcagctaaatactagaaaaaaaaacataattaatgctcccttaacatgttgatcatacaattaggcagccagcaaggacagtgttctatatataaagtacagttgcatgtgtctcaattctcaaagaaaagcaaagtcgtcaactcgccataccaaaatggaatatgcttagcataataaatttttcataatcatcattatcttaaaaaaagcgaaatatttcatagtgatggtcagatggacacgtggaaattgcttacattgtccagccaagcatccggcagaagaacatgagcttctccgagcttccccatttctgcactcaacaaagccagccttctcctctgtttctttttcctttccttttctttttttttgttatgaaaatattgttcggtttctgtttcttaagggagcaaaatatttgaaagacaagtcatccaaagctgacgaaacactatatccagaagcttgatttgcagctgaaatgtatccaaatttggacgacattcgctcactcacggcaggctatatctatttatctatctatatatcatgtactttcgttgtccgcatagtttagattagatttacacggctttatatatctatgcgcctcttgttgtgtcatatcgactgatatatatagttcttctcatcttgcatgcaattgcaagcttgtccaatatcgtcgactgatcgatttgggcgagagacgacttttgtgagcttgtgaccatatggcaatggcgagcgtagcagcgttgcgtctcgtcgtcctcctcgccgccgccgtgccgctgctgccgccgccggcggcatcgctggccgtgacgtcgacgtacgtgcggccgacggcgagggcgacgctgtccgtgctccacgacggcgatggccgaacgccgcagcaggtaagctctcgttcgatcggtcgatgtccatgtcagatgtgttctcctcctctttctttctttcgctcgttggttcgatcgatttcagaggaatctgaaaatgtttacgtacacgaatgaatgcttcgaccatacagaaagttgagtacttatgagttctttctttgtgctcaatcatgagtaatacgaaaagttactttctgtaaattttgctgatagtgcaagtaatcagcatgcatagtttcagtacagtaatcttcctgactcctgagccatccttcatccttttctttttctgttggaggttctgaaaagaaatatctcaattatctgcatacattaagtttcaacataatctgtgttgaaaagattatatgttattcatgttgtcagaattgtcaatgatcataaccggaaaatgatttatattttgtactgcatgatgcttaatctctctttctgaagaatgaagtttatatttcaagtaatttcagaagaagtggtgaggggtctagagtctagacggttctattagacagtttgcatgaatcaggaagcaagtactcggttttatacatattaattttgtcattttcatgcatggtagccctggtactacttgaaaaatatgagaaacaaagttggaccaaaatttcctaccacatgttgagttggaacaaaagtcaattgca

SEQ ID NO: 26038 - DNA, 1079 bp, Oryza sativa
ttatatttcaagtaatttcagaagaagtgcgaggggtctagagtctagacggttctattagacagtttgcatgaatcaggaagcaagtactcggttttatacatattaattttgtcattttcatgcatggtagccctggtactacttgaaaaatatgagaaacaaagttggaccaaaatttcctaccacatgttgagttggaacaaaagtcaattgcaaatatgtgcttcaatctattcaggtcaattttaacatgagtggattagcaactgaaacttgtgggcactgcacccatgcccaaatttttttaataagcacaatcatttattaccattgttgtccctgctagctagtatacatgtatggctcggtatatatgtaatagagttaaaaaaacataaactacaattatgttgctgtctttcttctgaatcatcaagttagctaacaaaataagcaatagcattggcgtattatttgccagtagaaagatagcccatgaaatttctgagaaagaaagtgaaataattaaagaaatatgttaatgaattgtggattgctatatatttagcctgaaattgatgttcatgtacagcttagaagattgcaaagtcatgccagtgaaggtgatcaatatcatagaatctgagaggaaattaaactgatttccaaagaaaaacctcagagaaaatcaagaacccagtttcttcctgaatctgtgttcagagaactcaatcgctgctctgaataagattacagtttgtctatcagattactacagtttttgcaacaatgaagtgtatcttctcaagaatgataaaaattaaaattacccttttgcaatagttgacaaatgacttggcaattaactgtagctaaacttcatttgctagtgagcttgacacattttgctgaaacttcaggtgcatatatcagctgtaggctctgacaagatgagggtgacgtggatcaccgacgacgacccgcccagcaccgtggagtacgggacggtctccggcgagtacccattctcgccgggcggaaacaccaccacctactactacgttctctaccacttc

SEQ ID NO: 26039 - DNA, 4698 bp, Oryza sativa
ggtgtacggcggcggcgaggacgcgtgcgggccggtgcacgtgaccgtcggcgacggcggcaaccgggaggggctcgccacgaggtacgtcgacccgcagccggcggcgtcggcgttcagggaggcgagcttcgggcacggcaggctggaggtggtgaacgccacgcacgcgctgtggacgtggcggcggaacgacgacgacgaggcggtggtcgccgacgaggtgtggatcaccagcctcgcatccaacccggcttgcaacaagaagtattccatcagcttgtattgatgtgtgagaaactaggatgacgataggtagtgtgattctcttgatgattatactacttgataaatctctctcacataaattatatagtatatggttaatttgtaagttatgatatgaaaccatatttttattagcaaaactaatttataaattgattggactagaagtgcattcgtacaaagaaacacacacctcataaagctttgtaaatacttcgtactactttgtaaagcggtttataaatgtatatactttgtactgtaccaaagaagcaataaagcttcttgaattttaatgttgattgacaactaaaatatacactatatgtgacaaggtgtatgcatttatactatagtctatacgtattttaaaattttagtaaaactctgggtaatccaaataggaagtgtggctaattcagaaagggtttaggtgaaaaagtactcttcatgacttcatcatcatcattcaagtagatgtcatttggcataaattgtgggtaaatctttcaccgacagttagttcaggagacgccgccgccgccgtcatggagtctagcctcgtcgcaaacaaccttccctccgtcgcacccatacctgctccaccggcggtgcgttggcgtctccccggtgccaccttgctctggctcttctcgcgcctcctctcctctccttgctgatcctgctacatttccccgtatcagaggcagcgacgaagcttgatgttgtcgacaaactccccaatagagatggcaatttcccccgcaggactgggtcccctacgggggagtcggggccggggacccacatttgggcggggaggagacgggggagacatttcacccacgggtgacccgctggccggggagtgtatatgaactctcaaaatatagcccataaaaggtccaaaacagtccaacccagaaaaaaacggagatatataaacaaaattactaaaccctaaccttatcctctcactagtccccccatccccatctccctcccgtccacaccacgcacggggttgggcggcatagggcgcacgacggtggcgcggcgcagggtgcacggcgcacctctggatctcgtcgtcgccggtcgccctctcccttcccctcctctcctctcccctccagcctcccatcccgtccccttcacttctccctcaagagtccacctccacctctccctccggcagtgcaaacgacgcacgggatggcgcatagacccgatcacatggtaaggcgcggcggccggcgaggttgtggcaagagcgcggcggccagtgaggttgcggcaaaagcgcgacagccggcgaggggataggtgcggcggcgggcggcaagggataggtgcggcggcagccggcgattcaccggggccgaccattcatcctattttttatggggtgtcaagtatgtgcaatctttggttttgccaattcgatgaatgtcttggttttttttcctgattggatggagatgctatccaatgtggggccccggtcaggttgcggggccccagagagatcagggacgggggttgatttggccccgtatcaacagtcagggccaggggcggggggtgaagtccggggtcggggactggggcgtttcagccttaaccggccccgccccgtcccgttgccatccctactccccaagacagtgatggagccgggcgccggatctgccctctatgccacatcatccatcgcaccgaaaggatgaaagcagcatgcgagctcgggtaggtgatggcggagctagcgccaagctcgaggagagggttaatggcacgggtggcttgggcgggggcgttggcgagcagccgacaggtagtcacgtgcgcgggtgagggatgacggtgcgtgcagctggccagcggcgtcgtgactcgatgccttgctctctgtggccgtgaagatatggacgacagggtccacatgtcagcggggtgtatatgggggtattttagactatacgaaaatacattggtctattcatgggtccaatagcctttgggacgtagaatatggcatatttaagatatatgaaaaattgtaatggtatccttctaattaggtgaattgtgatgatattttttaaaacatgcacatttgtaatggcatgaatccaattgacccatggtgtgtttgagaagagatgagaagatcaagagacaaaattgagacccataattagggcatgtttggcagagctttggctccacttatcctgaagccagagtccagaaaaatagtttcagttccatccaaaatgtgactagaattagctggagttttttcacaaaatgaactagagatgtggagctggatttagactgctccacaactctactccagaccgagcccttggagctaaatttaggagttggagccctactaaatagacctttaattgattattaattgttttaaatttgaaaaatagattaatatgttttttaagtattttttctattaaaagttttaaaaatacaccgtttattagtttgggaagcgtgcgtatgtaaaaagggagaaaataatacgaggatatataatacatgtactattggtcaggggcggatcccatgtgattcatgggtattcacctgaatacccatagaattttaaaaaaaaaactatatataggtatgttatgcatatatacatgagaaattagaaggaagtgcagcatgtatagtccaaatgaaaagaagcccatttattcgcaacagaccatacattcctccccatcttggcccaacgaataggcccactggcccaaaaacgaacaaatccctagttcctatcccccagtcagccagtccccacccctcttgtcgtcccagccccaatccgccacgcctccactcatccccaccgacgggcgacggggcatcgagagcatgacgctcggcggcgccagccgccggctcggcgcgtcgccagaatcgccacaagcctcatctccctggaccctggtccctgggcctgctgctgcggaggtggcgcggcctgcgacgacaccgccgcctccttggggacgggtgacgctgagcagctgaggttcgcacgaatgccggcggcgttgcggcgcacggcggcagccagttgcggcgacacacccccgcgtcggcgcgtccccttggtccctagacggctggacagtggactgacactggtaaaataaatcctcttgtcaaattccccaatcgattggccattgcttaattgctattgcttagaagttaaattagtcagtcagaaatttgaactgtaggtcttgaaatttgaaaaatgaagaagaattgaagtctttgtgggaaaggtcaaccaagtctcagaaagtagcttccacctctgatccaaaaccattaaccaatgagagtgaagttcagatcccagaaaatgccccttctagtcctattcagctactacttgaagcacccaatgcccatgatagtgatatgtccccaagtgtgcatttggagatagacatcttgactattgtgctactgtttgtacctttaaggctttaaacatgtcattaccactcctgtatgattttcccagtccaattttttgagttctgtatgattttttttttcaactttgaataccctttgctcaaatcctggatccgttactatgggtatcgtcaacatgttttgggcaggtactatgactcctaacactccaatgccgtcatgtgatgggctatagcatccttttttttttgactaaatcaccgggggaagagaatccccacctaaatatattgagccaaatgatcttacacagagcaagctttacctacgcaagcgcagggggcctggggccctggaggatagaaaaacagaatacacggagaaatacaacgaagagagaatagagaaagaaaaactcctaaaagattacaattgatgaacgacacctgcaaaattatcttgccaaattccaaaacctactgctaaaccccaactaagcaacatccaattcctcacacagccacaagcatgtcgaaaaaaagagaggcaagggaatgctgttgaagtccaaagccaccagcatgaagccatcaagaagctgacttgatcttgttgttgtttggatcagagctcgccaacgccctttgggggaaggaagccctaaaggagggagggccactgaaggttgcggctcgaggccacccgcattaagttttcttcaatcaggctttatcaaattgcttgttagatcaactttctccaacgcccttcaagggaaggaagcctcaaaggagggagaaacactgatccttgcggtcctggacatctggagaaagagggtgaagacgagcacggggctagacagaaggggaaatggctaaggggattctcacagaggaaaaacatcaacgacaa

SEQ ID NO: 26040 - DNA, 9233 bp, Oryza sativa
gggggtggcgccgacgaggtcgtgccggcccgccgtcgctgtagcatgcgccgctagccgccaccgggcaccgggtccagcgctccccgccgcccccttccagtcagaccgcgggagggccagctccgccgcgcccactctggcctccaccccgcccactccggcctccaccccgccgaccgccagcacaagcgccgccgctccgcctcctccgtgcggatggtagtgacgctcgcctccggccaggtccagcggcagggcgccggatccagccacgggggtgccagatccggtggtggcaccgccggatccgaagcttcatgccgcgccgttgccgtcgcccgcccatcgcgcgccgcgtcgtcgtcctcgcgctgagtcgtcgcgtcgccggggaaaggcctcgccgccgccctcacggttggtcgcgcggaactccggcggcggcgaggggtgggagaggaagggaggaggcggcgggggctagggtttgccctccgtgtcgcccgcgcgagagggcgacgcggaggtcggaagatccagtactgtttcctgtaccctcggctataacatcctggattagcgtattcttttatgtgagaccctggttaactaaactatgtgtcacttggttttgaaggatttgatgaacatggaagatcccaaaaagtactcgcaaacagcttaagcaacatgataggagtagaatagaagttcaggcatgatggatcacgtgaagctggactgaagtgccttcgccatcagtgtggcgaagatacgaagaattccagcatttttgatcttcctcttcttcaaccattcaatactcgtaactcgtagtaacatgacaaataaaatagggataattacatatgtacccctactttaaaagccaattgctgttttacccttatttttcagggtttgcatttttacccccactttttaatctgaagcaaccgtctaccctcacttgtgacagccgtttgatgggtcccacattgtgcgttaaagaaatacaaaggaaaataaaaaaagggtaattatgaaattacctttgtacccctgagagtggatagggttgagtgagtcttccacccgtgcgtacgggaaaagcaggtcgaatccctagcgcggggcggcgcggaggcgacagcgagagcgcgcggcggggaggcggcggtggccgagggcgtgcggccgcgccggcgcccgctcccaggaggtagacagcccgcctcttcttcctccgcacggaacagtgcctcgccgcgccgcgacaggacgggaagccctggcggcgcgcactcgcctccgaatccgcctcgtcctgccaccgctcgcggtgctgctcctcttcgcgctcctcgccgtcgcggtggcgcgggcacgcggccgcggatggaggaaccatgaggggaggaggagagcaacctccgcctgccgtctgagcgcggcgtggcggatgacgcggtggcggaggacgacgccgccgaggacaccagatgggccgtcctcatcgccggctccaacggctactacaagtaccgccaccaggtgattttgctcgcccgcaacccctcgaaaacaaaccacgctctcgccgcgcggttaatcgtggcggcacgtatggtttggtttggttcggtttgatccttcgcgtgtgtgcgctcttcgttcggtttgatttggttggtttcacgggattggttccatctccaccaacgcgcgcaatcgccgcagaagtagaaaccctgagccgtttcgtgttgccgcaaattccaaacgtctgttaaatctctcgttaatctgattcatgataaacgtaatccacaattaatttgagattactgccgtgaagagagaattcgtcgtgaagagagaattcggcgtgcaaaatcacacgaagctgaaaaaattggagcaaaattgcaataaccactgagagcataattgtccttttcctctacaagtaacacagataaaaccggctgttagaagcaggggcacatggctgcttcagattcaaaaagtaggggtaaaactgcaaactctaaaaaagtgggggtaaaacagcaattggcttcgaaattggggtacagatgcaattgccacaataaaatattatccacatatggcagtgttcgtttctaaaaaaaataagaaaaccattaacgcatagttaattaatttttaagtattataaatttgaaaattttatttcatattttaaatcaacttttatatataaaattttctcatagaatgtacctacttaaaaccatggtaataaaaaatgaggtaaaatttatatcttaacgagaaaaaaaaattagattcatattactatcaaacttacgtaatgaactaccagtgattctttgagattacgacagaatatcgctgtatcagttcacctccctaacctttgcctctcactcacacaaagtgcaaaccatattttcgtcggtctacttctgggaattcgttgtgagcgtgcgtcgcaaccaaccgtttctcacaacagcaaccactcaccgaacgaacccggcccctgggccccaccgttgcagcccaaccacacaccgaccccacctcatccctggccccacatgtcatccacccaaatcacccacttgggtcggggtgggtcccaccacatctctctctctccctggctctgattaatttctccccaaccccactcactcgccgcgtcggcgaccaccaccactcgagctctaaatggcagccgccactagatctcgccaccatcaccgacgacggcgacctcaccgccgccggggatgaagcgccgccacctcccgcccgtcctcgtcctcctcctcctctcaatcctctccctctccttccgccgccgcctcctcgtgctgcagggccccccgtcgtcgtcgtcgtcgtcccgccaccccgtcggtgaccccctcctccgccgtctcgcggacgacgatggcgccggatccagccagatcctcgccgaggccgccgcgctgttcgccaacgcgtcgatctcgacgttccccagcctcggcaaccaccaccgggtgctctacctccgcatgccgtacgccttctccccgcgcgccccgccgcggcccaagaccgtcgcccgcctccgcgtcccggtcgacgcgtcccccccgacgggaagctcctcgcctcgttcagggcatcgctcgggtcgttcctcgccggccgccgccgccgcggccgcggggggaatgtggccggcgtgatgcgcgacctcgcgggggtcctcggccgccggtaccggactgcgccgtggtcgggaacagcggcgtgctcctcggctccggccgtggcccgcagatcgacgcgcacgacctcgtcatccgcctcaacaacgcgcgcgtcgccgggttcgccgcggacgtcggcgtcaagacctccctctccttcgtcaactccaacatcctccacatctgcgccgcccgcaacgccatcacccgcgccgcctgcggctgccacccgtacggcggcgaggtgcccatggcgatgtacgtctgccagcccgcccacctcctcgacgcgctcatctgcaacgccaccgccacgccgtcctccccgttcccgctcctcgtcaccgacgcgcgcctcgacgcgctgtgcgcgcgcatcgccaagtactactcgctgaggcggttcgtctccgccaccggcgagccggcggcgaactggacgcggaggcacgacgagaggtacttccactactcgtcggggatgcaggcggtggtgatggcgctcggcgtctgcgacgaggtgagcctcttcggcttcggcaagtcgcccggcgccaagcaccattaccacaccaaccagaagaaggagctggacctgcacgactacgaggcggagtacgacttctacggcgacctccaggcgcggccggcggcggtgcccttcctcgacgacgcccacggcttcaccgtgccgccggtgaggttgcactggtgacggtgaccccgacgtgggtgtatgtgtagctgctgctgaattttgttgtaaaattgaaactgatttcatattcgatacgtagaatcccattgtaatttgtaaatcagggggaatgggaggagatacggacacaagatgtgtgtcagatttgggagctttgtaaggagaaatgtagctcaattttgttgtgaatttattcgaaccattgcagtgaacttgttgatcatggaagcgcttattgattgtgaacttgttaatgattttttttttggtggtgatagatcttgcttaggtatgaaaatgatcagtagctgatgctactaataactattacgtctttgtttaattcttccttaagtaaaggagagtaaatattcgggttggtgggcggtctcctatctgcttctgttgtcgatttgctaatctcttctaggggaatattctggttgtagtatagtactagtagatgaccgaaagctaataaaatggtcaataatccaggaagaaacagctagtccaattgccaattgcccattccttttctccctttttctttcagataaaattgccagtcctttacaagctgctgctgctgctgctgctgcaacttgatttataatcatcagactgctaactgctgaagattgtttaagtaacacaatgtttcttcttcagtactgacaagtttacacatgcggtgccattatcccaagttgatcttgctcgtgctcgtaaaagtatatcactagctaatgtgtttttgttcactgggaattgcacctatccttggtattaccttcttgtatttagttagatcatgctcttttctgattaagatacagattttatctcggttttcattaacatgatttttaaattgctaatggtaataattacaaatgtattttttaagttggtaataattaaaactcaataggagtgctaccatcaatcaatccatccatttcaattgccctatttatgccgattttagttccaaactttttcttcaaacttccaacttttccaccacatcaaaacttttctacatacacaaacttccaacttttccgccacatcatttcaatttcaatcaaacttctaattttagcgtgaactaaacacacccttaactactctcaagtaatgcatgcaaaggatgcatttgtgttgttgtcagaggagatgcagaatcatcaactaccagcaggaagtcttgatcacaactcacagaaatggggtgctcgtatctataggcgccatgagatctccctttacgaaaatgcaactcctgacgccagcttcagttggctctgtcatgatgatgatctctgtgctgcacattgcaatgcaagacggacacacacatccagtcatacagatggagttcaatgctgctacaaggtcaacatgtcagatcagaccaagaatccaaatctcgaatccaagattatctgccggtagtaggacctgctgcatccatcccttgcccatccatcagatcagaaattcagatgaagtagtatagtacagtacggagtacaagtctacaagattcatgtaaaccaacaaaaaagctcggtcattggaaccatatcttgagtagtttgaacaaatttctgtatgctatgcatattgttttatgggaattgctaaattctcaaatgtcactcagtgcagatgttaaaatgtctgtagaatctactactagtcatattcaattctccgggacccaaaatctctctacacaccgacaattcaagatttgtactcgcactaatcggtgtgctcataagacatgcatgatgcattgttcacatcgaatcgtggtgtgatctgtatgaagtgatgcgccatgccgccatgatagctgctctgctagctcttgcaataatgctcatcgagagagcaattgaagcttggaagcagaagtgatggaaggaagaagagaagacgtggaggttgaatgctgatcatcattagctgctgccttggaacagcaagagaagagatctgccgttgcgagatcagatgatgagagcaaagacttgacttcaccacactgctactacgagtaggccataatcgagtgcaagagtaaatgttccttctcgacttctcggcagtggcggatccactgttgaggctggttggtgtgtaatccctgttcctagttatagtcattaacaagtctaattagttggatgtgtttagttcctaaaaaaaatttaaagtttgggaaaagttggtagtttggaaaaaaagttaggagtttatgtgtgtatggatgttttgaatgtgatgtgatatgatggaaagttggaagttgggggtgtttagttcataccaaaattggaagtttggttaaattagaacgatgtgacgaaaaagttagaagtttgtgtgtgtaggaaagttttgatgtgatgaaaaagttagaagtttgaagaattactttggaataaacacggcgttattagtgaagaaatttcctagatagcaaggatgcaagctgcctcactgattctactacccaaattgataaaacataatttattccgagtatacaaaacaatatattcacagatacttatgaacattttaatatagccacaaatcaaaatagaaaaagttcttttgatcatatgagcatttcattttcattggaaaatagtttagttgatatacctttacttgttttaattatattatattttttacactagcatcacctcaatttacatcctggagttgccttgccactgcttctctgctggctggctggctgctgctgctcccttcttttttggacagagtactctgcatttccatcatttgattttagtcaaatgaagtcaaattgatttgaacgatttgtcattacagttcaaaccacatcatgattcacgagagagactctactgggaaggaagaagaagctggagtaccatttcaactttggaacttggaagaggaatgattgcgtatctttgagcgaagcagaagtgcgtcatcaattcatcgcgatttcattctcaactctgaactgcaggccgtgattgacccgcagagcagagcagatatacagtacacagtacatacagccactatactccacgagggctataaatacagtagacggccgtctacgcgaacaccactgctctgcacagctcaagaacaatctcctcttcttcctctgccaaacctgctatcccagtactatcttccttcttccttctctctagctagctcagcagcatcttcagatcaaaggtgagggactacttggtgtttcttatctgtctcgagttgaaactgctccattttccatggatcatcttctcatcagcaacttgcacatttcttggttgcatgatcctgcgtcatttgtaactgttagtacgacgatgcaagaatgcatggcttagttagctaccgtttgagtcatgtcttagcatgcagcaaatgctagtaattagttgactaggaattaattgattgggcatttttgagtgcaggagatcgagatcgactggcatggagagggtgaacctgaagctgtacctggagaacgtgtacataatggaggagaacgagcggctgcggaggaaggcgcaggcactcaaccaggagaacaaggccctcctcgccaagctcaacaccaaccacgccgccgcctcctcgacgtcgacgacgacccagcaccggccacccaccgccgcctccgcggccggcgccggcgcgtcgtccaccctcaagcccggcaagcagcagccaaagtgatgcattgcatgcatgctgcatgcattagtgcaaggagttcatgcttaattaattaatgattagtttctgtaattactctaagttagtagcagcaagttggtgaagtagcttaaccagatgacgcataggagtagagtatttagcttgcaccgtgttttggcttgattagcagcagtacaccttttgtttttagtacaacttggtacggactgatcactgatcagacgctcatgaccagtgtggagtgcggacagctggcggcattttgggtcagacttaattagcagtgtgatgtaggagtagtaacactcaatcaaagcttaatttgtgctcctagctactaacagcatatattaattcgtaccagtaccgtttccataagttgtcctggataatactcccaccgtctatttttagtgtagctgtgggtttcattttccttatcaatttgatcgttcgtctaatttaaagatttatgaatttctttttttaaaaaaagtcatgcataaaatgctattcatattttatcatcttataataaaaaaatattaattataaaaaaaaatcaaataagacgttggatataaaaatccataagtcaaaatgggatgaagtatgtgtgataaaagtttgttcataccaatgatgtttccaaatcagagtaaacgactataccgatttcccgtgattgaggatggacttatgagctctcggacggctggtccatccccgtcccgtcgaccagatcacataatcgattacgaatgtgccgtggacaaaatttaaaattaaaaagtgttttggagtcaattttatgctttttttttcagcgcgtatttttcagtcttaaatttttaacgttgaaaccataagtaaataggtaaataacacatctaatataaaaagctttattcgcaaataatttttctttttttctacggctgataattcttgctcaaatcgattagagcctttataacctagagccaaccatgcattctactcctataaaaaaaaatatgccgcagcttacgagaaaataatcggaatgattttaagtcaacggcgtcgaaacatttcgaaacggagggagtacaatctagctagctctatataaagggcctgttcactttgacctgatttcttatatagttaccaaaatttggtagcaaactaaatatagccactttttttttggcaactttaccaaaatttggtaaggttgaaaatggcagcacagtgaacaggccctacatatctcacaaaagtttttaaataagaagaacggtcaaatatgtgctaaaaagtcaacggtgtcaaacatttcgaaacggagggagtatatatatatatatatatatatatatatatatatatatatatatatatacatacatacatacacacacacagaatcctgttcaatatacaaataatttctatttcttgag

SEQ ID NO: 26041 - DNA, 3780 bp, Oryza sativa
cacggtcaaaccgttagatcaatctcggtcagaccgacttttgtcgatttcgagggtaacttttatttccgctaaaagttttcggttttttgggtataccaaccattcaccccccctttggttggcttagttcttgtttttcgatcctacaagtggtatcagagccttgttttcttctttggatttttatcgatctagagtttttgccatggctactcccgctaggttttcaactaagcctcatgttttcgatggaacggatttttctcattggtgtagtaggatgcaatcttatattatggctgaagattatgatatttagagaaaagtttctcatccttatgtgattcctgaagctattaatactgcggctgaaaaaactgcttttgaacaaaattgcaaagcacgcaacattcttttgagtgctatttctcgttctgattatgatcgtgttgcgcactttcgaactgctcataaaatttggaatgctttgagtaactttcatcaaggaacaaataacattaaagaacttcgtcgtgatattttcaaaaaggagtacattaaatttgagatgaaacctggagaagctttggatgatatctctctaggtttaataaaattttgagtgatcttagatctattgattcttcttatgatactaattatccacaatctgagatttcttgtcactttttgaatggtcttgacatgtctatttgggagatgaaagttacgtctattcaggagtctatgactactttgactttggattcactttacacaaaattgaaaacacatgagatgaatgttctttctcgataagttgattctaagtcaagtgctttgatttcttcgtattcttcttctttggatattgatgcttcttcatctaagccttcttttcttgctgtttttaatgccacatccgatgatcaactcgaacagatcgaggaggaggatttggctttggttgctaacagagttgcttgagctatgaataatgccaggaacaggaaaagaggtggtccaaatcgttgctttgaatgtggttcaattgatcatcttcgttcgcattgtcctaagcttgggagaggcaaaagataagacaaagatggtgagaagaccaacaacaacaagccgaagggttcatcccaagggaggatgctggagaatcttaggaaggcttttcaacaagtttgtgccgcctttgagccactaagtgatgtagatggtggaagtggagatgatgataagggaaagaacatctccgatgtttgcttcatggcacgtggtgaatctgacacagagtatgaagataatgaggtaagtgcttttgaagaagctattaatattttgagtgaaaaaaaagaagtgtgagaagatgtatagaaaacaggaatttatcattgaatctcttaaatctgaaattgctagattaaaatctcttattcctaatgatgattattgctcaaattgtgaggttttaatgaatgagatttcaaaaattagagatgttaatgctgcacatgatttgaaaaatagatcttctcttgcttgcagttttgctttgcacacacgcactttggatgagttgtttttaactaaaaagttgttgcaaaaatatcaaattgcttttcatgttagtttgatgtttaacatgatttctgctaaaaagttaaaacaacctcatgatgttttggattgctcaacatgtaatttgaataagttgaaattgaaagatgttttaggtcgtgttgagttcatggaagatgttgtgaaaaacaatgaagtgctttcttgccctaaatgtcgtaaaagcaaatgtgttatggtagattgtgaaaattgtgctaatttggaaaaggaggtttcttatttgaaaaattccttgttaagattttctgatggtaaaaagaacttcaacatgattttggatcaatcaaaggttagcacacataaccgtggtttaggttttaatccttatgctcataattctagacatcctcctattgtgttaggtgttgatgctagaagtggtgagatttttgttaaacctgatactaataaaattgtgtttaaatctgctggtatcatgtctactatgggtgcatcttcttcaaaatccaatgttgtgcatgccaaatctcctgttgttgcttgtgttgctaaatcttctaatgctaccaatgtgtctaatcatcatgaaaaatatacttgttctttttgtgggaaagatggacatattgttggtttttgtttcatattagctcataaacagaaaaaggagagagagattgcttttgcaaaatcaaggtggcaaaaatcggattttccttcgaggaaaccagtcagaccgcagtgggtcccgcagtcagaccagcgaccggtcagaccggctactgagcgtcggtcaccccaggcaccagtcagaccggcggtacagtggccggtctgaccgggagtcggtcaaaccggcctcagaggaaatttttctgaaaattctaaaatgattttgcatgtggttatatgcctattggatcttctgatcgtgtgtctcagtactggattcctaaatttttattatcatctaaccccagtactgaggcttcgacttctgcttatgtgtaggctttggtggcaaggaaggagaacgtgtggatagtggattccggttgttcgcggcacatgaccggtgataaaaattggttctcctcactcaagaaggcatccaagactgaatcgattatctttggtgatgcttctacaagtgtcgttctcgctacaggtttggttaaggtaaataaaaaatttgaattgaagaatgtagctttggttgaggacttaaagtacaatttgctttcggtttcacaaattgttgatgaaaattttgaggttcactttaagaaaactggaagtaaagtttttgattcttgtggtgattctgtgttgaatatttctcgctatggaagagtgttgaaagctgattttgaaaattctgtttcacccgtgataacatgtttggttgctaagtttgataaatatgtgatgttttggcatcgtagacatggacatgttggttttgatcatctcactaggttaagtggtttggatcttgttcctggttgcctaaacttaagaaagatcttgatttggtttgtaaaccgtgtcgtcatgctaagatggttgcttcttcacatactcctattgtttctgtgatgatggatgcaccgggacaactattacatatggacattgttggtccagctagagtgcaatccgttggaggaaagtggtatatgttgattattattgatgatttttctcgatattcttggattttctttatggcaactaaggacgaagcttttcaacactttcgtggtttgtttttcgattggatcttgaatttcctggttctttgaaaagaattcgaagtgataatggtggtgagtttaaaaatgcttcttttgaacaattttgcaacgaaagaggtcttgaacatgaattttcttctcctcgtgttcctcaacagaacggtgttgttgaaaggaaaaatcgtgttttggttgagatggctagaacgatgttggatgaatataaaactcctagaaaattttgggctgaggcgattaacactgcttgttatatttcaaatcgagttttcttgagatcaaaacttggaaaaacttcttatgaacttcgatttggacatcaacccaaagtttcacatttgcgtgtttttggttgcaagtgctttgtcttgaaatctggaaatttgga

SEQ ID NO: 26042 - DNA, 1079 bp, Oryza sativa
tcactgctcctttgcacatttaacgacgacatccgccggaacaaatcattggtaatataggtgagcggactacaaggtctaaggtaacgactcatgatgtttgtgcaaattctgtatttgttgctttttttgaacccaaagatgtgtcacatgcattaactgatgaattgtgggttaatgccatgcatgaagaacttgaaaattttgagagaaacaaagtttggactttagttgaaccaccttctggacataatattattggaactaagtgggttttcaaaaataaacaaaatgaggatggtttgattgtgagaaataaagctagacttgttgctcaaggttttactcaagttgagggtttggattttgatgaaacttttgctccttttgctagaattgagacaattagacttttgttggcttttgctgcttcaaaaggttttaaattgtatcaaatggatgtgaaaagttcttttctaaatggttttatataggaggaagtttatgtcaaacaaccaccaggttttgaaaatcctgattttcccaaccatgtttataaattatctaaagctttgtatggtttgaaacaagctcctagggcatggtatgataggcttaagaactttttgcttgcgaaaggtttttcaatgggaaaggttgacaaaacgctttttgttcttaagcatgctgataatcaacttttcgttcagatttatgtggatgatatcatctttggttgttcgactcacgctttggttgtagattttgttgagactatgcacagggaatttgagatgagcatgatgggtgagttattgtactttttgggattgcaaattaagcaaacacctcaaggtatttttgtgcatcaaacgaagtatacgaaggatattttgagacggttcaagatggagaattacaagccaatttcaacaccaattggttctacagctgtgttggatcctgatgaagatggagaagctgttgatcaacaggaatatagaagtatgattggatctttgttgtatctaactgcttctaggccagacatacaatttgttgtgtgtttgtgtgcacgc

SEQ ID NO: 26043 - DNA, 9782 bp, Oryza sativa
  unsure (1)..(9782): unsure at all n locations
nnnnnnnnnnnnnnnnnnnnnnnnnnnnnnnnnnnnnnnnnnnnnnnnnnnnnnnnnnnnntgattttgggggttgtggaattgataggaaaagtactagtggaacatgtcattttcttggtacatcattgattgcatggtcttctaagaaacaatctatgttgcccaatcaactgctgaatctgaacttgttgctgctgctagttgttgttctcagattctttggcttttatctactttgaaagattatggtcttacttttgataaagtacctctcttttgtgataatactagtgttatcaatattgctaagaatcatgttcaactttcacgcacaaagcacattgatattcattttcactttttgagggatcatgttgagaagggagatgttgaattgcagtttttagacacaaagttgcaaattgctgatattttcactaaacctttggattctaatcgttttgcttttctttgtggtgaattgggcataattcatccttttggcatggtttgagggggagtttgtacctcatggttttatcaagtaataatatgacaatgaaaaattgagaaaagagagctttgtttatacatatggtattttcttgtgcatgctagcaatactatgaaggtttatttgtctctagcatagcttgtctgtattctaatcttttcatgagatttagattttacttttaagggagatgatgcatgacacttaaattctatacttgaattaagtaaatatgcaatgttgatgctagcatatggtttgatttgtaaatgctctatatatatatgctttattgacttgttattcctcaaatagctttaattgctcattgtgaaaaagagaataaaaatatgaaaaaaatgaataccgaatccttggaaacagtcttgacgacagggatgtattcgatgtgagaaaaataatgggtgccgaatctctagaaacagtcttgacgacagggacgtacctggaataaaagagaaaaatatgagcaaaaaggctcaagaaaaagaaaagttaaaaaaaattctcttggttattttgtgctaaaggttatttgagaaagagtgataaatgcaataggtgtatgagtttagtgtttattcttcaacctatgtgcttgttaagatgttgcattataaatcgtatgaaatcatgaattttgattgttgattcagcttaattgtaaaatctttggttcatggttatactttaatgcatgcttgttatattatagatggatttatcttctttttattgcaacacatgacttgatatatatgtatgctaagcccttgaatattaataaacataattcctatgcttgatgaaatcattgtcaaaaggaggagaagtaatgtgaaaatttttggatttttggagaagcaaggtgaatttttgacgagttgttgagaagagcatgtttttttttgggttcatgagggaatttctttcttttaaaaagggggagaagttttcttctggattttcgagcacgatgtgtacttttgtacgaagtgtgctttttaccaattttgtttttatttttccaaacaccaaaacatttttgatggatttgccaatgtgttcatcaagggggagattgtaaaatcaaatgtgtttttgattattattctgtgatgaacaattgggcattggagattattggttttgttatttggaatttatttacgaagtggttttggagatgattggatttacaggtgaatcgtaggttcgttattttatgtgaccggtcagaccgggctgtgtatgccggtcagaccggcggtgatcaagcggtcggactggccagcccgcggtctgaccggccgacgctatgtcggtttccggttcgggttgtttatttggatatctgtgattattttatgattatggcttctagatggatactatacgtatgtaatactgttgtttgctactaatgagtcaagttggagatagcttggtctcagaatatggttactttgtttatttcatgtgtaggtgactcgatgcctcgggagagtatttacggtgatggaccgggagtcggcttggggataagacgacgtccgtggtggtcagagatcatgcgagatacttaggctagagttgatgcacgtggttggtggagattccatatggcatacaatggaggtattgtgtgcgtatgggatgcggagtcgaatttggaaggagtccaaatttggtacgattggttatgtaaagtttgtgtcttgtactagagggttttctaaggtgtttaagactcctagtatgagtttggttcgtggctgtaggctgcctacctcatgtataaatagagggggagcgtgaggcttcccggtatcgcttttgagagcaattgagtttagttttgagttagggtttcgagtttagtcgaaatttttgtaaggagtgctgttggtgcactttgtaaatacagagataatcaataaagtcgtcatccactttaagagttcttcgatttgtgtttcaccgagtttcggcagtccaaccggtgatataccggcggtcagaccggcggcatacgggcgatcagaccggcggcggcgacaggcgcggcaggtgacatcggcggtcagaccggcggcatccacacggtcagactgacgatcaatctcggtcagaccgacttccgtcgatttcgagggtaacttttatttccgctaaaagttttcggtttttaggtataccaaccattcaccccccctctggttgtcttagttcttgtgttttgatcctacataatccttctacttaacggacaatctctactacttcctccgttttatattataagacttcctagaattgcccatatttacatagatattaatgtgtctagatttattaatatctatatgaatgtggacaatgctagaaagtcttataacctgaaacggaggtagtatttcaaagtgagtcgtggtggtctctgtttttcctttgtaattaaataatagatctaaacaaatttccaatgagctgcgaaatttccagctaactgtgctgtttctactagtaatacgacttattagatggtctgaaactctgaatttgtttttctgaaaggtctgaaactctgaattgataaaagatagtatcacgtttactaagtaggcagcctactgggcaacctaccatgtcccctacgtcatttcccaacaatctgcaccaacaaaatctaacaaaaaaagaagaaaaagaaaaagaagacatcgagacagacatatcaacccaaccaccatcaagtccccgactctctctaccacgtctatacgcgtgcaaaccgcaaagcatatatacacctacactgcactgcactgcattgcacgtacccaaccgatcgaaatcgcaccaccaagattaccatttcacatttcgcaatggcagccgtagaagcaaacgccgcaacgacccaccatgaaatcaccacggccgccgccgtcaccgccggagagcggcagcagctcaacgccggcggcgaggacgacaagaatattgggatgatcgtgactgacgacgatgacgaagacgaagacgacgagctgttcgagctcgacatcgccctcatcgaccaccgtgacggcgaagagtactacaccaagcgcctcgtgacgagcagctgttgcgtcgctgtcgccgccgcagccgccgccgccgacgacgacgacgaagaagacggcggtgacgcgctcctagccaactgcctgctgccggtgagctcggtcagcagggcggtgccggtgacggcgagcagcagcttcgtcgtcgtctcgtcgtatcccgttggccgccgctaccacggcggcggtgggtgcggcgacgacgacgacgacgacgctagctggaggtggaggaggttcttcttcacgtccggcggcggtggcaggacgcgtattggccgccacaacagcaataactctgcgaggttctccttctcaagattccaaagcttggcaaattttcagcgatactgatgaacgaatatgttctactgattcaaaggggcaagaaagagagatgaaatttgacgtgtatatatagccgatgtacagattgagtttctgggattgaaattttgtactagctagcttagatagggaaactattttaacagctcgagtggatgtccacccgtttattgcatgtcatctaaatggttataaaaaaaattaaaaaaatatgaataagatagatcaatatgtaatgtatcaatccacaaacatacaatttaaaattcaacttctacagattgtaacaaaaataacaaacaaaactcaaattactatatgtatatttacagttaaatttgttatttttgttacaacttgtagaaattgaattttaacttgcatgtttgtggagtgatatattacatattgatctatcttaccaatttttttgaaaatttttcgtagccatttagttgacatgcaataaacaggtgtacttccactcgagctattagaatccatcccagcttagatatggtaccaatcttatcaaattgtgcaaaattttcagttgtttggaattaagggcatttgtgattttactggacaaaatttatgtctgttacttcaagctttgcccggcaattgtacaaaattattctaaatgtaaatttaaaattaaacttaatttaagttagtatctttttgtggtaaccgccagtttagagcgtgattgaccattcaggtcaagagaagagaatgtgcggtggttgactggtccatatgtggccagttgaatcggatgcccacaaaagaagcccacttaggccttctctgtataggccgaaattttggcccatatacatttgagggccgaaccaaatgaggcctcaattgcaaatttacttttacaatgtgcggcccaagcctactactggtagacatacgctccgcttgttgaataagtacggtgtacggccacctcgccgtcgcggccacggcccctctcctcggcgagcacgccgccgcccgcggcggcgggatatcccctgtagatgaccacacggtgatcgtctccgccggcccgggacgacttccacggcgagccaggtgaagcgggtgaggattctctcggcctcggcctcggccaacccatccccatctgattttacagttcattgttaccgcatcattctgtttgctgcacctgcgctctctgctactctgctgctggtccgactgtttctgcgcaggagatttgggatttccagcagattacacgagtatgcttcaaatttctcatcatgttgtgctaatggggtacagcctgattagcaatgggggtacacttgtttgtgtaaattgggattagatccgaatccaatccgatttctagggaggttgagatttatgaaatgatattcatctagaatcaagttcttagagggaaatgttgtgattcaatgggaaaaggggaaatagtggaggagagctcatagcctgatagtcagattttttgcaagaatgtgtacatgctacagaatggattattgccggccgtttggatgttcctctggatcaccgacaatttcatatgggtgttcctctggatacaatgggtacatcccttttatgtcatgtttttaggaatgtggtagcaggctagcggcgctggtgcaatacagttaggagggtcaggagggtctttgtttgtccttctacaaggtgacacaacaagatctaacaaacttcatgtccagcagatcgcgtgtcaacaaaagtgcacatcttgtggagccagaaagtgcatttggtggataaagctttttttgccagctagcccctgtatcagttatagattgctaatatttgcatgtgaatgcactggtatttatcatgactctcaatcttcttacaaaaacaatccattacttaatttttgatacgggaaacaatctgacactgatacaatctgtcaaatgcatttggtttattgtagattttcttgaggcaaatgacgtaatgatgaagccttgatccacaatctagtgatgtggcagataatgtagacgacaggagaaactattggatggtttttatttatcacagcggggataatgacagctggaattttttagcgtctcctggcagcagtctctctctgagcattgaagtagacagcagcgacaggaaggccaagttcgttctcctcagcaaactggcgtgtattgaaatgatccctagaggatggcacaactacagcctgcctacgcttctgcttgaagagcacaaaaacgaacctgtggataccaatgctgggctttgggctctcatagcttatgatttcccgtcctgcaattcaaatgccagaaagatgcatattaagaacaaatacatgcaagcatggaatgatctaatgcaggttagggagaggacctaccaaaagaggcatccgttgttccaggtatatcagttacaatcctgcataaatattaagggtaaaatttaatgatttggccacaccatggtcattatctgttcagaaatatattgttttttggaagaaatatttttcttattagaaatatgatgttttgtatgaaaacaagaaaaatatgtggtattagactactagtgccatctccatcagaaacataaattttatagtgaatcaataatcaccaattggacacaaatgtatagattttggataagaagtgttgaaggttaccaatgtaggtgttcccttagatatggatcacttggtcctggcacatctgggtctgtcataacctgaagcattccgagttatggttaataggggggggggggggagagtatgaaatgcactgaaagctaactatggaactcccaggatagagttagaccagtccgtaccaatgtgaagaaagaacgcatatcacccccttggacctcgactcttggtttagatacaactgctgatgggtagaactcatggccattaaagacaagcttgtttgaattgtaggttactatcatcttcgtacatgggttgaatgaatcaataacttctccgatcacccgcccaacaacaagaggctccacagacctagacatggttggagccttggagggacaggtaattatattttccgaaattagtgctctggctagttgtaaatgacaaaacctagtgcacttcaatgtgcccttggttgcttattgggcattgtagagtgatgagcctctatttatagtggcaagaagcatgctgtcttctttcaagttgtagacttgtagggatatatgatagaattttccaccagaatcataagatatgtatgaatgtgcatatttgtttgatcttatttatacatattcctctattccaggccttcttttgattatttataattttatatgcatgtcctgaagattaagaaaacacttacttttttatttgattgaaattaaatgtttttaaagtaattttatttttcttgttattttggatatcaactctggacacaaacttgaccattaatttatctcactatatgttagtaatatattgatatgacaggtttttaattatcagtcctattaataccattttacatgacaaatccaattaccctttttttattgtagcataatctaaatcttactaggatagattgcaatcattctaaattatcattaaagaaaaacagagggagtatcatagatcactacctatgttatttctttatgaaacataagacacttcaggcaaggagatctctgaagattatgttgctgaatttatgttatagtggtgggaaaaggggctcatgaccctatatgtaaggcctgcatgacaatgcagtctgcagaatttttgcacactatcaaattgtcatgtaatttctatacttttctaaagaaaaacagatgagctattatacaaatttattttttagttttttggcaataaattgacagatgggttttggggatggagctgcaaatagccacaaataccttaccgaaaagaaacatgtagataaaatttcccacttttaggaggtatgcaattgtggataaaatgagaaaaaaaaagaaaaggaaagggactataatccttctggagtgatgccgttcacctactccctctgtcccaacaagaatcaatgaatctggacaaacacttgtccagattcattgtcctaggataggttatactaagttgattctttttgggacggaaggagtaaaatacaaattcattcttgattgctagatttgatgttacactacggaaacataaaggcttggcttgctgagattcttatcctactgttttcaatgaccttcttttgttatctatgaggcagatgcactctacactgtctgcgtggaagcctatcaacccccaaatgtttgtcgttagcagccttgtttgtctgggtaagtctcacgtagcttcttctttttctgttaacaaaaagcaagctatggagttgaaatgctgttggaatttttctttctcaaactgtgataccaactggattataccattattatctgtttactctcttccttggagtgctatggcagcacagcaaggaacagaataaacgaatgaggtgcagcgccgcactgctgccaccacttcaccgtgtgggggtactgtctagtgctgagatgtcacttcactgataaaaagatcataggttcttcttgattgaggaattaaaaatacttctatattgccataagtagtggagccaagtacagccttttgcactgtgctcttttggtctagtgctatcatatttgcttgacattttgtgcaagtaaaaatactgtagtcaagtacaccttggcagcatttttctactcctaatgccataatatttgcttgacacagctgatttagtggaacctcataactgttggctgtaactaatggtaacttatctgtgatgtagactagcagtgcacctttagcttggtgtgctgacttgtcactagtggtcaggacaggcgtgcaaggtcagctgtgagttatcattgtatttcttagacgaatatttcttcagctgttttgtaacaggtaattctccactagtcacagaagattaaaattgcttatcaatattgttctgcttcgctaatcggtttgtataacccttacacaccataagcactttccacttccatgcagacagtgatgttttctgtttgctgtcaaaattgttattgggtaaaaaggagacacccactgagccagaagatgcacaatggtaagctacctgatctaacttttttatgactaagttgcctgaattcatattggtgggaagatcattgtgggacaatgcaggtaggaaatcagatattcagatcatgacagggtgactctagaggaagccatgccccaaagaatctctattagatcaatgtgtcgctgcttgattgagtatgagtcagctcacaagattacactcaatgtgaattttggctatcttttttgtttctttgaaattgatttcaattccgtttatcagtggtgtggtcaatggccaatagatactgatatcataggttgctccaatcagtaaatgctgataattttcaataggttcctccaatccgtaaatgctgatatttttcatcttccagaataatatttcattattcaattaccgtatcctgatgcacatttcacttgttcacccagctccagaactttggcagcannnnnnnnnnnnnnnnnnnnnnnnnnnnnnnnnnnnnnnnnnnnnnnnnnnnnnnnn

SEQ ID NO: 26044 - DNA, 7044 bp, Oryza sativa
ataggttcctccaatccgtaaatgctgatatttttcatcttccagaataatatttcattattcaattaccgtatcctgatgcacatttcacttgttcacccagctccagaactttggcagcagtcagttaactccagtcgttattgaacttcctttgtctgtactagttttctgaaaattggccgtttcatgttgcactcaaatccaaaagtatgtttttttggttgacgatctgcactagctatggtcaagttttatgactttatctctttattcgagtgtttgattgacaaaatgtgtgaaatgttacagatctaagatctaactagacatccagtgaccgtatttcctgcatttcttgctttgcagaaggtgaacaaacagatttgctgctcaaattcagagcacttggcagttcgcacaagtgaaagaggttgttgctggttcaggtaatcaggtcccagttttgggccgtatatgagcccctgacaagttgtcgacatcgatgagagatctttccatttcagttcttcaagcactctacccgcttgggaaacatcagtctggttcagtttgctgtcaaaactacccatatcaaaatttagtaatgccaaactttgatattattaaatttcagttttgtatgtatttggtttgtgccctcaccaaattttcaagtgtttttatgagaggaaacttctgaaaattctgaagctgggtagagtggcattagtatgaatatgtttagccagcatttggtaatatcgaaatttagaatggatgaaagcggtaacaactaacaaaccgaacaagcccatggtcccaactcccaaaccttcatgagtgaagaaagggaatagtaatttgtaaaaaatgtattgactgctggtgaggatatcttgttctgaatgcctgacaccaattgcacgcctatgcttacctgcactgaaatgcgacatgacaaggcgttcttgatgaagcacaggatgagaaacacaagaatgcaggacagctgatggcatgctgtccagcgcaaactgtcagtacgcacccagataatggtattttcgtaacatcaataaaccagaaaaaaattcaagctatctgcaaaacatagttgaaaataattttaaaaaatggattttcatccttaaagagacattcacttgtttcttgtaattgtatgccacctaaatagtcataaaaaatttaaaacatttaacaacatagattaatatgaaaatatatcactccacaaatatgtaaggtcaaatttagttacaagttgcaataagagaacaataaactattaactaaaatagttaatgtacattcgcagttatatttattataacttataaaagttaaatttaaacttgcatgtttgtggaatgatatatttcatattaatctattttatcaattttttaaaaaatatttaggtgaaatgtaaaaaagagggaatatctactcagagaataaaaacactttcaaaaaaagagtatgaaattatgcgcgtggacaacattatgaaaggaataaagttaagtaggaaacctgaatgcaaacgtggttgcgtggcattggcagcagctcctctcagtccttaccaaccagagcatcatcacctctacatctccattttcacagtactggagatatgttctcaacaacctaaaagtaactttcgctctattgatggaacttaagggggtatttagatctagcggcgtaaagtttggcgtaaagttttgacgtgtcacatcgggtattatatagggtgttgcatagggtattcggacactaataaaaaaaactaattacagaatccgtaggtaaacagcgagacgaatttattaagcctaattaatccgtcattagcaaatatttactgtagtactacactgtcaaatcatgtagtaattaggtttaaaagatttgtcttgcaaattagtcataatctgtgcaattagttattttttttagtctatatttaatactttatgcaggtgttcaaacgttcgatgtgacagggtgcaaaatttcggggtgggatctaaacatagcctaaaaacagaacattcacaacatcaaattacatctgcagagagatcgctcgctacatggattgtcgtgcgaaaagctagaccaaacggagtgtcggtacaccacgacagtgcacgaatggtgggaagcgacaacaaacatggagaatgtgccaaaacgcatgtgctcctaggagatttggaaggaaagaaacgagaaaatctttcaatacaatgagctctcatctatagttttattggcaaaaattaaagagaagtcaaaacataggcgctagtaagagccagtgtctatttgttttgctgtttaaggataacccttttacaactttttcatgtcaacacctgtacagaaatttacttcaattctattcaattgaaattagcaacttgccgattcactaaaaaaaaacatttacaggatataagcaaatatctcaatctagatacaaccatgtagaggcaacagtttatgttgcttacagccacagatcacaggctcaagcaaagaatctcaattaaataaagaagcaaataaagtgaccaaaatgggtccatgcaatgatgggtacagactaccaatggagtaaacaacagccaatattgcatctgctttgcacagccacagggacctggaactctggaagatagctgctgctgctgcttcttctcctccattgccatctatcacctcacctgagctgaaatcaagaactggatctaggagaaggtcatggttccaaggatactcatcgttctcctggttgtgctgcttggattggcattccaggcaattctccggccaccacctcaaaaattgtgtggctcacccggtggacctcctgtgacatctccaagaatcaagctcagagatggaagatatcttgcttacagagaagatggagttcagaaagacaaggccaagttcaagatcatcagtgtccatgcgtttgattccaccaaggacttccccttgcaggtttctaaggtaaatgcaaacatcacgaacagttagatttgagaaaaaaaagtcatctttttttgtccatgttttcttttagatttttcatgcttttctgaattgattgcttagtttgtctgtcgaaattcaggaactggtgcatgaactgggaatctacattgttggtttcgacagagcagggtatggggaaagtgatccgaatcctaagagggatgtgaagagtgaggctttggatattgaggagcttgctgaccagctcgagcttggacacaagttctatgtgttgggagtgtccatgggaggatactcaatttggggatgccttcagtacataccaaacaggtaaagactgaaactgcaataagtaataatgctaaaatggtagtagtgctctcggtcaaaaaccatatgtggcttgacattttctcggttaaacttttgaaactataactatcattaaaaattttgatactactacttaatttagaaatataaaaatgacatgtgtggattaaaatttctttcataaatcttatactactaattactctctccgtcccaaaaaataagtacttttggaccttgacatagtctccaagatgctactttgatcaataatatagatattttaaataaaaagagttgtatattataatattttgtttaataataaatctagtaacatcaattttacattattgaacttttttattattttgctattaatagtcaaattaaaaatatttgatttgtcactatgctaaaaatgtttatattttgggacggagggagtagattttataaactcgtcctaacaaaaaagtgtgatcaacgtcgcaccgtacagacccaaaaaaactgatattcgcaactcttcactatatatactgtgtacctatgtgcaggcttgcaggagctgccatggttgtgccaattatcaactactggtggccttcattcccagctgagctatccaggcaagccttcaagaggctcatcgtgccagagcagaggacactctggattgcacacaacatgccatctttgctctaccagtggatgacccaaaagtggctcccttcttctgcggcagccatgcgccaccctgaaatattcagcaagcatgatttggaggttcttcagaagatgatggcaatgcctctcattgaggtaaaatcagattgtttaacccttatgaaccaccacttatgcgtttttaagaatggttttgaatgaattttgcattattatagtagatttcaaaaaatcgcttgatttacactaatgtggtccagtttgggtacatgaaaaaaaaaatcaagaagagaaaataaactgaaaagtggaacatgttatatgcaaattaacctaaaataatactatcgcaaaccataaataccactatcggtttagatttgtttttttaaagagcaattgtttggaatgttgacatatatatatcactgattgcttcttgatttttcagaataaatctaggcagcaaggcatttatgaatcaacacatcgtgatttgcttgttgcttttggaaagtgggagtttgatccaatgaatattaccaatccatttcctcaaaatgagggttctgtacacatctggcaaggttatgaagacaggttggtgctggttgagctgcaacggtacattgcccagaggcttccttggatccagtatcatgaattccctgaaggaggacacatgttcatgctggtagatggatggactgacaaaatcatcagagcgctcttggttggagaacagctctgaagtctcatcaaatcattctgtgcttgttagcttatcatcgatagccaaaagttaaaatttcaaacttattaattctagagttgattttacattttctatatgatactcgctctgtttcattttcatcttaacttttttcttattcaaacttttttaagtttgatcaaatttataaaaaaaattaacaatatttacaacatcaaattaatttcattaaatgaaacattgaatatattttgataaatatgtttattttgaattaaaattgttgctgcatttttatataaatttggtcaaacttaaaaggtttgagaaaaagagtcaaagcgacttataatatgaaacggagggagtagtgtattttgtagaattggtttttaagtcgtaaataagttttacctataaattatttttactactttatttatttttttttatagatcgtcagccatcgctcaaacgattcgacactcgagggtaaaatttacttaaaaaaatgtacacaaagggtaacattacacgcatttatatagtcaactatattttgcagttttagtaaaacttggagtaatccaaactggagctagtggccaattcagccacggctgaggatactccacatcgatcgcagtgtcattcgtataatcataaactccaacgtcccgacgaagatgtttacggtgaaccaagtacccgtagtcatcgtcgaaatatatgtgatttggcatcaagtgtggataatccttcactggcaagcacatcgagtaactagtgccaataaacaatgcattgttacctatgtcatcgacgtcatcaagatcttgcttcttgtagtcaaccttgtacaccccgatttcagttgttcgtacgtccttatgctcgctaccttcatcttcttccgtgactcgcaagacctgcaggatgtcaccttccgtggtacgtacaatgtagagggtgcccaattcacccatggtcggcttgagaatcagtctatgggtgaaggaggaagaagcactgacgacatcaatggcgtggatggcgccgtgaacggtctgggcgtagaacacgccgtcgtggtagatgcaatcttcgaaccactcacactcattgttccccatcttgatccatgtccacttcttgtcgccggatctcgcgaaggagagctaagatatgggtgatggatgagcatcaccgtgtagtcgtcgccgcgcgatgggtcggaggagatgacggctttgagatacaagaactccctgaacgtctccggcgggtgcgtcaccgtgtgcatgtcatcgtcgttgctccggtgactgttgccgccgccgtcgtagtagaccaacttgtagttgttgaggttcccggcgtcgtcgtagagtggccttacgtgttcgatggtggcgacgggtgggaggtcgagctgctcgcctgtggccgggttgaggaggtggagctcggagcggtggtcggcggtgacgagccagccgtgggatgacccgacgatgtggcgctccgcgatgggcgggtccgggagggggaccgtgtaggacgtcgtcttgtcggcgaggctgtagagcacggcggcgcgcgggccggcggcggcggtggtgtagaggaggcagggcgtctgcgcgcgggagtagaggccgaggcggcgtatgtcgcgggcggtggcgcgccagagcttgcagacggcggcggagcggaacaggtcggggaactcgagctcgaggaggacgaggccgagcacgtcggccggaagctccgaccagtcggcggccgccggagtgtccatggaaacagatcgattaagcgtcgatgaaggcgtacgtacgtgccgcgtgccgccagatcatccgctaaaataaagcagcgcaactgatcgacgcggatcagatcggagtagaaaccgaacaggtttcagaaatctctatctctatctcttccctatctctactctctatctctatctcctctccactacctaaaaaattagagaaatttccgtgtctgtgtgctaaaaaaaaatgcgaaaaactttttctgtccgattgaaaaagaaagtgcaaaaaaggatttccgttttccgttaaaaaaaggaaagaaagatttctgtaccgaaaaaacaagcgctaaaaaaaggcgaaaaatgtgcgaaaaaaatatttccgtccgatttaaaaaaaatactgtcgtccgtggccaagaaaaagcaa

SEQ ID NO: 26045 - DNA, 10843 bp, Oryza sativa
  unsure (1)..(10843): unsure at all n locations
gctttttttttagacttgaccatgcgaggcagtgtaggattttgattcatcatattttttattgcaagaataggattgaaagagtattttagattatggccatgtttagttccatgccaaaattgaaagttcaaaaaaattggaacgatatgatggaaaagttgaaaaactgtgtgtaagaaaattcgatgtgacagaaaagttgaaggcttgaataaaaaagttgaaatctaaacaagccctatatgcatgttgtcacatgaataatccaacttttttgggcaaagcaaagcattagtaagattgccatcgtcgaggttgggccatttatggaagatgttctatttttccttatgatatgtcttagctacaacaatcaatacaaacattattattcacatggttatttatgaaaaacatatattatcattggaatttttcacccgttgcaacgcacgggcagttttgccagtactacttaaaaaaaagatatgttttcttcgatcgtcaaaaaaaaatagctagaaaaataaaaaaaaagtccgacccctagatcctattccctctccactcctctcgttttcaatagataccgtgatatcccatatatcttggtgaaaagaattgatgtgccggattgaacatccgtttgcaaaaacgaaatctacaggtcgagagcattccatttttatatgattttaatttttgggtttgtacttttgtatttgattccatataatttttatatttacatttgagtccctataatcttgcaataagatacttgagatcgttttagttaaaaaaataataaaagggtgagaaaagacagaaaggtgcataaaaagaaaaagaaaagccgcataaaaaaaagaaaaacaacaacaacaaacgtagatccgaacggaaaagaaaaatctgattcctataaaaggaaaaaaaagtggtggaaaaaaaagctagatccgattcctttaaaaagggaaaaaaagttttattcctataaaggcgaaaataaataaaaacatctaaaaaattcgtccgattccctaagaaagtggcgaaaaaatgcttcgtaaaaaataaaaagctggttcgtataaaataaaaaatgcacgcgagaaaaaaaaagaaaaaggcgaaacaaagtccgatttctaaccggtatatatctattctctatctctaatctaatctaactatttaaaaatagaaaatgcatgagaaaataaaaatggttcaaaaaacgtgtgagaaaaagtcagaaaaaagcgcaagaaaaaacacgctaataaggttttccatcttcctaaaaaaaattaaaaaatgggtgagaaaacttatttccattgtcggtaaaaatttttttaaaaaaaacatgcgaggaaaaagctgtcagaaaaaccgcgccatttttaaaaaaatggtttgaaaaaaccgtgcaagaaaaaaaaacaccatctattaaaaaacaaatcactctgaaagtactgtccaaaaaacgctaaattgatggacgcttgagtcggataggatccatcgatttttgccatctactacacggcttttatttcgccatatattctcctgtattggaaaaaagtaaaaaagaacattcgaaaaaaagcaaaaaatacgcgcgagaaaataattgtcagaaaaaacaggcaaaaaaacacacgagaaaagaaaagcaaaaaagggagaaaaatatggttttcatcgtcagtgaaaaaagaaaaaaaaacatgctagaaaaaaactgttagaaagaaatgcgccatttctggaaaatgattagagaaaatcgcgcaagaaaaaaaaaccatttataaagaaacaagtcgctcattaaaatacaaacattgtcattgacatgattatgcatgaaaaaagtatattatcattagaatttttttcactcgttgcaacgcacgagcatttttctagtctgtttaaaattaagataattttatcgtccttaagtaagtacctagagataccatatttagtgtaaaatttggtacatttaggtatcaagtaccttaagtatcaaaaaatttattgtaaaacaggaactgtaaatttcctcttaaaactatacttcagatatattctgctgatcagatgtttgtccgtgactgacatgtgaggccccggtcaacgtgtcactacgtgattggcctgcacattgtccagttcttttgtggtcgacgtgactaatataataatatattcggattaattttttaatagcgttagatgtgtttggcagtaatccgctaggggcatgcgaattagctaagggagttgatggagaaaattaacgtgcgaatttaattttttaattctaattatttcttttttgctgggtacattgctagagagaaataagagggtattcatgagagaattcatatcttctaagatatttgatgtgtgacttttgaggtggaaaattatattataagtcatgatgaacggtacggtgaggatgtatttatctttcacttaaaacacagttctcactcaattaccacccctccctagggatagattggtgggagttggatcgattaattccccatcccaatcttttctaagggtctctttgaatcataagaataaaaaaacagaggaatagaaaaaacataggattctgacatgaatgtaagtgtaaaacagaggattgcaaaacacaggaaaaatatagtaataaccgtttgattggaccacaggaaaaacacaggaatttgaggagagataaagactcaaaggatttcttctatgaggttctacctctcgttaaaattcctacaaaacttgtatgggaagagacattccataggaatttcataggattttatagggtttattccttttattcaaagggctttgtaggaaaaattcctataggaataaaatcctatgaatttcctttgaatcaaagggggcctaaattcataaatcctccgattaaagtgagattaaaatgctcagatttcttacactcccattccatctctcaaactcctctcaactataagccgtaacgccacgaaaataattagagaaaagaaaaggagcaaaatgaaaagagcaaagctagctagcagcccagtagctagccggcccagcagcaaaaggcagcccacagcagcatagcagcgcagtgcaagcagcagcagaagagcgagcagagcagcagcagcgctggtactgtagcaaaaataatcccacctcaccaattcaactcgagggagaccttttctccaacgaaagttggataaaattttagatactcgtggaacgcttttcaaactgctaaacggagaatttcgtgtgaaaactttctatataaaagttgttctagaatatcagattaatctattttttaagtttgtaataattaaaaatcaattaatcacacgttattaccacctcgttttacgtgaaacacttaatctttatattcatcttcatcttctggagattcaaacaccacctagataggagaagagcccccggtgagtgtaacagcatctccaacagcctctccaaatcgaactctccaaacacccataagccaactctccgtctgatttagctagtcaaactagatactcactccaacagactctctattaatcctctccaaaataaaatcggactcacatgtcaacatctatcccctcttcttcatctttctctcccccttcttctttctctttccttcttttcccccttccttccttcccgtcgaggcggtcgacgcatggtgcggtggtgcggcgacgcggggaggtgggaggcggcgacggcgacaacggtttaggggcgcagcagcggagctcggggaggggatggcgatggcggcggcggctcgcgacgacgacctcgacgacgaccctgacgacaacctcgacgatgacctcgtgaggagtacagttgctgcgggccaccgttggcgaggcgttttggctggccaaatctagccagccaaccagcgattttggccagctggatggctgccagtctgttggacctcctttttatggttgaatggccaaaatttggcttggagagtctgatggagtggttgttggagatgttctaactccgattctggaattttttattaaagtgaggacgaaaaagtagtgagttgtagtgttaggtgtggtcaaactggatgagatggatccaatactgtttttgggccttgggcgtcacaaaagccgtttaagtttttttttattaggtgtctctccttttatcccgtatatatacttttgtaagctacatggaaaacattttcattgttatttacctatgtttttaactaactccttgtcagggttatggataccacatacctattagtagttgactaaatctcggcaggactcaccacataccatgtcttatgcggaaacaaccttcggatatagtaggagttccacataaggaaggatgaatagagttctacatggaaacgacaaggactactcgggttgtatccatattggttttcctagttctacttggacaaggtgatacttatgggtataaatacaagaccccctaggagaagaggggatacggaacaacagaagccacaacatacaagccaacatatgccaagacaaaacgccggatatcgacttcagagataggcatggctagtcccctacggtacctacggataccgtcaggagagatatagcgatgtctcttatctcgccgaatgcggattcgaagaggaaagctaccctgttgtcgactacgagtcaaaccttcagaccgtcatgtcgataacagttagataggctaccccaaatattgtaatggtgtgattatgatgaataagagcaacgaccggcttcggccaacgggatgtagggttattacctgacaattcagaggcctgaacctgtataaaaatccctgtctccatctcttttacctcaatctcgtatataccctggtaccaacgatccccatactatgcaaataccggaatcgcgacatcaaacgtcaacactcctcaatagtgatcatttccagtcgactctcatggtattttttgtaagtgttattcacataaatatttgtacctacatatctattatattattaaaatagttttgaaagaaggcacttcgtttcttgtggaggctaaaaaatcccacattaatcaaagaaaaagaaaataaaagtccaagtagacgtacaattaaaaaatatctgaaatactaaaaataagcaatattgaaagaagagtccatataagaacccaatacaagataattaaaattcggaattaaaaataaaataaattctgaaattagaaaaaataaaaagagttcatgtaggaatataatttagaaataactgaaatttggaactaaaaataactaatatctgataagagtccttatacaactgaatacgagataattaagttcggaataaaaaaaactaaatttcaaaaatagaaaaatgattataaaagtttaagtaggaatacaatttataaatataaaatattataataaaaatatggaattttcaaaaaaaaaaagataacctagaactcaacgatgacaaataacaataaagagagagaggacaagtaataggccctaaaatagtaaggtggtgaacagttgatgggacatctaaaaattataaacaagaccacaaatagaaccccagcaacaattaagaggtggaataacagacaggacgctaagcagcatagccacgacggttggcgtgacttttacaatgtaaaaaatgaattgcaataacaatcatgttttattttaaaaatcttcaatgataataaatgggcaggtcatataggagtatagtggtggagccgacagcggttggcgaggcttctagaaattaaaaaaataaacccttaaaatttgaaataaaaaaattgacaatgggaaaataattctatgagttcacaaataaaaaaatcggaatgaaaaatatggaattttcaaaaaaatagtccatctgaaactcaacgatgatatataatagtaaagatgagagaaacattaggcctgtaaagcagtaagttggtagcaattcatgcgacatctaaaagctataaacaataccataaatagaatcccaataatgattaagaggaggggcgatagacaagccgttaagcagcacaatcacgacggttggagggacttctagaaactaaaaggtaaatcgcaatgacaatcatgttcgatttttaaaatctcaatgataacaaaaatacatgagcatagtggcgaagtcggcggcacggtggttgggcggatttctagaaagtaaaagatgaacctcaacgatagttatgtccaatttttaaaatcccaacaacaataaatatggaagacaataggtggatcatagagaaatacaatattgatgtttgacaacactcctaaaaattaaaataatggaacctgatgagacaatggactctaaaaacttggactctagaaactaggaggtgcaatttttaaaggtttaaaggaagataaataaaagcagtgatagatcgtacaaataaaagggtgataaaagagtaatgggtaatgactggtgtgacttttaaataaaaactataaaaatttaaggatgataaggttcgatctttgaaggttataagacaacgcaatggcaatttaacaaattttaagtaacgtcaaatataaaaaaaatagataaatttatatggatgctagcctcgcaatttcgcaggtctcccagctagttttcgtaacatgagtaagggttagtcacccgtcccgaagaatggatctgcacaatcgctcaaaaaacagcgggaggccacgccgcaagcccgaacaagagctttacaaaagtcggatagaccaccagtgaggccaagaaagagccgaagggtccgttaagaagtaagaacgttgcttatcaacttcacctgaacaacgacattatatgggatatcaaacacacagcccatagatagaaccgtacctaagcaagatggctagactctagagaaccaaacactagaagacccatatagctaacgttgaactaattatttagcttaacaatccatgttcaccgaatacttcagaaccaaattgtgtagtcgatcgtgtgcccatgcatcgatcgaagcacaaacagatgaatttccatttatattttctagcccggtccacatatgtatattcgatcagcagcaagcccacaaaaacaggtggcctggatgatagcaacgagaacaaacaaatgtgccagcaataatgtgtcttacatttgccctcggtcaagtaattcaccgatccacagctagcggggaaaaagttcttaactcgagtaatagaggagatcagtctatattcgggaaacaggtcgaactcgatccattgttttattgagagttaatatttcccgatctggtgtgcttcttacttttccgacgaaacctgcaattaattaatcaaagtacatcagaaatagccattcactgctgtttaatgcacgtcataattaaaaatcttccaatctagctagctagtgttctagaacacagttcaaattatgaataatggatcatctgaaggctaagggaataagtatatatgtacaaacccttcacaacagttagctgattaatcaattaccagctggtagtagacttgtacgaacttatgaagggccatgctcaggtgggaaagttccaccaccctacatatatggaaacaaagaaaaagaaaacactcatttgagatatctctttgagtttatctccatttccatggcactgtgttgaaatgcaaaataggcgcgaaacatgaatgaactaacacatctataattatcagtgggataatgaaacaatagtacgtactcctatatgggaagcaaaggtgacagaactgagataaattatatgaactaacacacacatgtttaatactagtattacattaattacattattactccttggtgtgatgagagacagtacaatgtggatctagcagatttgtacatagcagatacatttgcatgccacatgtggaaaggtagctaatttgtggagtagtactagtaaattagactgagatgcaaaatcgtaccgcttggaagtgaatgagcgtagtggtgatgcttgccagcggctgctgccgtatcgaacgcaagcaggcaatctttgcacttgacggtggccttagaatgatgtctagacatgtgtctcccgaactgtaacagtttagtggatcagaattcagagattcaaattaaatcatctatcaatcgatcaactgtagtagtagtagtaagttatgcagctgctggaaattaagacaattatattgcacatgtacacatgctctgcatttctgtaccttgtgctttggaatgtagcgtgggtcatcgcactgcgaggcctccatgcagatcaaacacgacaggaaatcatctggacagaatagcatagctatcccgtatcggcggtagaagagcacctcctcgtccgtctcggggtgtaactgcctcacaagcgctaacgcctcgaggaatctaccagtcgcgtcaccgctgatccttcgcctttgttggttttttttcccatttctggtggcgttgcaggctgcatgcagtttcagagagcacggcgtcaatacgattattgcccggtgaaacattacacgatgatgccccatattgccacgcgatcgcaatcgatggtgctcgtctcgagcggttggatcggaggaatgtctcggctggcccgtcgagaagagatcggagaaaggaggtcgagggtttaatttggaagagacctcgtcggtggaagggcttcggtgcggatgctgtggtcggagtcggaggtgtgtcgtcgtcggtgcagtcgaacgcgatgacgaagtacggcggtgggcggtggcgttcggaaactgcagcgacggccggcgtcagcaagtcaatcgcgcgcgatggcgctagggctaggcgctagctagctccgaaccggagagggaagctgggttttggactaattttggtcagaaaacgaacgggatagagagacggcactgccagtactggtttggtttactcccgccggtggacaaatcgccgccggagaagttgacgacggcgaggaatcgatcgaaacggggagaaaacggcaagggaggagatgatgcgggagaaatggttagaaaattgggggagaaaggcggagatcagaatgagttaataccttcccttcgtgtgctcggtgcggtggacggcgcggaggaggtggcgtggggcacggtgcggtcccggagctcgcagccggaggggtcgacgacggcgacggcggcggcttcaaccctcggaaactgcagcgtgagaaattacggcgtcagagagtacaacgatgctacgcgccatggcgctccagtctagaaaattccagaaaactccagaccagttagctagggtttggatcgcgagtggatgagatggggagaacgaggagcgcggatgcaggaacaggatgctaagttgctaaccttaagctgcgtgctcgtcgagatgcggagatggacgaaggcggtggctcgtcgaggtggacgaacgcggcgtggtggtgggtgcactcgccggagcccgcggccggagaggtagaagacgacggcgcgcgcggcggccgcgctctctctctctctccgtcgcagcaaaggagctcgcctcggctccgcgagatcggggggtcctggtctttatagccgagacagaaggcaaaagcttttttttctccctttttttctttgttttttttaaacatttcttatttccttattacttcctctcgaagaatggaagacttcgcacgaaatacaagcccaacacaacacggcccatctcctctgtcgccatcgcactgagataaactctctcttccgtagcccaagcagtggacagttactgagtgatttagcatttgcttgtcagcaaatggaattactggtacacaatgcccataacaaaagctacacaattactggtacaacaacaattactggcacacaacagctaccaattactggtagtccgtaaactactacagtataccagcatctcacccagataaacatcgcacagcgacgacgtagtacatatcagatgatgaattatccaaacaatatgagcattgttacatatctgacaagccaatgcatgtgccaggtgcatatgcaaaattgtcacttatacaagcattaatcatttcaacgaatcattgttgacttttaccaatagaaaccctatatactgttgtccaaatctcagtcccagatgttctcaacatgatcaagggattcctattacacctcatcaaaagagaagatcaatggagaactgtttcttcatgaacatgagaccaaggaaaaaaatttacaaaaaatagaaggcaacatagaaggaatgtactatctgtctggaaagaacccaacttctttactcaagagaatgttccccaagctccatcttccttgctgattgaagacgaaaacaaaaatatgctgcctgagcacagctaaataatgaacaattgtacagaaatatgcatatatgagatgttcttacagggatttccactaaaaaagtacacatggcacaaaacaacattctccaagtattgaattgcattttttgactggtcttcatcaaatccttaaacaaggcattatgtgcaatcaataatctggaaggggtccttccaannnnnnnnnnnnnnnnnnnnnnnnnnnnnnnnnnnnnnnnnnnn

SEQ ID NO: 26046 - DNA, 1312 bp, Oryza sativa
aagaattagtgctcatgcaaaatgataaggattttacatggaaaaaagaggggaaagaaccccaggtctaaaattttatgtgcatggaacattatggcaaggaattaagtcaggtagagaacctggaagcagaggtgttgcgtggcaatggcaacagtccgtctcctcaccgaccagaatttcatcacagcttcatctccatatccaaagtgggtgattctgaatttccatcaacaacaaggacgttcgaagcaacaacttacatctgccgagtagaaacagggatttgactcaacataaaccatgtcgaggtaacagtttatgtagcttacagccggagatcacgggctcaagaaaagatctcgaataaataaagaaggaaagaaagtggcatgaaggggtccatataatgatgggaacagactgccaacagaataaagaacatccaacattgcaggatttcccctccacaggacctgtaagacagcttcttcacaattggcaccccttgcctgaaagcaagccaggatcagggagaaatggttccaaggattggcctgctggttgtgctggttggattggccttccaggcaattctccatccaccacctcaaaaattgtgtggctcaccaggtggacctcctgtgacatctcccaggatcaagctcagtgatagaaggcacgcctacaaagagggtggagttcaaaaagacaaggccaagtagataatcgcagtgcatgcatttgatgaaaccaaggacttacccttgcctgtttctaaggtaaaggcaaacaacaaatacagtaagattggaaattcctctttttgtgtggatcaaatctacatagaattgcaacattgattttttttctttagttcacacttttcttaacacattactttgtctgtcaaaattcaggaacttgtggatgaactgggaatttaccttcttgctttcgacagagcagggtatggggaaaattatccaaatcccaagaggaatgtaaggagtgaggcattggatattgaggagctcactgaccagctcaagcttggacagaagttctgtgttgggaatgtcgatgggaggatacccaatttggggtgccttcagtatataccaaacaggtaaagaccgaaactgcaatactgtaccatcaatggtatatgtgacccttcactctccagaaatgtaaagatacaactactgtgtgcaggcttgcaggagcagcgttagttctgcccattatcaactactggtggccttcttcccccgctgagctatccaggcaagccttcatgggtctcatc

SEQ ID NO: 26047 - DNA, 2568 bp, Oryza sativa
  unsure (1)..(2568): unsure at all n locations
catttgatgaaaccaaggacttacccttgcctgtttctaaggtaaaggcaaacaacaaatacagtaagattggaaattcctctttttgtgtggatcaaatctacatagaattgcaacattgattttttttctttagttcacacttttcttaacacattactttgtctgtcaaaattcaggaacttgtggatgaactgggaatttaccttcttgctttcgacagagcagggtatggggaaaattatccaaatcccaagaggaatgtaaggagtgaggcattggatattgaggagctcactgaccagctcaagcttggacagaagttctgtgttgggaatgtcgatgggaggatacccaatttggggtgccttcagtatataccaaacaggtaaagaccgaaactgcaatactgtaccatcaatggtatatgtgacccttcactctccagaaatgtaaagatacaactactgtgtgcaggcttgcaggagcagcgttagttctgcccattatcaactactggtggccttcttcccccgctgagctatccaggcaagccttcatgggtctcatcatgccagagcagaggacactctggattgcacacaacataaacttccttgctctacctctggatgacccagaagtggctcccttcttctgcggcagccatgcatcatcctgcaatatttagcaagcatgatatggaggtccttcagcacatgatagcgatgcctgtcattgaggtaaatcagagattatttcacccacatgaagtgctatttaatagaacattagaactacagataaacaaatgcatcggccacatccttcaaagcttgcttgatttatactactgtggtcaagagaatgataactttacattaaaaaatagtaagagaaaagctttcaaaattaatatttatatcaaaaccaacctaaagaaaaatgtcccaaaccataaatactacttgttcaggatggcatatcatcgctttctcttcatttttcagaataaatcaacgcagcaaggcaaggatatggaaattgggaggttgatccaatgaatattaccattcaccaatccatttcctcaaaatgagggttatgtacacatctggcaaggatacaaagatagttggtgctggttgagctgcaacggtaatttcaaagaagctttccttggatccattatcatgaagtcccagaaggaggacacatgttcatgctggcagatggatggactgacaaaatactcagggcattcttggttggagaataactctcggagctgtgagcctgtggctctcactgaagatgctatattgctatgtagtccttttttccaagtttatttccgataatatcaaatttggccccattcaatagatgacagaccatactgtcacattaagctatttgttaacagtgaattgggtaatgacaattgaaaacacgaagccttggtgcgtctctagcttcactttggttgtttatgagctgtcacaatgcctgcttcagctttcaagtacagaaggcaggtaaagaaataatgctaagataaatttaagtaggtcaatgggtattttaaaaaagaataatcaaatgcaatacaatcctataaaacagtacctgaatggtactaacatagtaataaaactcatggaaaccacttgtttcttgaaatgagtaagagtttgggcgactgcagaaatatagtacctgttaagattttttttcctctgtctggtaaaatcaagtttcatatattccaaatttgtgacagactgggcattcctgtcattcctgatacacctaacagaattagtccatagtattttcaagtgtagtaataaaatgttttcaataccagtgaccagactaccagacagcatgagccatatgacttaaatcagtccaagaaaatagttcatgatgagagtgaatacatttataagacaacaaaaatgcaatcatcacaaaaagatcagtctagattctaacaaatcaatgaaataatgaagacctcatagacaatagaatccacaaatgtaacacttagttgctttctttatataacacagctaaaagcatattcggaaacggaatgacggtttaactacttcagagtgcacttctggaaagagcgaaaaccaaatcgaagaaaggcaggtgtctacaacctgaccatattgcattaatcaacagagtagaatgtactaggcaatactaaagtaatcacattagtaaacataatactaagcattacttgatctaggttctggcatcatgaatgtcatcaactcactcgcatacaatgttacatctttttcactgctattaggtataccactacccacaaagtacataaatttgcaaaagatcaagaatgaatgtcagaatgaagtcactactttgaaatttgaatgttgcatatggtaataccaacattctgcaacaagttatggtccattttgtcaaaatgatacaacttacaaccttcaaaattaagaaatgaaaccaagataatgtnnnnnnnnnnnnnnnnnnnnnnnnnnnnnnnnnnnnnnn

SEQ ID NO: 26048 - DNA, 7273 bp, Oryza sativa
  unsure (1)..(7273): unsure at all n locations
nnnnnnnnnnnnnnnnnnnnnnnnnnnnnnnnnnnnnnnnnnnnnnnnnnnnnnnnnnnnnntccctccattttttaatagatgacgcctttgactttttctcatatgtttgaccattcgtcttattcaaaaattttatgcaaatgtataagatataaatcacacttaaagtactatgagtgataaaacaactcataacaaaataaattataattacgtaaattttttgaataagacgaatggtcaaacatgtgagaaaaaatcaacggtgtcatctattaaaaaacggaggtagtatttatcagtagcacttcagaataaacagaagagaagaaaaatgcatgagcagatgcttcagatatcaggatttcaagtacagcggattaacttccaaaccaaacggcttacctaggtttacagacacaattactattatgacttcttggaatgtttcaagcggcaataattcaatggaatctgaccactagtgaatgaaaaacatactgcagatttgtactacacaaccaacctctagcaagctgtgcaatgatttgagaacacagattaagtggaatagtaaacacttgtgtgtgtcagcaaattaaagggcctctctgctgttgtagtctcataagcagaccatgtcttgctcatctccttatcagtagacatagaattttcacccaagatagtttaacattaaaaatcaataaaatgtatccaaacaatatgagcattgttatatctgagaggccaatgcatatgccagatgcctatggcaaaattgtcagtgttacaaggattattcattattcatttcacaaaatcattgttggcttttaccaataggaaccctatatactattttcgaaatctcggtcccaaatgttcactaccattcaactttttttttttgagatagtaggtatatgggagacatagtcaagagatttctattacacctcatcaaaagagaagaacagtggagaacatctgtatctccatgaagcatgaacatgtgaataaggaaaaaaattgacaaaatttatccaacatagaaggaaatgtttgtatcaactatctatctggaaagcacccaacttcttttctcagagaatgttccccaagctccatcttccttgctctgattgaagacaaaaacaaaaatatgctgactgagcagagctagataatgaacaattgttgcaaagaaatatgcatttatgggatgtccttacagggatttccaccaaacaagttcacacggtacatctttcttaaggacctgtctatgcacccaaaacaacattctccatgtactgaattgcatgttttgactggccttcatcaaatcccttaaacaaggcattatgtgtgcagtgatctggatggataccatgctgatgcatttcagaatacagccttatagcctcttcccagttaccttctttacagttcccatcaatcagcaaagtgtacgtgtatttgtttggcgacaatcctctttccagcatctcatgaaaatgctgataagctaagttagttctccccatcctgcaaagtgcatgtatgagcacattatatgttacttcattaggtcgcactccttcctccagcatcttttgaaaccaaccatatgctgagtaaagatttcctcttctacagtatgcatgaatgaaaacagtataggtcacagccgaaggtggcaacccacttacaagcattccatcaaaaatatcccttgcttctctcagacgccccctttcacaatgtgcgtgaatcaagcatgtgtacgtgatgcagtcaggctgtaaaccgtcactgaccatcttcatccacaacacataggcatctttcaagttaccagatttgcacaatccatcaaggaaaatattgtatgttactgtatcagaagaaattcctcttgaaatcatcacctctgtcagctgaaatgcctcagaagtagaacctagaatcagctctgcagaaatccttgtattataggcaaagcaatctggctgcaaacctttgctcaacatttcatcaaagaactctcttaccatcgcaagattcctcaccttacgagacccattcatgagaatcgtgtatgtagaaacatcaggctgacagccctgctctaccatttcctgcttgaatctcctagcttcctctaaatcacctaatctacaataaccatctaaaagaatgttatatgtcaaaactgatggggctaaccccgcacgcttcaaatcaccaaataaccaaagtgcctccttcaaattccctgccttacaatacccatttattaaagaattgtatgtaatcaaatctggaagtaatcccattgctctcatttccacaaacttcatccgagctgcctccacattaccacttctaaacattccatgaataattgtgttatatgtcaccaccgtgggtacaatgccctcattctccatctccaactgcaatgctccagccttttcaacagaaccccttgcaaaatacccagtaataagtggattaaacgtgaaagctgacgccttcttggacatccgcattctgtcaaccagctgagctgccttctccagctcacctttcctggccaacccattaatcaccacattgtatgtgacatcactcggcaagcatccaccaggccgggcctccatctctctgagcaacttggcagcctgatccaccctaccctccctgaagaaagaatccaacaacgtgttgtatgtgacaatgctcggctcgattccaagctgaagcatctctgcatacaccgagcgcatgtcatcccacctggcttcatcacgcagcgcacggagcacgaggttgcattccttgatgaaagggggaactccgtggtgcgccatctcacggaaagcggcaaggcatagcgtcgaacaggtggagggcgcagggttgcgagctcgggtattgaacttggtggacaggcgcaggaggaggttgaggaggtagtggagggagacggtggtaggaaaggagaggaggagggagacaagggggaggagaaggccgaggtggatggcgcggacggagacggggtgggcggcgtggaggtgcttggcctcggcgagcgggacgaggacggcggcgtacgcggaggcgcagcgcgggaagccgcgcggggtggcctccgcccaccggaacagctggcgcgcgaggcccgggaggccgcggagcgcggcgtggacgtcgccagcggcgagcacctctcggagcgcctcgggtggtgggggatcagacgcgagcagcgacgcgaacgggctctcctctgtccgaggcgggggaatcagcgccgtcgacgacgacgacgacgacgaggagacgaagcggaggccggagatggcggcggcggcggcggatgcggcaggagcttgggatttgcaggggtggatggagaagagcatgggttaatgttcgagtcctccccggcggcgcctcgccatgaatggctgcggcggcgggcggaggcggcgccggcggcggggaggaggaggggagaggagggagttcgatgcggtttgtaagatggtcgcgtggccttctccttcgcacacgacttaacccagaaaattttcttgtaataattcacttctctttgggcttttctgtaaatggcgcaaacgcacgttactctttagctgctccctttgtaatacttggttctttttcactttgtttttacttcaatcatctgtttttttaatggagttttatggctatatttaggatgcaggactttaggaaactttacgaacttgtatttctctttttttagggaaataggacaagtggccaaagttgaagaataaacacttcgtttcaaaatataaagaattttgttagtacaagcttaaaatctcttttatattgcttatatattgggatggttgtagaagtactctagggtcaagtagctagtttttttttttcgtagatacgttagcgttggtagacgaatggataggatagtatcccagtggatgtattgtaagctcaagttgtgtttattgattggaagttgctaagataccttgaactacaataatatgcgggcacattacacgctgaactgtactccaaaatcgatatagacatcaggatttgagccgtagtttccagctttcaatcgcaatctggcatggaccaagactaaaaccacgaacccacaaagccatgtaatgtatgcatatccttgtgatttcgacaggttcaagcgaattataggaaattacagacagcatccatcaggtgatggcctcccagtcccaatgtgattcctctactactgtaggaaccaatggtgatgataacgggccatattgagctgaatctcccggatctggcccgattttaaatgcatcctacgtaaagcataatatacggatgcattttgaggacaaatgtaccacgttttttgttcactacaaccgaaaaatcagcacaatgggcttgcagaaaggaactcaaagcccgggttttcataagaatcagtagctgtcttcatctgtctcgggcctccggagataataacgcaagcaattcacgagcacctatatgatggcatgttaagagatatataagtatgatgttgctgagatgaccaaagattttaacagaaagtagtaatcaaggcattgcaatacctgagataatgagctgttcaattttgcacctctgtaactcacatggaatttgtcctttgcaaccaagccctgaataaaacatcacatatgaagtaaggaagggagttgacagaacaaggggatttcataacaaagaaataggaacatggcatacttcagtatctatctcagctgattccacatcaacgttcacgtcagtgatgatcttcactatttccagaagtagaccaggccgatcagctgtctctatgtacagcatgctgcacatgtttaactaatatcaatgaggaagacggatgatgaacatcatatggagcaaacagagaagtaaggcacatgttatatcagatgtgatattgagaaacaatacatgcattactaataatatgtagacatgtatcaagcatgaactattaaatgatgtgcatagaaattcaatgatttacagactcaaattaccatgaaaaaaattatacctgtataaaactagggagggttggggtcacagtgttatataatgcaaaacttcaaacatcttataatagattcaatgtctttgcacaaatcttggtggactttggattgataggataggcatgaacatacatgtatatgtagttgtgtttctcaagttacttctaccggttgcattcgtaaagtatgctatcaggtccttgttttgtggagaaatcagtaacgataatatgaatcaagagtccttgtgtgcctttttttcctctaacacataggagagctgcgcatcattctattaagaagagagggagtctaggaagactcgtacaagcccttaaggaccagggttaaacacaacaaacaaaaactagaagaaaatgtgtgcctatttttaaggtaactatctagccgtgcacttgtaatgccccataagtgttcaattatacaatctgtggacatgtcacatcccactcctaagcaaggcatactgaaataaggaatcacgctaaaattgtatataatcattatggcttagttggatcaaaccttcttttaggtccatcatcttcaacaattacatgtgttacaacatcaacatcaacctgagagtttaaagaacaaataaatcacgttcatgctaaagttaatggaatacaaaattaacagcataacaaaacactcaggaacctaacttttttactgtgttaaaattgaggaaaacacacaactttaaaattgagaagatgcttgataacagagcatgggtggtgaacaagcagaatgagaacatccaatgaactcaccttcttctcaggagcttttattccaaaaaattcacccatggctaaattctcacttgattcctacatgcatatcaaccagacaaatgagttagtttgatactttgattcataaaaacaagaacggatccaaaattactaacggtagaagttctaaacacaagtaaaaggatgtgacgctcggaacatacaggatgatactgcagaaggttgttaataactgttagccgtatcttttccaatgtgtcagggtcctcaactttgcgccccctagatacagacagaagagggggaaaaagataatattagacatgaaattatccaaatcaccaaaacaatataagaagcatgatagttgctaaatgttttaatctcgtattgtgtttagtgcacatgtaaactattagtatggtactttgataaatatgtggattcaatgagaaaatacaccctctacttcaaatataaactaaacagcatgacaaaatgcagcacacagaaagtggcgtgcacccacgatcgcatgatgtggaactttgtttgtgtgacagctgattcagttgacacacttcctttcgtcacatcaaggcccaggtccttgagtgccttcatctgcaaacagtgaataccaggacaaaataatttactgatacaacaaaaattactaattacgaaatatatcttaaacaagatcagatcaaatagagcacccatagcataggaaaattataccgtgtcaagtagtgcccccagacggtctccaaaactcagctgcactatggttgcatcacggtctgagtcttgatctatcagaacaactggctgtggaattgcatcatcagatgtctgcaatatttttggggggagaaaaggtacatggtagaaaaatatcattagctaaatatgttctaaaatattttaatggtagtaagcaattaaaaatagcatacacgaagcaaaaaaaaagtaatgtcaaaacaaaaaaaataataatcggactaaatggaaacaatataagttctcatgcagatattgaaatgtgaagcaactcttcccgcggaccatgtctacaactgaactgacttcacacatgtcctcagatgaataattgcactgtggacctaatttgcaggctgggttgttactccagatctccactgtttaggaagacaactctatccttcatcacttgatttttttttaagtggaacaacaaagctgaaggacgtgtcgctgtgaaatgtgtgtttccatatggtgacatgaatggaaaatcaatatgtacataccgttgaagaagcacccaagacatcagccgag

SEQ ID NO: 26049 - DNA, 8742 bp, Oryza sativa
ttttttaagtggaacaacaaagctgaaggacgtgtcgctgtgaatgtgtgtttccatatggtgacatgaatggaaaatcaatatgtacataccgttgaagaagcacccaagacatcagccgagttgatagattggcaaaaaatcctacagtgatggcattgagaaaaatgatttagaggagggaatgagcttagttcaggacactgatgtactacaaataaccgcagaattaaatagcaacactagaaatagaatcacgttatgcatttcaaagttagcactcagccactcagtagccattggactgacatacatgaacaaaagtaacaaagggaaaataaggattgcacagttgactgcaactaagtactgattctgtccctttactgatgcaccagcattcaacagaaaatccttagatggctcctaattataaagcacacagatttctttaaaacgatcatatagtgtttacagacggacacgttgaatagaaaatatagttttagaaagctttatgccacaattccagtgctaaagcccacagaatccaacacatgtaacaataggccttcacgagttagtaaatgaaaagcccatcgtgtagcaaatcggtcttctcatgttgtttattcatttatgacttgtgagaaatgagaatcaaagtgtaggtagagttgtaacttgtgtcaatatggccttgaaacaaatccgcacaccgtggcacgagctctctatgtaaagtttctttcgagtgaactaaggatttgaagcatgaaagtaatttttttttcttgttcattccattcattttccaactcctattagtactccaatcaactgatagagaccttctccaacattcatgttcacctaaacatgaacctcactaccttagtgaaactgagactaacatggatatttccacaccgggtgaaactgcacctaagtaacgcaagatatacaagtgagataataataaaacgattgcatctcaagatactagaatttaggataatcgttcttgccagctgacaattacaacgttttaggcaaaaaaaaaacgtaaatagtgtaatccgtgtacaaacaaccgcaggacaatatctgtactaggtaaggaatctatcaagatactattagtacaaccgcgatttctccaagccaatccaaaacaatatcaactaattcagtctaccgacacgacactccaatagtccaatcctaccgcacatctcccgacacggcgaaccacccctccctcgtcatcgattcgaatcaaacagccagacgcaacgcggagatgcctagatcgctcacctcggggccgcggtggcggccaggccgacggatcgggggaagtcgtggaggcggaggaaccccggcgacacgcgagccgagtagtacggcgacacggcggcgggcgcgacgaggtggtgggcggcggcggcggcggcgagagccatggctggttggtggtgacactcgctgcgcgcactgcggcgaggcgaggtgaggtgaggcggtttctctctgtgtgtgtcttttctgtcgcttgctctggtcggggcggttgggcgaggaagtggatcttttttgcttatttttatttttttaatctgccacttggctgcattattggattggatgtgccctttttcttttcttttttcatttttttcccctgctgttgtgttgttcgtcagctaggattttttggacagtggttgttgcagttgtcaaaattttcattgaaatagttttattttaattattggttgccttgtctggcatgagagtatgaagtgtctcttttttttctctctctttctaggtgacgccagatgagggtgatgattcattcactcattcgttgattcccaagagttgcaaacgaaattggcatgcttactgccagtaataaagttgaagacgtgtcgatgaaacggaagtggctcgttctctgtttgtttaggaagatgggccgggctgaatcacacgttagttggaggcccgtcggggcatgtagtccatgtactccctcctactcagaactactcagaataagtttatttgctccttccgtttatctcaaaataagtttacttttaaaaaagtattacatcctagcttataaaagaaaagaataaatgcatttcttatgtatttactgaagtttggtaaaaaaactaaatgtatgtaaatatttggtaactttataaaaaaaagtatggtttaaaatgacatcaatccgaacagcccatgaattttaaggaactgtctatgtaacatccagctgaaatttttttgtcttttcagctggatttctagccgtcggatagacctcttgccagcatcccaacctcgccttgcgctccctgcctgcgcggccgcgcctcgagcgcttctcatttttatgtcttgttggattgggtacgggcttcaagcacgtctgtgttttgtctattataaaaggtccaacaaacaaacgggcttgaaaaacactggcccaatcactgtccacgtaacagaacatatcaggctttgcaacgaaagctctgtttaatagctaacattctctgaacatacgtcgggctatgaaaaacatgtaatctactgtgttcaaattttggttctctgaaccaaaacccttgaaaagaaagcaaagcactagagccacctaattactagtgcctaactagattgaccattatctccactggaagatcagccagaaaacatcacaagattgactttatctgttagcttcctagtcatccatagcgcaatattagaccctgcaaaaatttgtacattttacttagttacttcgtaccaagatgcagatatttctattccaatctgtgacagaaggaaaatcttgtacatcttcatgttgaattttgtagtcccaaaattcagaatgagtattagcttagaaaattatggatagaattttaccccaaaatcaaaatgagtactcattttaccccaacatgagtactagattgaatcattcctgcactttaagaaattcaacagtaattataccccaaaaaaaaagcatttgtggcatatactagcaccataaaaggagaacattaattaaggatggagaagtggatagcaggatgtcatcgaacagatgtaaactgtggaaaagaagttctcataacaaatactcatttctcaatatcaaaaccacactgtccaaacagcacagatcaggtaactaaagatgcaaaccgtggggtttaccgtggctgcctcactgataaccgttttgggatgccatgaccgacacactaacaaccgctggagaggtataggccatttcacccagcgccaataggatacacaatacaatggatgccttgctgacctccgaggaagacgttgtagccatctcgccaaccttgtctcgcgaacaaaaacacggcgcatatccttggccacgggctccgtcgtgacccggcggaacggacgccgacatcatcgcggatgctgctgccgcttcgccgcctcctcccccatcgacgacttctctctctcgctgacaacttgtcgggttgctctctctttcatcccgtgcgtggaggagagaccggcgaggtgggcgcgtgtgtggctgaagagaggacacgacgacgcaacggggtcgcatctccctgatttgggctggccttgtgcacgaatcttgaacaaaaaatcaatggccacaaattcagctgacaaagacaaataaatcagcaggcagccagttatcaattcccttctgggagtactaaaaaaattagtgacaaataaaaaaatatatacggtgaatggccaagatgcctttcttcctcctccatcgattcctcccttggcaaatgaatggcacaccactcttcacgcacctctgctcccctctgttggtttccatcagaaagaaggaaacaagtttctctgcgtctccgatctgcagtgcgagccacgaaggttggcgtcgtctcctcctccctctcctcctcgcgcgcggctgccgtcgagaagacgctcggcctcccttgtgcggcctcacctcctcgcgctgaatcccctactccccgtgttaggtccgctcctgcttgcctgatgctgcccgttgctggttcttgatccgtcatgtttgttacatgttccagttttatggatgggtttttttggttggctgattcgttgttggtgccttcaattaatcagtactactacattgtcatgccctggtagtgatgcgaaatggcattttttttctgttttcaattttgcgtaataacatgattgatgctagctagaacattttatctaggggtgaaaacggagcggatattacccgatccactctgtatccgtccgaaataaagatatgataagggtttttagatatccggcggatgcggattttaacatgtggatgcggagccgtatgtgatatcaacaatatccgacagatgtggattatccaatattttaatcggattatttggcggataatccgcatttctcatgccatagcccattttatatgggcagcccatgtagcccatctaccgttaacctaatccaatccccaacatgcctgacggcgcgtcgtcttcctaggtgcgccaccacttctcctcctagcgcgccgctgcagcctgctgcttctagcgccgccgccgcatccaaccaaaagcagcctttctactatttctagcaccgcctctgcccttgccgacgccgtcgcctgccgtcccccattccccgcgtcagcgcctcctccagtggagtccccgtccaccgttggcccgtcgcggagtcgccagcgcccagcgcctccaccgtcaggtactattgttttcttgtgatgatgaataatgactgaatgagaagtgaagtctggatccttgcatgttggcgtgtgcagtgtgttgtatggaactagttcatattagttcgtatttgcaacttactaaattgcaagagtaatggtagtactgtatggaacggaactttgttaatgtactgaagacttatatttttaagcaacgccgcaatgaactgaagacttgtattatgtatttgctggatgtattttggattattcaagctcttaagcacttgacaatctgctgtatgtgttatattatcaattatgcaagctgcactttactagttaagcaaaattatattattgatgtgttttgcctggtttttcctagagagctgagatcataaatcatgttcagatgttttgtcatcgtattgctgccctcttgttgtatggattgaatacaaacttaatatccgacaattttattccattttcgaaccgagtccgcaccaactccgtaccgaatccgacgtccgaaataatctgcatccgcacgtcatccgcacccgcttcgcatccactttaaaaatatggattaggatatggtatagaaactatccgtccgaatccgctccgtttccacccctaattttatatgttcttgtctttttaagcattggcacttgcctcattgcctgcattggtcaagcttacaccacttatgtaactgttaattgatgctcgctgctaaattggttgtgaattttgctttataatccatatcaactgttacgaattttcctaaactatccatgtctgaattagatgtaattcaggagtccgtacatgccaaaagtaccttttgtttttcgcccttatgttgcaagaatctgctgatgcaaatcttgatacagatttgaccttcataatccaaaagaagaggttttagttcaagcgaacgataatggggatatccaaggtgattggcatcgctggaacaactcttctagtcacgtctgttggtctgtggaagatcggcttaagaattgtcgcggttccttttctagcaaccagtactattgcctatatcatcgctgttgcatcccacaattccatcaacataccttggatcttgggaaagaattcaaaggggaggtttccaatttggtcaagtgtactttttggtcctttcttgatacttgcccgggtatatgcaactgtgaagagacatatgaggaagaaggaggctgtgtataacatgatcactgaaggtgtttatctgggaggatggccgtttatgttgaagcatttgcccccaggagacccgtctgttattgattgcacttgcgagttgccaagaagtgattttgtcccaacaaatgagtatctttgtgttcctacttgggatacaagagccccgacgatatcccaaattgaatttgcggcatgctgggcatgtgaaaagagagccaaaggaaaaccagtttatgtacattgtgcatttggttagtaacgacctatctctcttcatatattccaccttttttaaacgttgacacaaggactgtagttctataatctagttttgtacataattgcagctgctaattacttttgaatattgtgtgtgcacgcttatgttttgtgcatgactgcatcaggtcatggaagaagcgcttgtgtcgtgtgtgcagttctagtagcattgggcattgctgaaaactggaaggatgcagaaaacatcatccgagaaaaaagaaagataaaaatgaatgctgttcaccggaaaaccttagacgattggtcaaaatatagagcttctcagaagaaggataaataactgtgagtcgattgttctcagatgtacttctgtcatgttgaaagaatgctcaaaacacattaagagttgtattgtttaacatcttaacattcttaattagtaaaattgctgttttgacaatcaaacgcttatggcaatcgtttgttgaacatgaaatccaaccatcattaacttctttgatatgcttgctagtcatatgccttaaagccttttatgctaccaacttctgtaaaggtgtggtcttagacaactgctattagaaatttagaattttagcatgcttttaaaggttgctacttcatccccctctcctactagttcaactgttgcaacatactgattgcagcagaataaccaaaagtacttcagacccaacaacaatgtgtgcaatgtcagactttagatgagttgctagatctggaaaagacttcatttctaggtagtttggacctctctttttctgggcgtcagattcacttctattctattagatagcttttaaattcaatccaagatgttctggcactggaagtgtagattctgttccaacttttagctactcattaactttagaactgtaaaatcaacccttttatcaatcgaaggcactcttttcgaaatgaagggcttcacgggaaacataatttgccactaaatcacataaataagtagtatttcagcaacaaaatctagctaacccctttttgttgtcactgggcaggacattaaatcatttgacatctcaggcaaattaccatgtgagttctatgcaatctgggttctgagaaatcttcctagttctggagcttgcattgtttcccagctcatatcagtgtttcccacacgtgtcagattacttccaaaatttgttcccagttttgcttacttctgctcctatctgaaggttagtcttcaaagtccttgtaaatcagaaagctgaaaattggctttcagatggttgtgctgctatgcttagctctccacagttgccttcatctgccaccaatatcctacaggcaaataaggctccagctataaatatatgatggatgcgtccagataaatagcactacagctgctgtcctattattcttttagacttttatagaatttagttagttggctgaaagcctgaaatagttgaaacatgcatagaaagggacaaaatccatatctagcccttattttgtacaccttcacatcattgtattttatcataatcttttttaggataagggactaccactagtttattggtgtaatgaccttcaaaattatgataaaataaagtgcatgcagtatgcatgatgtgcaaaaaaaagtttgctagcttttgactacctccagtaggaggctggtccattccatgctgatttaatagggtgcattccttatatttttttgtctagtaaataatggttcagttatatgtacttcgaactttccaatcagagattaaaccttcaacaactacaggtaggaggcttatcataaaataaagaaaggaaaagaattaattgcaggtaggactagagcatggtgcttactctcggggacgagaagcccagagggagctgagggcacggaggcgattatggtactcgccaattgccaagaaacatcgagctgcctgcctaattgtcagaattctgtgcatctgatgaagagtctgttgcctcaagttatcagcctggaaatccaatttgacagttgcagttttagtacatgatgaaaggatctcactcttggcactagaaaattgaaaactagagcagatactggtagtaagtttgttttactatgccatactatagttaatcagataagctccaaagtccaaaataaggataatgtcacatgtttaggtgaccattcttttctttgtatgatgtagagataacatctctacatgttgatgccatagcatattactgtaggaaaatttgttccttttcactctttattaattaacatgttggcatgtcgcattattaaaaggataaaaatgactgtttttttgctcgactgtcaagtgattggattgctcatctagacatccacaaag

SEQ ID NO: 26050 - DNA, 6380 bp, Oryza sativa
agtttgtaatgaaattagaaaaaccatacttgtacttagaagatgaggtcagatttagcatggttaaaacttgatttggcaaattgttttgcacattgtgaactgtgaagtgagcttcatgtttgatgtcagattgtcaggtgcattttcttatgaaaactagcctagctttaacttatcatgttcagatgtgaggttatgactacataccatgagcatgtttaagcatgatatagtaaaagttttgctttatcatgaactgtgaagtatgctccatgtctgatgttactccagattttcaggtgcattttgtgacgaaaaaacttagctctttttatgatgaaagctttcttttattgtattgtttagaccacttattttaagctattcgttcaatttatttatcaaaatatttaatttatcctataattaaggagataatctgcagcagtaatcggctaaataatctgtttcaataattaaatagcttcgtgtccagaaaggggtttagaaatgaggaggatcatgtctaacttacttaaacttctaattactgacatgtgagcccgttgagtagaagatccacatgtcagtgactcatgtcagacaaaagtaagttagaggataggatctcgagtatgtatataccttgagcagatcggacggttggaaaccgcccatccagaggaagcagcgctcggcgggggtggcccacgtgccagtgatgaggtggaacacgtcggccttggcggcggctgccctcaggcggaagagctcgtcgtagtgggccagggcgtcgtcgacgatcgccctcaggtcgccgtccggcaggtgcgcgtgtagcccgccgtgcagctccgccatccgccgcccgccgtcctccagccaccgcccgtactcggcgtcgaacatcgccgctcctgccacgaccaaatggacagtaaagtaaaacatatatactgaattattactgatctgatgcaaatcctatatgacaatcaaactgaatttcacatttcagatcagtagataaaagctactaaacatgagagattgatcaagtgaaggcaatgcattacctgcgctggtgtttccacctggtgatcctcccagcaagaggccctgaaccaagaaattcagattttactgcattcatgatcctacctataatgtttagtaattagttcagaatgcagaaaaaaattactacctgggaacgagctctctcgagatcctgctccatctgagccagcctcaacttgctgctctcaagctgctggatgtaagcctgcaaattggtatttttgacagattatgctgtcagaaacttattgggaagaagaaattcagttctgaacaactcattttctttctatgcaggtactgaaattctcatggatctagctaggctcaccttctttcgcagccggctcttgcgtgctgcctctcggttctgggctaaccttctcattatctgattacaccaacactagagagtaagtaattgtctcaaactcatgtttcaaacagtctttaattagcttgcactgaatggttctgtacatacatataattgcatgagcacgcataatcatcatcatcatgctatctaattaagcatcaactgggagtatgagagagctaggagagtaggattaacctttggatcaagtgtctttgtcatcctgtggtcactgtgagtggaacttgctgccatcttctgcatgccatgtggacatgaacaagttattgttaattacaagatgcactttaattactacagttttgtgcagttagaaactatacaagataaatagaaaaatagtgatgatatacatgcttatgtgcctatggtgcaaataaaatatactagtatgatctttggatgcacgttacatcaaccagatataaaaaaacagcaatgtatatgggtggaagccacccactctaacaacagacaaaaatattgttctgcttttttgtttatgttgctgtcacgccctaatatgcaaagttctctttcagttaagcgtgagttagatataaacattgggtaataattgttcatccaatgtgatcttggcagttcatcaattggccagaaggaacctaaagcacccctgatggccaaattgccattgttcaggtatcagttggtgcaatttttttgggaccatactttgtgcaagctagagacaattaacatactataagaatgcatacttgtcgcctaatacagcacataagctagcatgcacaagtctaacatatcctttcctagacttatctgctcctcttcttttttccaaagaatgaaaaagatagaaatttgtagtggcaagtaaggctaaatgtcaaagaaaatgcatgggtaattactaaagtgatcatattctgcatctgattcttcagaaaaacgctggtcccttggatgaagcatcaggggaacaagttggaactttctaatgtagagccaaataatacacctaacttgttgggattggtgatcttgggagcagcaagatcttaaatgaccctgaactcttctagtactactccatgagcatcttgagttgtgggctagctactgacatgacaccagactagggaacaacgcattgcatctgcaccactgcatggctttattttcttctcgcgatgtaggtatatgcatgatcaggaatcaggagatccatgcagaagcaaagacaagatgaacacctccaagaacaagcgtttacaacaccaaaacgcatcaagaaactcaagaccaagaattacaccaaaacgcacatcaagaaactccagtgattgatgagaatgcaaaccttgtgctgcttctgctgctgctgtgggatctgatcaaactggctcgccatgtcggctgctgctgcaccctgatcgccgttgttcttgctgctgctctcggagtccgttgtgtctgccgttacatttgaacatccatcctacagaacacagctgtaactttgcctttgctttgcaaaaatgaaaaatgcagtagggatcatgctcaagtatttaccttcggtgttggaagagagctcctcctcataggccaggatgggaagatgtccagtgtagcaggaggcctagctgttgctgttgctgtagctgcagcagcagcagtggagaaggctgcaagaagatatcataggggaggaggagatcaagaaatgcatccaatcctgcaactgcaacatcagaaagctactaccagctgaagcactgcactgggatcacaaggggcaagtggggcccatgtggcagtgaaaggtggactggaatttattccctttgaggagctaggagtactgcacagactgtgtgctttgctttgctgccatggcagggagctagccagagctggtactatagtactttggagaattgttgcactctagagagagagagagagagagatggtgatgatgatgaggagagtcacaaggcagtcacaccactacacacaaggtgacaagaagcacaactgccactcctgctatctgtagctcttgctttgcattgcatgtggtttggctagctacaaagtttttgctgttctttttttttttccaaatggatttgcatggttgcttttgactacactgccctaacctcttgggaaagttggctcactaggttgtgtgcttttgttcttggtcagagaaagagagagagagatgatgttgtgagtacgtacgagtggtgtgtccatggtgagaggtggtggtggttgcagtttgttgagccctcctcctgagtgtggcaacctgatgaacaagagcttcttctagctctccaaaataggcagcgccacctcctcctcctcctccttgctcgctgtcagtgtcaggccaatgcaaattaagaagggaaattaaaacatgtaacatgagatcaacaacttgttgggaataaatttgttgaccagaatgatctgaagaaatattcatgaagaacagtaatgagaaagcaatatgaaaagaacaagctgagaagagtgctgattcagcaaccgatgcatatagcactcttcccctgaacgtgaaagagaagctcatggttcagaacttcagatcatgtttatgttgcacagtttgcacttcgcaatcaccagagagagagagagagagagagagagagagagagagatattgggagagaaggagacagaaagatgaaaacgagatgttgggagagaaggagagagaggatgatgatgaactgatcttacaagaggtttgcagaagccatggagttgggcaaggtggtgccatggaagccatagccaagaacatgatgaggattctgccctctcctagcctctcccatcctacgagccacaaaaccacagctcgatctcccagtatctccaagaatcagaacgaagcgctagctcaaatttcttcgatctacctccacaaagaacaacaaaaaagaacatcatgatcgctgctactgtacatgctagtatgctacacgccagatgatgtgaagaattcaagatgagagagtcaaagaaagaaacataccaagattgtggtctcttgtgataagcaagagccaagagctactatagcagaaaagtgaccggagtagctttagctagcaagaagtgcaagaagcaaagcttgaccggttcttggctctcagctggagtagctagctgttcttggctcttgctattgctgctcactcctatagctttagctctctcttgaatcttgatatggagtatctgaaagtgtagcagcttcaccttccggtctggggcatgctaatcacacagttgatggaaagatcttgtccttcctttctcctatgctggtttttttcttctttgaagagaggaaaggagagagaggtataggtcttgtctctacttgaaggtgttttgtcatggagtctgccacaggaatccctggctctacactcttatcatcttggaactgacttctctttctctctgtgtgactggtcccagatgcactgcagatgcaagtctaatttcttctggttcatgcatgtgtaaaccttattttgccccagataatgaatgggatgttgaatttgggttcaagttgtattgatcagtaccactattttttttcaattgttaatggctgttgacaaaacttgcaagttactatgcactggtgtaggaagtacatgatcctgtttgcaaagaaaaaatgattgagattaaccatgttgctactggattgttcaatattacaagctatgtatgttattcagacttcaacggtgcatgcatttcatctgattattccatactctcttcgattcaagattgactaatttacaccgacatatagtttattatatgcaaaaccatagctttcggatagcatttagaaatgttaaccattctgaccacacaataatcctacgttgataaacgcttctctcaccagtctcatgatttgtatgtacgatcttatctagttatagctctctagcaacttgattgcaactttgaataatctatttctcatttcaaatcgaagataaaataattgaactatcgaatcattaacatcaatagtaccgtacaagataaaactgaaaagaggaatagaaaaccaaacctttaaagaaatctttaggttctaaaaaaaataagtatagaactctctatattctccattattaatatatatcctgcatttaatttgcttggcaatattctcctctgttaatgcgtcaacatccgtgccttgtcaaaatatcacctagctaaacccatacctgaccaatcatatccatttcacaatacgaagatcggctaacttaatcaatttggaagttgattgtcacgtctaatatatcaatgacgctagtttaattgatttcctaatacgctcacctatatatatactttttaagtttttgttacgatatgtataattaagagcaactccaatagaatggccaagtaactacccaagctaaattttagcaaatatagggggaaaataccattcaacagtctctccatccggatggccaaatcgcacccctcattgaccaaacttggagagtctctctgcctggctattcgtgggctccacactcccctcccaccccatctctctctctgccctggctagagcaagaaggcggcaacgatgccgcttgtgaacggcgatggctaggaaccgcacaacggcgacggcacggaggagagatgcgccggagccagctgcgaccgccgccgtcgtccgcgtcgtcccatgcagcgactgtcgccgtcgtccacgccgtccctagtcgcgaccgccaccgccgtccgcgccatccctagccgcgaccgccgcccccgcgtggatttgaccggg

SEQ ID NO: 26051 - DNA, 15677 bp, Oryza sativa
  unsure (1)..(15677): unsure at all n locations
nnnnnnnnnnnnnnnnnnnnnnnnnnnnnnnnnnnnncgtcgtcgtcacgagccgccgccgctgccaccctttgctcaatcgccgttgcctcggggagtgctaagagaagaggaagagggagaaaaagaggaataaggggagaaagatgagaaagaatgggtatagagaggatggatggagaggctgttggagtaaagaacgaatttgacttgacaaataaaatggagagttgaccaaatagacatttagagagtcgaatttagagaaactattggagatgctctaagctagctttattaatagtacgtttcaataatgattacctctttaattggaccgaggctcctgtgattgatgtaccagctgtgactaccacagctgcatgcttatgcgtgtaagtgatgcactccctccgttccataatataaaggattttggtgggatgagacatatcctattactaatttgggcagagatacaacgaatatgattatagagtgtatttattgcactaggatgtgatgtattctagtaagcgaggttagtttttttgatggaggaattagctatcatgctgcctatgaattttaaattttgattttgagaataattttaggcaacgacagcggcagaggaaaacctaaaacttaaaatcaaatcctataatcgacgcagtgctaagtactccgtacacccttattcaaggttgactgcctactgttatttgactatttgttattaattgttactacaaattttgggtgaaaatatacaagaaagtagatatattttgttttcttgacaatgcatatgtatatattcaaattatacatcaccaactttatcacaatttattatcattactattgcatatttactacaattcacacatatatctagatctatcgtaatactctaccaattattttcatcatatcaaatttcatctaaaattacttctatatattttcgtagcaacacgcgtggtatcttcttgtatttttaatggtgagtaggagctagttgggatgagtgcaatgtccctttcattttgcacttggaggaaaaaatcaattaagtaaattaactacttcatgctccgcctagccgccaatcaaacagatttatttctcctcttcacccactatatttttcctaacaatgattggcacaataaaatgcgccaaaaacacatgacaagatcgagaacctactaatagctaggagtaagataactgaataattcattcttatttttcttttttgatctgctaattgacacacatcttatagctagtcatcaagtggcaacttcgggggcatgcctaataagacaaaaatagaaatagtagttgaactcctatataaactttggtttttatttatgagaaaattgattttggtggttagtgtctagctagcttctatggattgtataattagctgtggtcttatattagactagtggtttaattaattatggcacatgcatttggggctgaaaatttattgaacaggtagagtgcacgcatcatgcatgcatgcgcgtgacaaaatgattatgtcattcattctgctagctaagctagctggaaacctcaaacacatactcggtcagtcccaaatctcaatatacttattgttgtaggttatttaaatatagattaagatttgtttgaaaaagactataccgtttattattaaatgatgtatatatggtcgaaagtgagagggttgttaggggtagaatggcaggaggtgattgatttagtaaattatattttagagtaacaactattttaagataaattttaaatcttgaaagtgcatctaggcaactaattatgttggtgattaataacaatgtgattagagatgactaacaacttatttgagtatgagtgaatgaatgttagcatcggtgaaaaacgatgttaaaggcaaaacctctaggcctcaatgaccttgcaaatctcgaaatacaactattatgtcgcggagatagtattctactaatataagattatatatatgaaatttttttcaagaaatacattgacaaacattcaatttcaagaaatatcatcgataagtacgacttttataaaatgccactgtacaagcgactttgtctcggaaataccatcatcgttagggtttcgttagtagtcctccgttaagtattataggataaacggtgcatttaacaatggggatggacggaaccttaacagcaatgatatttatagaacaaaatcgcttgcactcgtcgatgatggctttgattgtttgttaatggtatttctggatgttctctatatgtatgggctcattgataacggcactatatgagtgacaatgagaaacagcgtgagcgaatctgtatgagatgacgtacgcgatattcatatacaggcattgatacaaacttctacacagtagctagtgttgctgaatatagcttggtcgtgtactccctccgtcccaaattaagtacaataaattttggttagatggaacataactataaatctaaacatattttttcagactcatattactagaatgtgtccaatcaaaatcttatatattttagtacgaagggagtagaccgtatgttgcgtccactgtatgttacatgtcgcccactgaattaaatatgaaactctgaaatattcaaagacgtcatcgggaagtgtgttgtaagtcagaaattattttgagctggggaatattagtttaatttcatttgcctctgatataatttgtaaggtgttttcaattttgttcaacgttatacttctctactttcatattagtgggccgggtgctttagcttaaactgtcacggagatataaaagcctatcttaatttttttttgacgagaaaaaacagcaagagaggctactactgtgattttaataagagaaagggaataattacagagagtatgtacatgagggggaaggaaagaacaacaaaactaaactaatcaagctaaacaagaaactgaatccatgattcccacgaaggtttatcatcctgttttactctatgcaaatgtagagtaaagtcctccttgaaatctgatttccacttgctgaaattgattgaaagattgttgaagataaagtcatttctcctgctctagatattccagcaacaaatagcaatgacctccatgaagaaaggataaggaaagttgttctttgcttctgagatcgtgttcataacatccagatgaaaatttcagttaatgcctaaactagaccagcattgctgagcaaaagggcaggagaaaaaaagatggtgggagtcctctatgaccactgatttcaggtaacacatttgatgcctccttgggtgttgaaatgttttctttgcaagagttccttggtgttcaatctgtccattagaagcaaccaaaggaagactttcagtttcagagtgcatttgcatttccaaatccaaataagaggagccggtgggtgaatgtgagcaaagaacaaatcatagacttttttggaatgatattgatgagaattccactgataagtccagcagtccaagtcattaaagttatccagattttgaaccagatcgtttaagatttgccattgttgaattgcttgtaccaacatgggtgtatgaaaagactgctcaatactattcagatcgaggaaacctttaagtgagatatcttccaattttgcgaatgagaataggatgcttaactcctcttgcaaaatgcttctagtccaattatctttccaaaacaaagctgtttcaccagaaccaacagttacctttgagattgctctgaaaattgggattaatctgaaaatgtccttccaccaaaaagaacccttttctgtgtgtgcatgagggggtaaatttgaatgagagtagtatttgttccaaatgagatttacccaagggagatctttcttattgaaaaatttgtccagatgttttgtgagtagggcaacattttgaagaggaggggaaatgagaaaactaaaaatatatgtaaaacaagataagttattagtgcatgattaattaaatattaattattttaaatttaaaaataattaatatattttttaaataaattttgttttttttaaaatatacacgatttaaccgtttaggaagtgtacacctgaaaaacatcatatatccctattgacactcccacctctcactcgtgacgactctatccaatccttctccgtctcgtcatggccacggtagcgccactcacatcagagccccaagatctcgaccctcatatatgggcccttatatatttaacctattagctagaaacaaaagtttaattaattaaatcccttaaaatatatgttggatctaatatgtatcccttaacagcaaagctatgtataatgactccatcaatcatcaataccggtttagtttgcgggccttctcaaatggtttggatgacagttttgctctgcgtggcgcacgttgatctaatctctatcctacgtctatattatattataaaataaaatagtaggacccatgtctcatcctcgcctcgttctctagctccttacacactttgagaaagcagggtatactggaagcagagagggcaggagggcgacagtagcagcaagccgaatcctggaagagcggcggcggctcctcccctcttctctcctaccgttcggttggggcacgggtgcgctcttctctcccttcctcctctctctctctctctctcttttttctttgagagcacttcagaattttctcaattcgctcctttgttatgtaacgaattttctcaagttcccttggatcagttacaaggacttgaacacccaattgcacttttgtcttctgaaggttgaaaccaagacatgcaattcctcctccctctcttggcttgattgtatacgtgcgttgagctttgctgtgactttgtgatgtcaagtttccaaacgctcattgtaccattgcaattattcaaatgaagaccggttgaagatagggatgaaaatggttggaaaatccctataccattttctttttcatatatatatttctcgtaaacgaaatcagaatggtagatctggaaatggtaacgatatcggtaatattggtatatcagaaacaggactgtcggaacgaaatataccgatattggttggaagtcgaaattcatgtcagaatcagcagagtgtggcatagcacacatttaactatacatgtaaatgacattttaactttattcttttatcatcacacaccacataacaccgttatatgatgattaataatatgataataagtttgatgaacagtataaacaaagtttaacaatacttaacatcgataagttgagaagactaaagttcagcaaaatccacatgccacatcatagggttaattaacaacatttttctctggtcactttcccttttttatgggccgcaagcctactagacttccttcattcatggacttctgatgggttaggcaggctaagccgctagagaacttccagaattttttcggaattttgacgaaaattatcatacaaatacggttaccgacaaaacggtcggaaaaacctccatctcatttccgctaccatttccagaagatattaccgtttccatttccaccactgttggttaccgataccgactgaaaacggtcggtgtaaactagaaacggcagccggaaatttccataccgttttcagggttggatgaagatcgatgatgacggtgctacccgagctcaagcttgtagggggctcgccagcatccctgttgttaccttctttcgcaggcgagtgtccaagcacgatctcgcgcgggacagccgttttaacggttttgcaattgagagttacgaatgagatttgacctgtatttgagataattaaatcggacattttcttatctggcctaattagctgaccctttgtttggaccagagtcattcttaaaagtacacaccttggcctttctctttcgcaaacattcttgaacagttgcgtacgagttgggcttttctttatatagcttaacgtttccggcccatgtatttccttctctcctcctaatcgtttcggacgatgcaagaggtggccacgatggtgtgctcagctgccgtacgtcgtcgtgccaagacgagtcgccggcggcgagctgggcctgctgctgaagctgacgccaaattaattaagctcccaaacggccgcgccggaggactatactcacaccgttaataaatatttgacgccgcttattttttaaaatatatttgatcgttccttttatttgatttattgttaaatataattatatgtatacatatagttttacatatttcacaaaagtttttaaataagatgaacggttaaacatgtgctaaaaaggttaaatatttagaaataaagggagtatatttttcaaaaaaaaaaaaagcttcgtggccggagctctgccggccggatttaaaagagggaaagccggaggattatatatggatcgcattcaggtctataccttcctgctttcttcctccgcgtggcgtcgatttccgccgtgcagatacgaggacgccggcgccgagtacgagttaaggcctgaagcggatggacgagaaagcctataggcctttgcagcccatatatacattcctgcagtaaaaaacaaatctatctctgtaaacatcttgttttgtcgtcagagttgcaacgaacagaattgacaacgggacacacgtacagaaaacgaagcaacactgagtgtgccaattctttaaatattatagcatgactacaagaatccaggatttttcttttgacagacacaaaccactaaggatagcatcaaaaccgttaaggtaacatgttttgccggccaaccgccaagtttatagaccaaggaaaattccattttattggcggctaactgttatggaaagagttttttttttgtctccccaacaagaaaattacgatcatttccaactttcgaaagcgccaagaaataaaaacttgtcagttcggattgacaataatatactttactttagatgttatcgaaccgccaaggaaattatcaagaaaataccttattcatggccgctacaaccaccaaaggaagtatcaaggaaataccttattcatgaccgctacagccgccaaggatataacttggcggttctacgtaaccctcaataaaatagttgtatccttatcaactagttatgatcatcaagataacgaataatattggcggctttgttttggctgccaaaaaatcttggattgttgtatgcgcaggagaaaatcgatcagaacatatataagagggaaactttatatggtgaaatagctaagctataagctcaagaagagatgttttcctccgccaaagtctaaggttttggcctcttccttgatctttgctattagcttgattatcgagagtttcttatgttggaacattcattgatttctctcctatattttccatgtcgtaagtaggatgagagtgcacacccccctttttctgataggcttcgacctgtgagcagtgccacccaccattcatatactatcgaggttgtgctccatatttatgggctgagttgctcctgggatgtccaggtggaaatcatgtccatattctcctcatatatctgcactctggacacaagtaggtggaaggatgcttctaaggtgggtcggcaaagcgagtagtacaagtaggtggaaggatgcttctaaggtgggtcggcaacgcgagtagtaggtattgtttggccaacttctcgaactgttaatctctgtcagacgtccgtactaatgttatgtataattagggcatgtttggtagagctccaactcccaggagagctggagtccagtcaaacagtttcaactccatccaatgggagtgaagctggctggagtgctctcacaaaatgattaactagagaggtggagctgggtttggttgctccataatttcactccagatccagttcttgatgttaaatctaagagttggaacctaccaatcaggcccttagccaagcgaagatcatgtatttctttggagtctaaagcttccaaatgaaatatgatagttctgttaatggagccgaagaactgtgctcagcttctcatgaaattgagtcaaacagtagatacaatgaagagtttttagtcataatctctcatgcatgaacgaaggcatgataaaactatcatcttgcttgatttccaggaccatctttaccccttcttacatgcatatgtttaatcaagaagaaaagacaaagagaatccttgcctcaaaattccttatcaatctagctattatatacccctctatctctctctaatatacatatataagctaggactgctcttgttgtccatgaatacatacataaacttattcaagagatccaaaatggtaaattcatgcatgcatcattctttgttctgcatgcagctagaaaacgctgccttcaggtatgctctgcagggtaggctgccacactgatccgcagctctcctgctggtgcagcagctcatctgcttcagcttgtttttgcatgagagacaccatgtcgttcagggagatggcggcggcgtcgttgtgcagcagcatcttcttcagctcctgctttctgaccaccagcttcaccctcacgacggcgccgccgggtgggtcgtcagccatgtcggccgtcgccggccggagtgcctcgtcgtcgtcgtcggaggagacgccgttgaggggtggcggcggcggcggcagcttcaggatctcgccgtcgacgtccatgctcatgatcttgatctccctgttcctatcttgaatcaccatgcaattccccatgatgatacgacgacgaagacgagttttgcaaggagatttgggatgatgaaattacgaggtagctagcacgaccgaatgatcgatcgatcacaattcacaagttagaaatgtgtgtgtggtgtagtatttcttggcgaaagagtagggggttggaggggaggagttatgtgtggtatttaaaggaattgtattaggaggatagccacaaactttggagcatacttcatctctgtgccattggactagccaagtgagctttgcttacttcatgtcatgcctcaccaaaagcaagatatagccactgagaaagtgagaattagtgaaatcgaccagccatttcttttttttttgtctctatcttgttgtcgtccttgactgttgcatgctgatttgcatcaggggcggtccgtgaaattcgaggccggttgcgcacgtcaaacatctcggaataacttgatgtgcattttcagctagattttactattattgtcttttcagtcttattctagtctactataaccttaattttaagtactatgatgttgttgaattttctatatatgtttaacaatttgtcttactaaaaaatattaaaaaaatataaaagtcatgcttgaagtgtctataataataaaactagccacagtaaaacaaataatatttacatatttgtttgataagagaatgatcaaatatatgtccaaaagacaacgacgttatatgttaaaaatagagggagtatatatttttttataataaacaagataaaaaaggtatagaagttattaaataaccgttgaattaatggagcaaatcgactgtaaactacaccgacacttatatttatgacaacaaatgcttcttcctagtgccaggcatgcatatatatgatctcattcttatccatgcatattacatatatgtaattagatggcaaaatcataattttgtgctgagtagagggttttttttgaagatatataattgaattagcaagcaacatacccaggtaaagggggagagatcacaaaacattagtagtaggatacatgtggagcccaacatttgggcaggcctaatccatatccttgtagtggaggtaagaatcatttgcacctcttgtcaaatctgcaagtgaaaatggatttgtgtactggtcatcatgtggtttaatttgcaagtgaaagtgaaactaatagagaccatgcatccaatgcgtgttactggtcatatatatagacaggccgaaaacgatcgatatgatggatcctcctctccatcaagcactaacaaccaatataaacatttgttgcacgatccgcatcatttcaattcagtaagaacgctatgtaccccggcatctatagttctatttatatatacacgtgatgtgttatatatgcgtgctatttgactacaagaatccagaattttctttgcggtcaaaaacaccaaggcaatatatttttacgactacctgccaaataataaccaccaaatttagagagccaaggaaatccagattaatttcttggttgctaatcgtgagggaaagttctattagcggtctaaccgccaagagaactacggagaatattaaacttttgaaaagccaagaaatgtaaccttaccagtctcgaccgacaagaacacatcttaccttaggtggtgtcgaaccgtcaagaatatatggtcattgagtgaagctggagacgatcgattaatgcatccaaggctatgtatccaactatatatccattatatatatggttattgtaatgggataaggcaagagcaattattgtgttttagaattcacaatgttcgcggttgagttttcttcttctccttttaattgtttgtagctaacacagaccacacattaattcaatactttagtgaattgcacattatatcgcatatgttaggaaacgataagcgaacaaacgataaagaacaatagatcaatcacagaagacacgagatttaacgtgaaaaaccctcccaaaataggagagaaaaaaccacgggcgccagccagcaaaatatcttcactatatctggggtgaggttacatcgccgcatggcggcttacaagagatatatatatatggtggaaccctaaaagggatgatgatccgtacgggagacgggcctccgctccactacggaagctggcctttattaagtgcagatgaatttcgatcacaactcaacagcatcgaccaaatattctccccgaagtttcctcttgcaccacaattaattaactaatggtttcgctttcaatcatttttcattcttttggtttgctttggaccctagctgttgttgttgttgctacttccctagctcgttgtcccctctctcctctgatggtgagttagctccaagatctaatcatcgatcaaggcatcctgcataaggtaatggggacctgaaccctgatccttgatgggtaaaacgtccattaagaacaaaatgagactcactcacggggttcctaatggcaaaatactcccccattagtccaatgcatcctcctttggaggatgccactaccacacgccacctcgttgctcccatcctctacttctactaacatggtgactgcgaaaagggtgcatagggatggatggtgtaggtcaactcacgcccatctctctagcggtgtgctctagcaatattgtagtggttcataggatatgaaagagtcaaagcaacggaaaatacatggggtgcaatgcaagaagatatatgaagaaaggaggcgtgtatgtagtattgtacagaagagagaaggccaccagaggggggggggcagtgccaatgactttccttcattcagaatatatcacatataggagaagagaatgaaaaggctcaaagttaaactaaagggaagaaaagtttgtccaaattggaagaaaaaattaggtcaagtaacctaagataaaacttggtatgcaagaataagtgatgacctatatacatacgtgtaattcacttttaaattttttcaacaaggctgccgatattccttaatagaatacagttttgtatgtgttgcataacagattcattggaccctaggcaaaaggttgaagcacaagaaaacaaaaacttgtccttgttgaatgtcgatatcaattaaagaacacgtcctttcacgcacattctaaaccccactatactttttatgatccttcttcctgtacttttctttgtttatacatttgcttttgtagtgctccccataaaaaacactttaatcaagataaaagctttgttagcattagaaaataaagtgaaatgtggacactaatatggtgatcgagtcaaaattatgtggaagactatttcaatccctttaacgagagtgggttgttaatcacgaagagctctaagtagctaattgaaacatgatatatagacaggaaaatactacgagactgtctgcatggtatagacgtagctagggttttgacttctagattatcctagaattgatatgcaactagaaataacaagctttagaaaaaggaaaaaaaaagagaaaccatcagctttcagaaaacaaaatattatataatagtaatcaatgaaacttaatggaaagacttccctttactcgctcactactatctccgtcttaaaatatagcaatctagtataaaatgagataaattctagtactttaaatctgaacaggcataaacattaatgtaaatgtgagtatacattcatcattgtaagacattcacacataattactctgctatatataaacatctctagctgagccgacacatacgtcttggtatatattcacaaaattattataaacacttctctcgctatcgattggcatgtcatctaatagaaaaaacttaactaaaatagctgtggtatagtaaactaatatatatatgtgcatgtatatagccttagtggctagtgatcgatggtgcagcattagagcaagtataataggaggttgtaagccgactaaatactgaggtggaggagagaagagagaagaaagaggagaagtgggctgtaaacttacagccggcttggacacataagaaccaagaaactctgtgagagagacaagtgatcatgtattaattgtaaagagctactctctccgttccataatataatgcacaactatttttttaggatgttcataaggcatgcatgcatgtatacaatttattaggacttcttctccattaaattattacttttttttaaatcctccaccctcaagatctcaaattctattggatgcatgcattatatttattagggtgattcaaactaggagatgataataattgtttcttggtctttgggttaatggtggttgtgccttatattttggaacggatggagtaactattatatgggtgagctgagagaaggctgcaaataatcttacagctaacaagttagctgtattattagtcttgctcttgaggtagcttagctcactataatatgtgcaataagcactactctgtccgtcccaaaatatagtaaccttgtatactggatgggacacatcatagtacagtaaatctggatagaggtatgtccagattcgttgtattaagatatgtcctatccagtataaggttgctgtattttaggacggagggagtatcttattagctcactcctttgacctatatctagctaagctagctagctatagctactcgcccgttgaacgctttttaaccacgcgtgcatatgcacacgcgctgagatcgcgcgttttgacgattttacacgcggctcgttttggcgacgcgcggcggacggcgagtggccggcaaggctagtggggcggcaccgccgcagagactaagccggcgacgtcgccgtcgacgagacgaccggccgctatagctattagctgccggaagacgactgccgtccgtacgtcgtcgtcgttggtggtggcgtagtacatacgtatatatgcgcatgctagcttgcttcgcttttacttctccggtcgccgcctcgccggccgacgtcgccacgcgtataagaattgagaagttcggataaactgatcatatagtagtatctactcatcagaatattataaggttaattaacaaaagtcgatgcaattataattatgagatattaaaaaagactcgactcattatgagtttctcaatggagagtagaaaaccccctcaagaatttgaactttaggaacagatcgtcttataaaagtccttgtgatctctctcactcatctagctttgttatttggtgtcactaatagtttaattgttgtttgtgtaatcctctccccaattgccgctattctttattcttagttagtttactcgtaatctgagattttcggaatatccgaaaacatttcaaaaatatccaaaaatattaggaaatatctgaaaagttctgtttctgtattttcttcaagaaagttttaaatgcctattcatcccctctagggaacatcaagatatatactatatatagatattattatatcatttttacaaacttatatggttaaacttgaaaataattgacttatattaaaatcaagacatcttgagttctaaaacaaaagaagtactccctccatttcaaaatagttactatttcaggattcaaaatttatcctaaactaatcattattttaaaatactatttttccttgtcaatcaccttccattttacctcaaccatcatctcacttctattcaaataagtgtcgctatagtcttttttttttcttctcaaaccttaatactccggaggcagttgtatgtaagaaaaacgtctcaatctgtgattaattagcagtttcaggggctgaaggggatgtgttggatagacgtggttacctagagatctctgtcgaatctcagaaataaagtgcatcagaaatttttgtgtagtcgctttttatgtcgttttgctcttaacgacactcgtgcacgcatgtagtcccatttttctgatctgtcgtcgtagagtactgttcaccatacgcacggaggaaaaatgaggctcgtcgcgtcgttctgtttggattcttttgagtagccttgatcgagatttttcagtatatgccatccaattcgcaccattttcaggatatgccacttaattcgcatgactttcagaatatgccattggaagcacgaattccttcattccatgccatttttctctattttcccaaatttctcagatttctaatactttccttcatctttctcacctgaccggacggatttacccatgggcccacctgtcaggagagtagagagatagcctcctcctcttagggaacagatcgatctatcgcaacaaaaaaaagggaaacatatcgatccccttcctccttcctcccggccgacagacgcaacgccgctacgagccgccgccccgaccgcgccccgcccccacacctcgctggcagctccgtcccccgctctgcaccgtgcaaccgcgcctcgccggcagcttcacccccgccccgcgccatgccaccacgcccagcaatggaaaccctaaatatctagggtttgaaggaggagatggagaggggggagacagcggctcgagaagagggcgtgccgcaggcgacggcctcattgctacataatgagctttcttcggggtaagatcatgctcccctgctatctattattgcagaatcgaggtgcaagctcaagagcgtgtaggtcagcaacgattaagcggg

SEQ ID NO: 26052 - DNA, 699 bp, Oryza sativa
agatagatgttaatgatgtggttcctggtgaagctggagttttctatgatagggatgatcctccaatggaagttggaagcttatatataagtatggttgagtttaggtcagctgtgaggcaacatgctataaaggggcaatttgagttagggacagagaagattgacacagagaggtttcggggctattgcacagctgagggatgcccatgggctattgtggcaaggttacagcctgatggaaaatctgtgagggtactaacaactaacttagcatggctatgttacatattcaatattttgtttcttagtgataattataaaataatacattttgatcatgcattgtgttcttttgtgttgtaggttactttgaacagatttccccatcattgtacatcaaccgcgagagttaaaaccaagatgtcatcctacaagtgggtagcagagaaggccattccctttctaaagaaggacccaaatatgggtgcaacaaagctacaagatgagttgcaaaccacacacaaagtcacagtgggatactcaacagtttatgcaggtatgcaaaagtctatagagcaaatattttggacgtgggaagagagctttgcatttttgtttaactttaaggctgaaattgagttgaaaatgccgggaaatgttgtggagatagatgtacaggaagatggtgatgggattt

SEQ ID NO: 26053 - DNA, 685 bp, Oryza sativa
cctcctcctctcctttcctaccaccgtctccctccactacctcctcaacctcctcctgcgcctgtccaccaagttcaatacccgagctcgcaaccctgcgccctccacctgttcgacgctatgccttgccgctttccgtgagatggcgcaccacggagttccccctttcatcaaggaatgcaacctcgtgctccgtgcgctgcgtgatgaagccaggtgggatgacatgcgctcggtgtatgcagagatgcttcagcttggaatcgagccgagcattgtcacatacaacacgttgttggattctttcttcagggagggtagggtggatcaggctgccaagttgctcagagagatggaggcccggcctggtggatgcttgccgagtgatgtcacatacaatgtggtgattaatgggttggccaggaaaggtgagctggagaaggcagctcagctggttgacagaatgcggatgtccaagaaggcgtcagctttcacgtttaatccacttattactgggtattttgcaaggggttctgttgaaaaggctggagcattgcagttggagatggagaatgagggcattgtacccacggtggtgacatataacacaattattcatggaatgtttagaagtggtaatgtggaggcagctcggatgaagtttgtggaaatgagagcaatggga

SEQ ID NO: 26054 - DNA, 679 bp, Oryza sativa
caccccttgaaagccacaatttcggtcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctaactttctgtttaataaataagaggttaattagcacgttttgaatagcaatgtagatattgaaatgagcttattcgccattagcaacaaccttagggtcgaaatctttcacctctcttagaagtgttgacatgttgtggcacacgtggaaaccacattggtctccgatctgttgtgcgcatgcaaacttggtgtcatgataaaattcattcttgccctccttgtgcctaccacccttttccacatatgggccccaag

SEQ ID NO: 26055 - DNA, 1720 bp, Oryza sativa
gtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgcttgattccctaaactgttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccctccgcttgagcctatcctttgcttcggctggaaatgtgaaccatttctccattgtcgtccaagctcgctctttctcggcttctgtgaccttgccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttcttatgcataaaaaaagaacaagtgtagaggtatataaccactgaatcaatcatgcaaatttaaaa

SEQ ID NO: 26056 - DNA, 2305 bp, Oryza sativa
aagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggtatataaatgaacaagtgtaggggcaaaaaaatgaacaagtgtagataatctgttcttattgagcaattcatcactggccatttaataaggaacacattgggcagcagcagcaagggtatataaatcatcaaagaatgacagaaaacaagtgtatatagtctcctcttatcaatccagaaaaaagagcaagtgcagaaaatctgttcttatgcataaaaaaagaacaagtgtagataatttgttcttattgagcaattcatcactggccatttaacaaggaacacattgggcagcagcaacaggggcaaagatactccacaggggcagcaacaataggggtgtattaacataaaacatcactggccatttatctagttaaaatcatgcaaaattcaaccaatgcagcaaaattaatcctaaaatcatctaatacaaaaagactaattcatctaatactgcatatatttcatccacaaatagtccaaattcatcacctcatatagcccatatctcaaatatgcatatatttcatcaaaaaaaatgagacagtactactaacttcatgtaaacagcaattcatccattcaattcaatcaagtgtagataataaaacagcccacaatcatttatgtggcagcagcagcaagggtatataaatcatgtatataaacaacaattcatgcaattcacctattcatagacaaaaagggtatataaatccacaagtttagataatctgcaaagttccttaatcatcaaagaatgacagaaaacaaaatgcatggagaattttggtgtctaggtcggttccgtccatggactacactgaccaatccaccaaaattccccatgcattttgtattctgtgatggtttgataacctcggaacaacattaaatctgcggccaatcaatcaattcttccatttgaactaaatttcaaaccctaaacctaataaagttccttaattatcaaagaatgacagaaaacaaaatgcatgaaaaattttggtgactaggtcggttccgtccatggactacactaaccaatccaccaaaactccccatgcattttgtattttccatttgaactaaatttcaaaccctgtatatgctttatttataggaaaagggaacataacccctaactagctagctagataaactatttctagctagctaccctaccaagctagaaacactgttgccaatctatcaatccatcctttttcagctaaatgtaaacattatccccaaaattcaatagttctagcaaaagggaacaaaacaacatataaagcagtacacactccatgaatggttacatgtcaaaatggcacttaaatccacattcaagttttaaataacagttgcaacaatctgaacggaatgacaaaattcatcgttcatccaaagttcatcattcatccaaagttcatcattcattcatccattcaattgcatcatttattcatccatccactgcaccattccattcatgggcatcagagagagaggggtacctggagaggagacgacgagcagaggaggcggcacacggcgacgacgagtcccggcaggcgcacggtgcacggcttctcagcacggcggcgcggcggcggcttcttggcacggcggcgctgaggaggagaagagggggttaatcggcgaccaatagtaaacgaggggaggcggggggagtgggctcaccgtggaggtcccggtcgagaggaggaggcggcggagaggagatcccggtggcggcgacgacggtcctggcgtggcgactgagaggaggtcccggcggccgtcgagagagtgagtgaggcggcagcggtggagaggtcgaggcggcggtggggagggcggcgtagagggcggagatggcggtagagagggcggcggagatggcggcggagaggtcgatggagatggacggcggcggtcgagagagtgagtgaggcggcggcggtggagagggcggcagagaggtcgaggcggcggtggggagggcggcgtagagggcggcggcagagatggtggcggagaggtccaggtcgaggcggtggagaggagggcgtaaagggtggcg

SEQ ID NO: 26057 - DNA, 3464 bp, Oryza sativa
  unsure (1)..(3464): unsure at all n locations
gccaacggtggagccgtcacaggtaagaccacctgtgacgggcccaacactctgggccgtcacaggtgaggtcacctgtgncggccctacagatagagcccgtcacaggtgagtttgcctagagcaattttattttattttatttcacttagttcttttattttccttaacatattttcacatacactacatatttttttatacttaattattttatttcactaacagtagtaattgcacttcattattatactactttaattatattatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagcagcctcgatgcgtaaaccactgttctgcactgtgcatttgctgtcttgcttgaccgtgtgaaaggtgtatccatttatgtcatatccttgccaggtggtgccactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccagatacctttcgcaaagatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagcacctgggttaagcagtaatcccattaaactctcgcatacattcttctcgacatgcatcaaatctatgcagtggcgaacttcaagatccttccagtatggtagtctccagaatattgacttcttttttcacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagtttacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26058 - DNA, 708 bp, Oryza sativa
ggacaccaacgccgcccgcgactgcgacctccgcctcctccgctccgtctcggagtcagtcgaagagatcaatctcggcgagttttttccttttaatctccgacttcgccaggttttttccttttcaacttattgttgtttattagattgatctctaaatgtcagattaatctctcttggtattttctgctgtttgcatgtaacgccgcggcactactcttgccgactggtgtttccgtctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctaatatgccgccgctgttgggcgtctacgacttcaccgccggcctgcctccgttgccgccgaatggtgccctccgcctatacggctggcctattatgcc

SEQ ID NO: 26059 - DNA, 712 bp, Oryza sativa
gccctatgggatttctgcgatctcaacggcagtggcaatattttccacactgatcttgtgctgctcgatcagatggtaatgatgtgactatgacatttattcatcgatgcctattaggctatagtgccaactctcttgataacattatttactttaaaaatgcagggaaacagcattcacgctcagatttatccacctgcaattgacagcctgaggcctttgcttaaggaacaaaaggtttactatattgactcctttactgtgaggtatgcgaataggacatacaggccagtcgacaatagcctaatgattgtgttcagtaaatggacaacatttgaagaatacattgagcccgctgctgatttccctggcataactttttcattgacaccattcagtgatatccccaatttagtggacaagaccatcttctatgttggtaatgagattcttctacacagctatatttgttgtatcaataatccatactatctcatcattaattaggcttatatggcatgcaaccagatgtcatgggtgtcatcactgaggttggttcgccaaccgttgtgcggccgaagtcaaggaatgctgatagcttaaaaagaacaatacagatatgtgatgcaaggtgtctttgctcagactgaatatccctatgtttaattgcaatttttaccttttccttttatgcatgcatagattcttagtg

SEQ ID NO: 26060 - DNA, 704 bp, Oryza sativa
attcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagtttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagcgctacataagcaatacatggagctaagcaatgcc

SEQ ID NO: 26061 - DNA, 730 bp, Oryza sativa
cgcagcggaaaaaaaaataaaactataacaaactacggaacagctatggcgactccactccacaggcatcttaaccagaacaagctcaatccttcagatcatcaccttcgctgaaatactcctcttctgatgattaaatattgcaagaatgagcatatgacatactcaacaagccacacagcaagtatgcaagtgcacaaggataccaagggatggcataatataggctcatttgcaaaaacagcatttagcaaagatttaagagtagtaaaataatagagtaattaatcatcaatattaatcaacactgaacagcacacccatgccactcaggcccaaccaaacctgaacaaccaaccccggtcgtacagatcaaacctccaaaccaggaattatccattccaaaccaggagtcaaattaattatcacattattaacattgatgagtagtgtgaaactaatcacgaaaaacattgctcaactcacccataaccgcgggtacggctattcgaatagttttactctgatcagaggtgtaccactgtacccacaagacacaaccccacatcatgtcaccatgtgcctcaataccaccacggtacctcggaaaggagttgtgacaatacctcttgcacaacataatccattacagcgcacctttcctggatcataatcacccccttataaacaaggcatggactccccagcgacccccgtggacttctcgccg

SEQ ID NO: 26062 - DNA, 7445 bp, Oryza sativa
aagaaatcgatccgagaaaaacaaaactcggttttggagataaactcgaaaacgagttcgattcgggcaagatactcaacgatttgctccgatttttgggggtaaagatagaggaggatgagaggataaaaacccccctaacaatcggactcggggcggctggattggggcggatttgagggcgcaaggcggcggctcgggcttggcatggccggccggccggaggtaggagaagggcccgacatgtgggccccacatgtcggtgtcccacgtgagggagggcgggcggtgtcggctgggccgaatgggccggctcggccgcttgggcggggagggggcatgttgggccaaactcggcccaacggcttaaaggaggagttttggaactttttaattaaaaaaaatttgtgaaatgttgtttaatttattaaaaatacttcccttgctcaaataattcccagaaaaatctagaaaatagaggagcaagtgtagtatttaataaaattttatctagctcatttttatgttgaaaattttcctagattattagggtttagcttgtcggcttttaatttaaatttctaaaaattccaattaaacaacaatttatataattaggatttttagggcgtgacaaacctaccccccttaaacggaatctcgtcctcgagattcagaagaactggcaaagagatgcggatgagctgacttcaattcatcttctcgttcccaagttgattcttcttctgaatgattgctccactgaaccttgcagaaccgtataacgcgattcctggtattcctctcgcttacttccaagattctgactggcttctcaacataagttaaatcttcttgaagctctatacgatcaggatctgcttcctccgtaggtacacgtaaacacttcttcaactgagacacgtggaacacgtcatgtattcccgccattgacggagacaactctaactgataagctacctcacctcttcgactcacaatcttaaaaggtcccacgaaacgcggtgccaatttccctttggtttgaaaacgatgaacacctcgtaacggcgtaacccgaaggtatacataatctccttcttcgaaagccaaatctctgcgacgattgtcggcatagctcttctgacgtgactgagcaacgcgcaacctttcttggataatcttcactttttcttctgcctctcgcagtatgtctgtcccaaaaacttgacgttcaccggtttgatcccaaaggagcggcgtacggcactttcggccatataatgcttcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaaattataaattgttgtttaaaaggaattattagaaatgattttaaaagtctaaaagagaagatctaattttaatttgcaaaatctcaatataaaaaggggcctgataaaatttcattaaatactttgctcaattctataattcctagatttttctgggatttatttgagctaaggaagtatttttaataaatggaattgcatttaagaaataatttaattgaaaaaggttttaaaaagtcttcttttggctttgggccgaaagccggcccaaaacccctctctctctctttccctcggcccagccggcccagttcgccgagccgccgctctcctctctctctcagccgctgacaggtgggccccacttgtcggtttcgtcttcctccttcggccgccgccgcccgcaaaccctagtgcgccgccgccgccttctccttccaaatccgctcgattctttccttctccggtgaaatctttagaggggaaatgatcttctcgatctcctcttccttttctcttttggaatctccggtcaattcggtttggaaactcgatggaatcgagatcgaatcggattcctctctctcccaaaccctaaagtttccttctcgccgccggtcgccgtgggcctccgtcgccgctcgctagcccctttataaggacccccaagctctcctctacccgtcgcctccctcgccttcgcccgccgtcgtgtgtagcgccctagcctcgggagcttttgcgccgccgtcgctgccgttcgtccagccatgcgccgccgtcgctacggtcgtcgtcgtcactcgggaaggccaccgtcgggatcgccaagtcgccgccgtccccgtccgccgcttcgccgccgccgaagaccgccggagcgccgtcgccgttgtcgacccgaagagcttcgccgcttcctcctcgtcgctgccgccgtccgttggtcttccgccgttcctttggtcaccggtgagttcgccgcgtcgccctctacccattggtgccctccgttcgcgtcgtcgcgccgccgttcgccggcgagcatgtgagcccgagtcgccgagccgccgccgccggggtgacgtcatcgctgacgtcatcggggtcgtccgccgtgagccggtcgtggaccgatcaatctcggccgtccgttttggatagggttgatctcggtcgtccgttcgcgtgaaccgccgcccgtgcgcccggtccaccgaaaccctagccgctgacgcaataatccttcttttccttttcaaaaataattcattattgcgtcataattcgattaaaatccatataaaggttttaatctgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatatgaaatcagaatgaggccgttcaagtctctaaattcatctaaaatcatgatctacatgtttgtttactttttatgtattgtttatttggtttttattagtctttttccttgttttgcgtgatagtttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggttattataattggactagttgagctttatatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattttagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttcccttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatctcgaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttaagtggttctgaaactagttgttgaaacttgaagacgccaatgtggtcaacttatggaggttaagtcaagtggatcgataaataagaaggtgatggtcgatctgaagggccaagtggtcaagatggaatgaagtttggatcctaccttagaacctatgccgccaaagtgtctttgaagaatagttagtaggatagaacgtttgttgtttgcttgtgtgtaggtatggttgcattcccgtcattggtgtggttcaatgatgagtgtgtaactatactaggttgcttgcttaatcaacttgaacaatataatggtctacacacatcagatcagtgttaacctggttaaggtcttaactttagcgtaacccctctcctcctatcttctctaatctgcaacagatggtgaacactcgtgctaatggaagtggaaacaataacaatgaagggaacccaactcttgctcaagttctggctcaacagactcagttaatgaacatgatgatacagcagatgcagaaccagctcaaccaagggaacaacaatgctccaccgccgcagaacaagttaactgattttcttcgtgtgaggccacctaccttttctagcactaccaacccagtggaagcaggtgattggttgcacactattgagaagaagttggaactgctccagtgcacggatcaggagaaagttgttttcgcttcacatcagttgcaaggacctgcatcagaatggtgggatcatttccggatgaacaaagcagaaggacaaccaatcacttgggcggagttcacggaagcattcaagaagacacacatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaggagaagtttttggaaggcttaaaggatgagctatcagttatgttgatctctcatgactatgaggattttcaggagttggttgacaaagcaattcgacttgaagacaagaagaacaggatggataaccgtaaaaggagaatgactgtattccaggaggcacaaggtagtagccagaggcagtgtatcaagccactccaaattggtgaatcttcttccgctggtcaaggacagtcgcaacagttgaacatcggtggtgagatcaaatcagagactaatgaaagcaatgaagttaacatcgagcaagctaatcagccggtgccagttcagcaggatcagtctcaggagaataacagtagtggaaggaagcagcaggtatgtttcaactgttacaagccaggccactttgctagagagtgtccgaagccaaagcatcagcagccgcaaggtcaggtcaacaacattgttgtcacaggagccaatgcagtgccagttgcgtcttcaagagttgtgtcttcaagtgttacaactcagccaccagtttcaaggcagcagtagttttcttcaaagccttagaataattatcggagttatggaataagatagactgcagtttacctattccctttttctttctagccgttccgaatctcgggacgagattctttgtaaggggggtagtttgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaaattataaattgttgtttaaaaggaattattagaaatgattttaaaagtctaaaagagaagatctaattttaatttgcaaaatctcaatataaaaaggggcctgataaaatttcattaaatactttgctcaattctataattcctagatttttctgggatttatttgagctaaggaagtatttttaataaatggaattgcatttaagaaataatttaattgaaaaaggttttaaaaagtcttcttttggctttgggccgaaagccggcccaaaacccctctctctctctttccctcggcccagccggcccagttcgccgagccgccgctctcctctctctctcagccgctgacaggtgggccccacttgtcggtttcgtcttcctccttcggccgccgccgcccgcaaaccctagcgcgccgccgccgccttctccttccaaatccgctcgattctttccttttccggtgaaatctttagagggg

SEQ ID NO: 26063 - DNA, 13308 bp, Oryza sativa
aagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctagacgaggattttatgcacaaataagttcggaaattactagtgaatttccgggcgtgacaatctgtttgagggtgataagcggtactgaaattcaaacgggtacccatctctacttgtaatttctgccaaaacttcgaagtaaactggctacctctatctgacactatcttcttaggaacgccatgcaaacataccactctggccatgtataactctgcaagcttattccccgtgtaggttgttttgaccggtatgaagtgagcgacttttgtcaacctatcaactactacccaaatagaatcatgtcctgccgacgttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgctttaggtcttggtacatcttagtgcttccagggtgaatggaatacaaagtttcatgagcttctttcatgatagtatccttcaactccttattatctgggacgcaaattctttctcctaaccacacagttccttgctcatctactacataaccgatggcttttcctcttctcatgttcttttttatttcttggatatcaggatcattcacttgagcttctctaacttgatcaaacagagtaggttgagcttctaaagtagccacaaaacctttgctgactatatccaagtttaacttctcaaattcttggcataactcccaaggtaaatgtcgaccttctgacatattacagtagcttttcctgctaagagcatcggctacaacatttgctttccctgggtgatagtggatttccatatcataatctttaatcaactctaaccatcttcgctgacgcatgttcaaatcaggttgagtgaaaatgtacttcaaacttttatgatccgtatacatctctgtacggttaccgaaaagataatgacgccaaatcttcaatgcatgcaccacagctgccaactctaggtcatgcgttgggtagttattctcatgaggacgtaattgcctagatgcataggcaaccacctttccttcttgcatcaacacacaacccaaaccgagtcgggatgcatcacaatacacttggaaacttttcctcgaatcaggcaaaaataacaccggcgcagtcactagccttttcttcagttcttggaaactttgttcacaatctctgtccacttggacttcacttccttttgaagcagacgagtcattggtttgcgattctttgaaaagtttccattaaccttcggttaatacccgccaagtccaagaaactacgaaatttttgaaccgtcttgggttgcttccaacttaacactgactccacattgcttggatctactgccactcctccagatgagatgacatgaccaagaaacttcacttcggacaaccaaaattcacatttactgaacttggcataaagctgatgctcacgtagtttctctaaagctagacgaagatgctcttcatgttcttctttcgtcttggagtaaataagaatgtcatcaataaacaccacgacaaacttatctagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcaccttccagttgatcaaacaggtcatcaattctgggtagagggtacttattcttgatagtaacctcattcaacgctcgataatccacgcacattctctgagtatgatctttcttctccacaaagatgactggtgctccccatggcgaggtactgggtctgatgtatcctttctgaagcaaatcatccacctgtctcttcacctcagctaactcattagctgccattctgtatggtctcttatggatagggttggttccaggtaccaagtctatccgaaactctatgtctctcttaggtggcatacctagcaaatcctcgggaaacacgtctgggtagtcttgtactatggggatctcttgtagagcaacttggtttaaaaacacaccatgatatttaggagaggacacaaagaaagaaacggtttccccattgctactggttaaagtcaccttacggttagcacaatctataactcctctgtgacgagataaccagtccatccctaagataacatctagatctttggattctagcaagataagcgaggatgggaaaggaacttcttctatttctatagtagcggaaggacaatactgtgtcgaagatacttgattgcctggggtattaactagtaaaggtctcccaagactaataacttccatcccatgattgctcgcaaaacttttagacaaaaaggaatgtgtagcaccggaatcaaaaagcacagatgcgggtatagagttaacaggaaacgtacccaaaaccacatctggtgcattctgagcttctgctgctgcaacatgattaacacgtgccttcggtgctggagcattggagttgttcggggctggagcgttcttcacgcgccgaggcttaggacacttatcagcataatgtcctggatcaccataattgaagcacacccctggcttgcttccctgttccttcctgacgggctggttctgagctggagttgctgcaggacgagcaaccatgttgcggttgtcattgccacgattaccagtattgttgtcgtagaactggcgttgggggcggacaactgatgaagatcctccttgagggtacgatggagcttgaggtcccgtaacgagacgcggcctctggttactgccctgttgtgccttgaattgggcagccctgcgcttcttctgctccatccggttatacttgtcttcctgacgaatcgccttgtccaccagctgctggaaatcccggaaatccgtagacatcaaggcataagacaactcatcatttagtccctctaagaacttctcctgacgctcttcatcggtgcgaatatcttccggagcataacgagctaaacggttgaaatcgtggaggtactcggtgaccgaacgagatccctggttgagtgctctaaattctctcttctttagagctacaacacccgttggtatgtgtgtcttcttgaaagcggccgtgaattcctgccaagtaataggctctccttcagccctgccttggcgaaaatgatcccaccattcagcagcaggaccatgcaattgatgcgaagcaaaagaaactttctcctgctcagtacactggatcaaatccaacttcttctccaccgcatgcagccaatctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagcagctccacttccacttccggtgcgcgtgttcaccatctgacgataagcagagacaacaggaaagaacgacagagagacaccctcagaacggagttatttaattaatttaaattttatattgctcttaactgtgtatgcttacatttaagttgcattaacactatctcaccaactatcttacactctgacaagcaaaagaactagactcatgctgttacatcccaccaatgatgtaagcaacaactaaaacccacacactcacaagcaaacttaaacaagcaatctaacacagcgaactacggcaacgacctaactaagcgactaatcccgccttgcgtcggaacgaagcgatggatcttcttcctctggagtagctggctctctttcttcagggtcttcctcttcttcctcatcacttacgatgtcgatgacaggttcagcacgatcgggcacaacttcacccatcacgcgaatcttcgaagctaactagagacgaggtggcggacaggttctctttcttgcggtgaggcgaagcttgggggttggcggcggcgtttctcctttaagttcagctaattccttctggagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgaccatgaggcttgtgaggatgatactagaaagctgatgaatccaactcttcttcaaaacgttgacgcaactctccaatggccaccaaagctgcttcttgacaagcatggctgtacgatcttcctccagcttcgaacttaatggacggaaggtcttcacgatcactagccaacgtcacacgaacacgacacttctcctcgttggggtcatgggaaatccggcgatactcaggagcaacttcatagcctacctcaaaagccatcaacctcagctccctgacgaatcctaacaccttgatcaaatttctcggtgaatggggcggcatctaaagaaacatagaagagaggaattaatgcatatttttttttaagttagctgcaccatctagacttaactgatttgaccaaagaggaagaaaaataaaagaaaagacacgtactaagccattatataaatatatttttagcatttaactttttggacagagacaaataattttttttttgacaaataactaaagtaaaactaaaatacttatgatctattataagcacggtacagtgtcaccataaaaaggatgagtagtactagtgctatcatgattgtatcaataccataatagatgtacagtgccgactaatcaacgaaatttaataaagtgaaataagaaacattttgaaaagaacaactttttgcttttaaaagaaaagaaaatgaattaaattaattttgtgcataaccttgcatgtgctgccaacttaattaatttataagagaatagagaagaacagttctatttttttcaaaatattttgaaggctacttaaggtttaccatttggcttatcctaaggtcaaggtggctctgataccaacttgtcacgcccggaatttctatccaaaattccaagcgcttacatgtgtgttaaaccctcgtccaggaatcaaccgaggcacacaataacaaattgataatagagtacaaataaataactatttaatatttgcaaacaaattattacagaggtagatagttcctctcaaagaataaccttctacgcagcggaaaaaaaaataaaactataacaaactacggaacagctatggcgactccactccacaggcatcttaaccagaacaagctcaatccttcagattgtcacgtcctgataaattcatcccgaaataaaattcattcgctaaaaggaataatagaattaattaaaattcgaaaagaaattggcaaacactaaaatacgtgcaagaaaaattccaatgtggcccggagaatttttgttaaattctccttggtctaaaaagagccctcaaattttacttgaattttcagagcaccggaaataattattaagcaacaacaaccttgatcaaagtttattaaaaagaaaaactaaaaatccctcctcttcctcctttgggccaagcccagcccgaagtccttccctcctccctctctttctctccctctccttctctccctcctcttgggcctcctcccctctcggcccagctcccttccccccctccttcctcccggcctgcctcggcccagccgcccagcccaagccgcctacccctcccccccccctcctgggccggccgcccggcccaactcgagcggcgccctcccgcccgagcgcgcacgtgcgcgcgctgaccgcgcgccccgcgtggggcccacgcgtcaggccgccgtcgccttcttcctccagccgccgcccggcttccctctccccgtgcgaaccctagcgccaatcctccctcaaatccgcttgattcactcggttaattccaaaattaattagggggaattaatcccctttccctcctcttcaattcccccttaatttccccttgaatggtgcccccaatcgccgggaacggccgcgccaagtccggccgccttcctttgccgccggccgccattcccgtcgccgttcccgctcctcccgtggccggctctctcccccatcctataaaatgggatcctcatccttcgttctatcgttttagccccttcccgagcctccccgtggtcgtatcacctctccccgccttctccttctccctctccgacgccggccggcctccagccacctctccctcctcaccggagcatcgtccggccgtgccgtcgcctccctcggctctgcaacaccgtccccttcaccggccttaccgtctcctcgccggaaactcgccggaacggtgcccccgccggcaaccagtggcattggtgccactgtactccctccagccggctgctgttcatcgccggtgcgccgatcgacgccgccgtctcctccttcgacaccgcggcatcgccttcttccccggcatcacctcctcctcgcccgaatttcgccggaacgccgtcgcccgcgccggcctcaccttcctcctcgtcgacatctcctccggctgccccggtcgccgcgccagagcgtcggccgacgtcgccgtctcctccctcggcgacgccgcatcgccctccaccccggcctgccctcggtttcgccggaacgtcgccgcgaacctctccgtccgcctcgccggagttgttcggccgcccgtccctcctcgccgtgtaccggtcggccacctccaccaccatcttcggcatcgcagtcgcgacgtcgtcctcggcctcgcctccccttcgaccgaaccccgccggtgttcgtcgtcatcatcccgttccctctcgcccggctcgtcgtctcgcggcgccgcctccgtcgtcggcatcgtagcggcgtggtcctcgtcgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtgttcgtcctcggctccgcgtcgtcaagcctcgtgccggccgcagctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccccgtcctcgtcctttcggtgtcgcccgtgcccgttgtgcggttgtcggccccggtacccgtgtaccggtgtcggtagtcgttcacgtgtgcgggtggtgaccgtgtagtgtccgtgttagtgtgcccgctcggtagccgcgtggtttccacgtgtgcaggccgtgtggtgtctagtggagtccgtttgttggccactcgcctcggttgacacacgggatccgcttccgtcgacccgtggaccgtctctgtgcactcggtctaccgcggtcctttaggttgacatgtggggtccgcatgtcaacggcgcagccttcctgtcttttccaggctagcgcttacacatgttttatagttgcaaaacctaattacaataatccgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttgtagctttgcttgtgtgcttcgcgtagctttcgtcgttccggaggttcccgaagcgtggttcgtggtcgtcgccgaaggttcggaaagccgttctctctgagcaaggcaagtcacatcatccttgaacatattgaatcccagtttgtaaaattatgttgatttaaattattgcattaccgctttatttaaattcccgcgttatcactgttttatctagccatgcccaattacctttgttatgaccttattattgttattgttattattattaccttgttcaccctagaataaataaaaccctaactagtgggtactctattcatggttccactagtataaatttaggtagatgcttcgctgtttaattaggcaacattaggtggttttataattttagactttgggaattctcatatcatttggacactatggaattgttggattatggtggaattggacatacacctctctttctctttcaaaacccctaaaacctgttttcggtggggtttgggtgcatgccagttaggggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccagggtcgggttgccagttcggtccaaatcatcgtaggccttgggttaaggcaggttcgtgagggttcacggccttgtttaataacactgtgtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactcccttcttccttcttcggatttcaactagtactagatggtcaggtcagtgaagaagaggacatcgccagttgtttgccgaagctccggaagactgcaggatccgctagcgaagtggaggaagcagtgaagccagatgtgaagcaggagtgaagatcttcgagaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagtgaaacaaacaacacatcattgaaaagagttagttcctttaaggtcttgtccctagttctggtctattctttccttgtatgcttcccctctcaacctctaccttgtgacagatggataatcctggtaaccaaggctatgggaatgatggatccgatgactcaagaacccaagccaatgggaatgagagaagcaccaacgcaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagcctccaacctttgccattgccgtcgatcctatggaagccagtgagtggttgcgcaccatcgagaagaagctagggttgattcagtgcaccgaccaggagcgggttggcttcgcaactcatcagctggttggaccggcttcagagtggtgggataactacgaagcatcacagccagaaggacataccaccacctggaacgagttttcatctgtattcaggagatcacatgttccctcgggaatgatcacactaagaaaacgagagtttcgctacctgaagcaaggagatttgaccgtcgcagagtacctgcacgggttctatcgtttggctcactatgcaccagaagatgtggaaacgggcgaagacaaacaagagaagtttctccaggggttaaaagatgagctcgcagtgcaactacttctagaggattatgaagattttgagaaacttgtggacaaagccatgcaactcgaaagtgagcataatcggatgacgaattgcaagagaaggatggttaacaacccagtatttccaggtggtaaccaaagacagcgcactgagccacttcagatcaccggatcttctgttgtgtatccagagttcctgccccaagaagatgaacgcaatgcagacaacaacaatagcaatactaatgctgatgataccaccaacaaccatggttcttgccccattcatgaccacttagatcaagcgtacaatgtcaacatcattcaccaagatatcgacgatagtatcaatgaaggcacccagaatgacaaccttagcaatttcgacactgagaaagactccaatggtgatagcaataatggcaccactgatgccgatgttagcaaggatttccaaccaccaattccaactcctaatcagaacgatcgttcccagacggacaactcagcaaagaagacgttgatttgttacaactgcaaagaaccaggtcatttctctagagattgtccacagccgaagcgtaacctgcgccatcactccggccattatgcaagaagaagacaggtcactcgtcttgtggtcactggagcaaacgccgtacctgtgaggcctcatattaattctaacccatagaggaaacaatgtaccgatgttaagcaccttccctttttgtttaagacagtgccttgtattcatgtaatatgggagaaattggtaataaaaacaagttctaagaggattcttttggaagatgcggatatgtgatcatgtgtataattgtttactgacaaaggagacctagggtatcgcgccagaggaactatattctaacctcgagctaataaccaacctgaggatggaaaagaaaaatcaagtgattaaccaaagagacatttgtttggactaagggttacagatgagtccttttcggatcaaaggcaacgacagttagtatagctttcggcaaaacacttcaaggtttcactgaaaggcagcaagccaaaggacctcatcgtcaccagaagcatccacaactctcggagtgaagagtacctggtggacaaagtttaagaggtgattgatagaagataccagcaaaggtgtttattatcgaaccaagaagtaggtcgaaaggtgattgataagagaaatctaaaaagaatacgtcagggctgaatgtgtaaaggaatactttgaatgctaaatgatgacaagcatggtatcttagtaatgacgagctgatctcgacgcatgacatgaagtgggtaacttgtatgaggttgacgccaaagatatgaattatgagaagttctggaacgaaagtcccatcttcaagtgccataatccagtcgaagtcaactagaggtacaaccagggaaaagtcaggtgaagagaagattccatctgcaacaggagattgagccaagcagtccagagtggagaagttttgctaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaaataaaattcattcgctaaaaggaataatagaattaattaaaattcgaaaagaaattggcaaacactaaaatacgtgcaagaaaaattccaatgtggcccggagaatttttgttaaattctccttggtctaaaaagagccctcaaattttacttgaattttcagagcaccggaaataattattaagcaacaacaaccttgatcaaagtttattaaaaagaaaaactaaaaatccctcctcttcctcctttgggccaagcccagcccgaagtccttccctcctccctctctttctctccctctccttctctccctcctcttgggcctcctcccctctcggcccagctcccttccccccctccttcctcccggcctgcctcggcccagccgcccagcccaagccgcctacccctcccccccccctcctgggccggccgcccggcccaactcgagcggcgccctcccgcccgagcgcgcacgtgcgcgcgctgaccgcgcgccc

SEQ ID NO: 26064 - DNA, 915 bp, Oryza sativa
tgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacagatcatcaccttcgctgaaatactcctcttctgatgattgaatattgcaagaatgagcatatgacatactcaacaagctacacagcaagtatgcaagtgcacaaggataccaaaggatggcataatataggctcatttgcaaaaacagcatttagcaaagatttaagagtagtaaaacaatagagtaattaatcatcaatattaatcaacactgaacagcacacccatgccactcaggcccaaccaaacctgaacaaccaaccccggtcgtacagatcaaacctccaaaccaggaattatccattccaaaccaggagtcaaattaattatcacattattaacattgatgagtagtgtgaaactaatcacgaaaaacattgctcaactcacccataaccgcgggtacggctattcgaatagttttactctgatcagaggtgtaccactgtacccacaagacacaaccccacatcatgtcaccatgtgcctcaataccaccacggtacctcgga

SEQ ID NO: 26065 - DNA, 995 bp, Oryza sativa
cacggctggcctattatgccgccgctgttgggcgtctaggacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctatacggctggcctattatgccgccgctgttgggcgtctacgacttcaccgccggcctgcctccgtcgccgccgagtggtgcctccgcctacacggctggcctattatgccgccgttgttggatgtctacatcctcaccgttggctcaccttcgttgccgtcgactggtgtttccgcttacgcggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatattttgccttttcctctgcctcactacaccaattggtcttccattgagtagtgagtcgggggctacagatgttatatcatattttttaaacaattttcataatatttatcttgattgcttgcgacatattctgagtacaaaagtgcctatcgagttatggagttccatcttcctatgctttccgtt

SEQ ID NO: 26066 - DNA, 28687 bp, Oryza sativa
atggattagaatcataatgaagcagttatgcgggttttctgatgacagcattaccagtgcttgcccgtcgacctttggcagcaagcaatcaacatctgaactaaaatgatccatgagaatcgaggaatgccttcatcagcctggtaatgagcattttcatttgtccaatctcctgccttgtgtctctgtcaattgcaaggtttctgaggatttctgccacgagcctccttagttctttttgggaatacgcaagaagcgcatctttgtattaagagaaataaagtttatttacagagatttgaaaatgaaaataaagaaggggatagggtaccggatggacaacaaaatgtaaggcctaatctcgtacaaaattttgcgaccgccactccgtggtcagtagaggtaactccagcattgccgcgttcgctaagcgccaaagcacggcctcagccgccatcactttgccacttcgacccaggtcttttgctgttggttgaagaccctgttgttccactccttccagatagtccaagctatcaaggctgcaacggtgtcgaatcctcgtcgctgagctttggcaaccttcattctcttgtcacaaagccatgagaggaaggagggttcattgaatggcagtatgtccgacaaaccaattgctcggagtgcgaaccagcacagttgacgtgactccgggcatgcgactaggagatgatcaatcgtctcgtcatcttgatcgcataggacgcaccgatcaggatgtggtaaaccctgtctccgcaaacgatcggccgtccaacatctgtttagtgccactaaccacaggaaatagcagcatcggggcggtgctaacgacccccagataggcttgtcctggaattggaccctccccacaaacatggactgataagctgagtgagctgagtattctcctgatgactcccatctccagatgattgaatctggctcttccgtgagggcatccaaggattgcaaagatgtccacaagctgaggtactctaggattgcttggatttcgaaagccccagatatatcccggatccatgttctaccttggagtgctttgcgaaccgtcctgcgattccgggttcttgctgcaaccgcggcatgcacagccggcgcaagggtgcggatcgacgacccctggatctagttgtcttcccagaagagcacgttcattccattgccgactcgacatgtcaaagagacttggagtaggttcctctccttttgcgagatcggaacattgagtccatgccatggcttttctggcgatgtcctcagttgccaagcccagcggcaccagagcgcaagtcccatgcgctcaagatcagggacacccaatccaccatacgatttgggtgcgcaaacacgtgcccaagcgacccggcaacttccaccgctagcacttgctttcccggcctagaggaagccgcgacggaccttatcgattccctttatcacccactttggcacattgatggccatcagcaaatagatcggtatagagctcaataccgcatttaccatagtgacccgaccaatgagcgccatctgctctgccttccataccggcaaccgacgggctatcttgtccacaaacggctacaggtcttctttgcgaagacggaagatggaaacgggcagccctaaataagtgcaagggaatgttgcgacctgacatggtagttcgtcctggatcagtgcaatgttgttgtcgttgcactgaattgggagagctgcacacttagcgaaattcatcccaagccctgtggcttccccaaagatgtgtagaatttcctttgctgtgctgatttcctcaggatccgaccgaatgaaaacgaccgtgtcgtccgcgtagagggaagttcggtagggcaggtgcagcggctgtaacagcccttcattctctgctttagagaaaagagagcttaatgagtccatagcgaggatgaacagcatgggagagattggatccccttggcacacccctcgccggtgcaagatagggttccccggtatgccattgatcaggacccgcgtacttgctattaggaaaagcatggcaatccaagcacaccaacggctaccgaaccctttgtgctccagaacctctaaaatgaattgccaggaggtggaatcgaatgcctgcgcaatgtcgagcttcaaaagcaaggaggattgcttccgctcatgcaaccgcttcgccgactgccgcactagcatgaagttgtcctgaatacatctcttcttgatgaacgcactttgattattggcaacctgagaatctagcttgggagctaggtggcgtgagaggatcttcgtgaaaagcttaacgaagctgtgaaccaagctaattgggcgaaaatcccgcaagttcctggcatctgggcgctttggcagtagcataatgaatgccttgttcaccttctccaaactcgaaccatccatacgatggagctgttggagagcagctagaacatccactttgatgatgtcccagcagcaatggtagaactgcccggtgaacccgtctggtcccggcgctttgtcgcaaggaatttccttgaccgcttgccacaccttttcgtcagtgaaagggtcctccaaatcggataacggctgccccggctgctcaaggaagctcaattcgagcgagaactcacgcggactgactgagctaagaacttcggagaagaaggactgtgcaagttacgccttctcttccggggcagttgcgacctctgagtcgaattccaattgctgaacaaagtttcaccgacgacgccaagctgcttgctgatgaaagaacttcgtgttcgcatctccttcttgcaaccaagtgatgcacgatctgtgcctagccattgtccgttctaaggaagagtacgccaaatacctcttctttagtcctcggtgcaggaatctttcttgtgccgagagaccgcgcacttcctccgctcgatcaagtttcccaatgagttctctaatcatttctagctgtagcttaacattccccaccttccgatcactccagctttttagggcacaaccaaccgacttgagcttggagtcaagcctggaaatgggatcgatgatggtacacgattccgaccaagattgctgcaccacatcagagaatccattcaatttgcaccaaaaattttcgaagtgaaatctccccttcgacggatgggccggcaaggttgaaaggagtagagggcaatgatccgagatcaaggaaggcagagccttgaggaagcattgagggaagagtttttcccagtcggcttcaagtcactccagggttgggttctcccacccattcgaccaggtaaaagcacgtccattcaggtggagcttgtggagagctagatcgttgatagtccgacggaaacgactcatcatccgatggttgaggttggcgttgtttttgtccctatcttggtagattagattaaaatcgccaacaactacccatggcccattacgcatacttctgatatcgcacagctcctgaaggaatagcaccttgtccgcatcggactggggaccgtagacgaccgtaatccaacaggaggacccattgtaaaaggatcctccttagttctttgattgctgctgctatctcccaagatctctgcaaggtttctcaataagaaggaatgttttgatatcttgtacctcagtgttatgccaatttccccttcaatgcttgtgagcctctgcagcaccttcaacgatgacattaacagaaccttctgttgtgcttcggaatttaccattgcacttttgaagcttgtgaatccaatgattttggggatcaggtcagttactctgtctatttccacgcagttattttgatcacaaccagcaaggctataaatgattgacatgcctagtgcagggaggagatcattgtctgtcaatggctgctcctttggaatcgaccagtacgccggtatcctctaccaaattctaggtatgtatctttggtcgttgatgtgcattgatcgggttggtgtttccagcaggttattgatgtttctctaaaaaagggttaaataattatatttatcttgaactatatatttttaaagaagccagtgtatttcttaactactttaaaagacaatcattttccttttttcgtcaaaaaccgctccctctcataaaaaaacatcatagaaaaccactcttccttgagaaaacagtccttaaaaaaatctcatgatcccaatataaaatacgtaagtagttttatataaaaatgatcaagtatgtccgtttgaaatgttggagtcttcatccgttactttgcattcccaaatttcaaccggcccaaatatggagtatatttcttttctacggaaaaaaaaaccgatttagcccatctatatctattatccatcacaaaaactacctaacggcatcatgtggtggtgcgacggtcacgggacaaacttaatgtgcccgaaccgttaccatctcacccccatcagctctctcatgaaagtatatagacccatgcgcgtcttttacatatgcgtcagtagggccaggtgataggttgatagctggtgactatgtgcatgcgtgcataatggttggcccaaggagcagttaactcctcttgcctactgtcacgcccggaatttctatccaaaattccaagcgcttacatgtgtgttaaaccctcgtccaggaatcaaccgaggcacacaataacaaattgataatatgtcgtaggctctccggaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagatccacactttcatcttaagcatgattatacatagcaaacacaactaagatgaaagaacttaagacttacaacaacttaataattacataggccgaccggccaaatagacttaatagagaacagcggaagcttgactacccaatcacaagcacaccgactaggggtttaccccattaagttctcatcctagaagaagcaatcggaacccgcatcactcaaagactaagactaaacctgcaaacaaagggttatatcaacagcaagagtcagtacattaaacaagttaatgtactggcaagcacaagtcaatcctaccatactacatgtaaggcatatattcaaaggaaggcaatatgtagttcattttcagcataaagcaagttttgtttcgcaattcttttgtaaaagagttgatgcttcaattaacaaagacaagttttaagtttcattattaacttcttcataattccatcataaacaatctcttattgccatacttaacaataagtcataatgtatcaccacatacacaactcaacacatttatcaatttcaaaccaatgtcacaagatcacatttttaaaacatagtctatactcatgacacatcaccaaagctctcatgaccgtgagcacggctaatcgattagtttaaagaactctgcagagtttgtacagctttacccacatgatatgaactctctagtttgttttgagtttgcaagactccatcacactcttcatgttgaatgtgatctagaggtcataacgaagcctttacactacttagaatctagccttgcaccagcacgatacgtgttcctccatcctaggcatacttggaatatacctagaaccgttaagtggcgggcccacgccttaaacttaacgccgtggtggcggacacgacgggaacccaccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacggataactttaaatgggtgacacaagttcggtccttatggacttgggcaaacacttcccctatcggtatgcaactaataccatatgcacaccacttgccgcccaagtataaaatcacattttacacattttagttcgtaaatacccatcatattcattttattccagcaagggttcatgtataaaaattcacattttaattatagatggaatgagcatttgcatatttctaagcatggctgagcaagtagttgcacatagagcatatataaacccatttgagcacaaagagtgtactctaaccatttctaggggttcaaacagcaagaggatcaattattcaaggtggaatatgcagcaaataagtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccacttcttcaccgattatgcaattatctagataaaggacacgatatgcaattaaacaccgaaagagctgaaaatccaaaatgctctaaaatgcatgatttatgcacagtgggttggtactgatctaaaatgaatttaggtgaaataattcctattttattttattccatttgggagttatgaattttagaagttttatcggtttatagtagtatagtcttaggtagtgttatgaaatacttttgtaaagtgatttttactagattagacttcataggagtgtgaagttgtgttttctaagactaacacatttggtttcacaatttttggagttataatgattttcttatagattttacaagttacaacatgttttaggcatatagtgttttatatgttcatgacttttgagtgataggttcagaacatgctacttcctgtttaagttgaataaaaggaataatttggttaactaaaacatttttagttcacatgtttatgatctttactagtatggttcatattttataaactagagatgctctaatctaaactagcaatatattatattaacctagaaattgttatatgagctaagttcttctaattttagtggatgaggatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacagaaggtgccaaattttattttactatgttgaagataactatttgctggttctatagaaactttgttcatttcatttggactaaaaatgaattttctacaagtttttacaaattaatggctgctctatgttagtaaatccttatatgaatatttagagacttttactacacagtaagtatataatattatttcataacttggaaatacatgttttaatgatcctacagaacttaagtttactcaaattgaagctaaattgggttctacatcaatttctaaagtttagcttatctaaaattaatcattatagagattatagttttagaggcatttgatgcaaagtaagtaattacttttatttcacctaatcagagactgtatgatgatgaatctgtagaatttgattttgtttcaaaatgagttgaaatgaattttctatgcattttataagtttgtacatgttttatgtatgacttatcttagataaatcttagagacattatttgtacagtaagtgtcaagttttatattcctggaataaatttcataacttcaagaatctacagcaactggaatcacttcaaaatgagctatatttgattttatatagattttacaactttgtgcatttttctgctaaacatataattgtttgggcattttcctaatttttcttcagattttaaaggatgggtccacatggctgtgagggaccaatatgcacaaaggcccttgaggtttctaggaatcaacccgcagtcctaggcccatatgtcagttactaacatttttcgcaaaaacccctggtttctcgggaaatagatcccgcagtcccctagttttaggtttgtatgcaaaacgatgcttgagttttagtttatttacagattattactggtcctacttgtaagtgactgttccagttgttaatacatccctgggagtctttaaatttcaaaagccatgcccttgctctggacagagcagagcagcagcacagccgcgagcttcacagcatcaccagtggcgaacaacggcgattcagcttaagctcccaaaacaaaaagtgtagagaacaaccgtgcgaacctattggtggctttctggcaagatttggtgctctatagcggctgttagggtgttagaggcggtggctaagctcggcttgcacatgcacgtgggttttgaggctcgatttaatcgtgcatgcgtatgataaggactctagggactactaggaggctcaccaagaatcaaacgcggctcggcgaagtcttagcgacggtgtactggttcggcgacggcgcaactgctacggtcgtcgtcgacggtgtactcccgggcttctactgcatatagagggtgcatgcttcggtttagatcagcacaaggtagctctaggcgaaaaagattgcgccgaagctcaccagagaaggagaaagaaaggaatggcgtcggcggccagagcgcgacggtgttccgagttgacgcggtcgcgttcccggagattggctgcactaaaagaggcgttcttggtggcgttagagacggcattgagagggaattacagaatgcttattgaacggaaatggagctcaccggattgcgacggcgtcgaggacttctctcaccggcgccggagttggcacccccgttcccggcgaatccgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagactggtaaacttgatttttagattaattttcggaattattttctcctctaactttgtagcttcataacttaatgtgtggaccaaattatctagtgttgaatttactggaggtaaatgattacacctagattccattttctttggttgcactcaaaaataatgggtagactgctcacagaaattaaacaaagatgggctattagaaagctagattgaatttttaggaggcttaaacagaggaggaaaattctagaaaaattacatttattcatgataactaatctagtgtttgaataaatcatttcccatgttcacttatgtgcagttcaatgtacttttggatgaaatatggttttagccaattaaatttaatttgatttcttttagttgtctgcttcaaccgattaatttgagatatcaacttgagtgttaacatgttaccaaattacagaggataagtttgtgctaatcattgtccacataaatttttccatgattttatcttgcacaaaatattttagagaattaagttgacctttgtttgtatatgtgttcccacttcataattgcatctaatattattatagggattacattaaacttgttttagactgagaagatgatatttgagtttaatattaagtccacatgttatcactcaagattaactataggtttgtttagtgaagtaattcttttagattatgctcatgggatctattatggaatgcaagaccaaaactccaaatgcacaaagaactcgagcctaggcatgcattatgtacatgtatgcttggtgacatttctagtctaatgttgggaatgaaaagattttattttgttctcaaattttaatcatgcaatggtttaagttggtcatcacctaaattaaaacggaaattttggctctcaaaattggagaagttaacctctaactattttgacaagaaattttaagtcctaaaatttcgggtatgttacataatagagtacaaataaataactatttaatattcgcaaacaaattattacagaggtagatagttcctctcaaagaataaccttctacgcagcggaaaaaaaaataaaactataacaaactacggaacagctatggcgactccactccacaggcatcttaaccagaacaagctcaatccttcagatcatcaccttcgctgaaatactcctcttctgatgattaaatattgcaagaatgagcatatgacatactcaacaagccacacagcaagtatgcaagtgcacaaggataccaagggatggcataatataggctcatttgcaaaaacagcatttagcaaagatttaagagtagtaaaataatagagtaattaatcatcaatattaatcaacactgaacagcacacccatgccactcaggcccaaccaaacctgaacaaccaaccccggtcgtacagatcaaacctccaaaccaggaattatccattccaaaccaggagtcaaattaattatcacattattaacattgatgagtagtgtgaaactaatcacgaaaaacattgctcaactcacccataaccgcgggtacggctattcgaatagttttactctgatcagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggactccccagcgacccccgtggacttctcgccgcttctcagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaatcaattaacatcacacgattaaccatcgtgagctaccatttaatgtaaccataattaaaacaataaagtaacataatttataattaatccctttagttagctaatgtttctaaacatggctaagcaaacttacatatagcatttagctgaaccaatccaacatataaggttcatgctaatcaaattataacccataggaaaataagatcatcttcggccattaattaattgggaaaggttcaccacccgatgacattcgaaaataatgcatagttgaaattaaataatagctttaaacgggttcaacatgctcaaagggttgtttgggatctgtgtgacttgtcttgggcttccgcaaactcttcggaaccttcctcaacggaaacgcactcctccggaacgtcggaaactaaagcaattaaacaaaaaatcaacaaaacagtacaaaaacaagcataaacagtacatgtgaatatttttaacatgtagatcttgattttagaaaaatttagcaacttgaaccacctgaaacggatctacggttatttagttacgattttctgaagatttaatctattagaaaaaacgaaaaggataagatgatgatgtcatgatgacgtcatcaatggtggccggctcggatggcaacctcgccggagctagggtggtcggccgggattttggaggacacctacgcgtagaggacgtcggcgcgaacccgatggtactcaccaatgcgtccaacaacgagggacggcggccggcgacaacgcaagagacggcggcggctcggttgaacggcggtgatggcgctacgacggccggcgacggcggagagggggcggccgagcttcctcgctcccgtgcgcacctaacggcggcaacgagaggcggcaacgacggcggacgcggcggtgcggcgtggccggaggatggccggcggcggcggcgggttgggtggtgtggcggcggcgctacaaggcacgggaaagcacgggagagggggcaaacgaaagagaaggactagggggtcctatataaagccttggattgaagagatcggactcctcccgcaagaaatcgatccgagaaaaacaaaactcggttttggagataaactcgaaaacgagttcgattcgggcaagatactcaacgatttgcttcgatttttgggggtaaagatagaggaggatgagaggataaaaacccccctaacaatcggactcggggcggctggattggggcggatttgagggcgcaaggcggcggctcgggcttggcatggccggccggccggaggtaggagaagggcccgacatgtgggccccacatgtcggtgtcccacgtgagggagggcgggcggtgtcggctgggccgaatgggccggctcggccgctcgggcggggagggggcatgttgggccaaactcagcccaacggcttaaaggaggagttttggaactttttaattaaaaaaaatttgtgaaatgttgtttcatttattaaaaatacttcccttgctcaaataattcccagaaaaatctagaaaatagaggagcaagtgtagtatttaataaaattttatctagctcatttttatgttgaaaattttcctagattattagggtttagcttgtaggcttttaatttaaatttctaaaaattccaattaaacaacaatttatataattaggatttttagggcgtgacacctactgcatggtagaagtaggcttacatgggtggggtccatgtgtgcaggtgatagctggtgaaccagtcatgcatgcatgatcgtgaggcctatgcagcagtcaaatcagtcatatggatatgtacactagtacatgtatatataactatacattgatacgtatcatcactatcatcccttttaactagacatatatcatcataagtgcctacaagtatcatcgcccgagcatagaaggtatcaccaccaacaactacattacgaagtgcgctgacgcgagctttctcaaacgtgtggtccaggtgccgcgctaccgtcgtcttgcctccatgctccaccacgcggctgccttatcctctctcttctcctcctcgtccaggctaccaggtatcacgggtaccagataccaagtacctggtacccgtgatattagctttgctccggtacctatggtacctacctatgggtaccagatataatattgacaattcgtctaatatgatccaactaaattaaatgagcaatcattagttggcccaattagccaactaataattgtgcatggttggcttaaaaatctaaattatttaataataaaaataacggaacaactattttaccataagcaaactcattatacaagagtaattaattttagtgcagactacagccagggaacactgtcccatactgacgcatatgcatagcttctactccgtagctagctagcgattgacacatagcacaactccataccagccggcaggcaagctactagaccctatagtgtgtctagggggcacgtcctgtcgagtggatacacacgcatctcgtctaggggagaggtaatggatataccgttgaacggtataccgttctctagcagccctcattgtccatcccaccgacagacgcacgatccggcaatggcctggctgcctcgatcgactaacgcgaggcggccggcaacctgccaggctgctaggcgcgacggtgctggctgggcgacgatctccggcgggcaaccaaagcagccgacaaggcgaccagctaggcgcgacggcaccaggcgggggcggcgggcgaggatcttcggtggagacgagcagccgacatacgtggcgagggcgagccggcgaatcccctccaggccattcctcaaacaggtcccgatccgatcacccttttgcctcatctcttcctccgtgccccctctcctcttggcaaggtaactgatgtttacactcttagtcttacagaaagaacagagtgatggttatactgaaatcgactgctctgcttagggatttggaatcttgggagtgctcttgggttgctagtttactactaggtcaatcgcaatgctgagttagtagaaagctccagtacagcatagttttggtctcaatagggccatgtacatgactttagtggccctgtactaaactagagtcagatgtcatggcatgcacggttgacatgggcgcatgatttgtatatttcatggatgttcagttgagttcacattaattgatagcaaataatttccaggtataaaaaataacccaaagattttaccaaaaaatttgatgccaaaagcgggacgcactagaacttggcataggaactgcaatcaccttaaacacctatatctaaccaattattatgcattaattggtcactcttaagagatgatatttggacaaatcatcagtagaaaagcagacaaacagtactaatgaggtaaaattacaaataacgtttgctcatctcgaacgaaaatcatgtttctttctaaagccatatgcacattccagttttttaccccgtgctaacaagtaacacgggtgggcggctcgggaggcgaaaccctagccgcccgcgccgccgcatcccggccctctcctccacctcgccaccgccggagcttgccggcgtgccgccggcgagctgggaaggcggcggcgaggccagttgagctcggcggcgtcctccttggcgcgaggaggttggggcaaagccgacagcgtcaacctcagcggttggaggcgaagatggcagggcatcgtgtggaggcggtagatccggccctcccacccccgaatctggtcggtgcggcgacggcgcgagctcgagcgacggcgtggcgaccgtggcagggccactgcggcggcgcggtggcccgtggtggcaacgcggtggctgggcgtcggtctggctccggcgtggcggcggctcgggctgtcagcgcgccggctacgtcggtgacgcggcagccggagtgtcgcttgcgcccatgtggtggctggtggcgcggcggccagtggtggtggcgcgccggctgtgtcggtggcacgatgtcgacgcatcggccggagtagagcctgcgtcggcgcggtggccgaagtgcagcacggaggtcggtgcggaggtgcggcagcggcggctcggcgacggccgctcggcttggccgcctagtggccggcagcccaagacgcggcgaccgtgggggggctccgaagccggagcggcagcatttccggcatcggcgtaggctcagatggtagtgcaaagggagctggcggctgtgggtcgtcttcttcgttgctggtcggcaccctcgccctttctggagctccccccttctttgcagggagtttctaggttggattgagacggcaggttgtcacttgtcagcgggggaagctcaggatgccgaagcaatgccacccagtcccaggttctccttcagccagatctggcgaggaggccggcgggtggtggcatggaggggtcctaggccagctctcagggatggtggttcgatgaagtcggccgacggtggggcgtcggtgcggtgtggtggcagtcttgtcgttggcaggactggaagctaatcgcggaggggcatcggtcgggtgtggtggaagccatgtgccgccgatgtttagatggtggattcggattgggcgatggaccacggcggtaaggggtttcgagcgaaagcttagcctaatttctttgggccaacggtgactacgccttcaggcatggtaaccatcctgagggcattgttgagatacccctcctccctcggcaaggaactctgggtgaaaaccttgtccagtttttggacggatgacgacggcgtctttcggcgtcgcgacccttgtgagggcgtcgttttagagtcttcgtgtcataatggtgttgttggcccggtggcgatcggtctcgcatagcgatggccggttcggtgcttggcttccctctctgtagcgtgtgtttggacggttggcacatggttcggggcgtgtgctctagtgcacatccttcctcgacagccagctgtcgatgtaaaacttttcttgtaatattttcttcctatcttaattgcattgaatgacctccttcggtcattccggcaaaaaaaaaaaaacaagtaacaatatgaatggtattctgattctaatgccaccattttttttctctgttccttatgtcatcgccacaacatgcgtaaattataaattcatagcatttcaactgcaataacagttcaataattcactgcaactgtcaatgggaattcatctcttacaatttatttatttgtcgctgctgatgccttgcagccactaatgtccaatcaattgttttgctctgtccacgagagcagagagaggtgtgttgcattccatgaagcctgtatcacccaagaaaatcatgtagttctcaacccttgagggcgtctcttctaccatcagcagtgcattcatcatctgaaattcattgaaacaattggcatagcaagaactgctctccatcatatatatggtttgctcaagtatcatcctccggatcccagggtaatcaacacttggtttcatattcgcattcagtgcatccactagcttcttcacgaatcttcgcttaatctgtccgtgctctagctcttgcacaaattcttcaggtttgactttgcatatctgtgaactaagaccaatgaggatttctaattctgccccttcaacatccgttattgtttccaagacctgtgtagtggaaccagcaatgtcatgtagcatgatgaacatagttgtaaactataattatacttatacaatttagtggtaaataaatgtccattttgattataaaataattatgtcttgacaaacattaatagacaacaaatgtacaaatgatacaacatactatacatatctaatattacacttgaagtatggattagcagggctcaccttttgaaaggcatcagataggtcattttggtttgattctgtgaggtcgggttgagcttgagcatgcaggtacagattacgcaacaggctcgcagccacatatatacatttcccatcatggattaggatcatattttttagtttattaatgaattctggttccttcaacataaccaagcagttatgcacattttctgatgccagcattgccaatgcttgcccagcaaccttcggaagcaagcaatcaccatctgtactagatggtccatcagaattgagggacgccttcatcagcctggtaatgagcacctgcatttgcccaatctcctgccttgtgtctcggtcaatggcaaggtttctgaggattcctgcgacgagcttccttaattcttgcatgctagtgttgtctcccaagatctccgcaaggtttcccaacaggaagggatgttttgatatcttgtaccgcaatgctatgccaatttccccttcaatgcttgtgagcctctacagcaccctcagtgatgactttacgagaaccttctgttgtgctacggaattcaccattgcacttctgaagcttgtgaatcctatgattttggggatcaggtcagttactttgtctatttccacacagttattttgatcacaactagcaagactgtagacaattgacatgcccaatgctgggagaagatcgtcctttgtcagcggctgctccttgggaattgaccaatactctgatatcctctgccaacttctgagtatggatacttggtcgttgctgtgtgctgattgggttggcgtttccagctagttgtcagtgtccgcaactaattcttgtctttgctcttgatcaccagctgcatctagtctttcttctgttggatcaacaaaaggatcttgatcatcatctgcatttagaagtgggtgtcctctttttggtcttccctcggtatccagaagcgttgatacaagctgcattgcctcagggacagttacaattcggaggctctttgcgaactcggccatgaccttcgcagcatataatctaatagttgtatgttggtttccattagtccagtccaacatgttgatcaacctggccttcgtctgcattgaagtggtgagtttctccaggagttgtgctcttgtcggatctctttgcagaaaagtgtgcatcatctggatcccgtacagttgattcttggacaagtcagagtttatagaatctatcgcaaagttgctgaggttgatcctctttggagcaaacacacctccttccatgtatttgtcgaaggcatattcgtagtacagattgatagattcaactccccactgacctgtaaatccagcacggcaaacgagggatctcagtgggatgaacgagaagacctccagcgtgccggcaacgatgtaaagtatgccttggccaagcaccatgctgtagaggatggtaagagattggccaagatttgtcttctcaccaacaccgatgtagtcatgtcgcgtaaggcgcatcctcgcgagctcttcgcgcacgatagctgcaggaatctgcaagttgccagatgacagtatggcaaaaccacataaatcgagcaagatcatcacgtgttgaacagttgaaggactggatcaaccatgaaaagcatcatcactatcgcagcaagcatgcacgagttaagaataaaccgacggttgccaaaaaaaaaaaaaaaaaaaaaaaaggaataacccgacgccaaaatacgtgtttactgcccaaagcaggacgcacttggttgacaataattgagaaccgcagcctgctgaccgtcaccaagagcacaaccgcaaggagcactatgtacactatccacatgacaaaactgtctccgtacatatggaatatggaggaacccatcaataggattgcaaccacggggctccatagcgatatcacacggagcagcagactacaggtgcgtggtcttcgagctcctcgagatactaatgggccaaccgtaagtagtattactactaataccatgattataatcaacataaatgccccgtcctgcacctcccgaacaacaatggccaccttagcagcagaaaagtatacgatcgcgatcagtccgttcccgccaagtgatctgaaactgaaagcacctcttgtccggaagaacaattggtaatcaaatctattgttgcgaccgaacatcctgtgtaatcaaagaaaagtgaaaacttagactgcagaacaaaaaatcaaaaacaggtgtagatgggcagtacataagtagctgtatataccttgcggcttctaggaatacgatggctgtcgcgaaccaaaaatcgccatgcgagtcgagcaccacagggtagccacctagcaggacaacggtagcccaagtgaaagccagcgtgccgagtgcattgctcgtcctctccatcagtgtcaccacgcgaacgaagcaattcacccatttttccggcgccgcgaccttgtcttgccggtcggagctggctctggctgctatctggactcgatgctcttcgccggcgatgtcccccatttccggaccacgcgcttcaacaagagaccttgggcaccgccggtgatgcaactcaatctgtgttccaaaattttaaacaatggtgggcactgggaagtccaaagaaaaagaaaaacctgggcggtgctccattgccggcctgacaaaaaattcaaagctgcaacattgactctacgaagctggtcaattcagctacaatcgacacgagtgcgaagtttctaattaataattggcttattggcacattagtgagatcaattgggtagatgtgggtgacatgacctcatctcccctgttatttttatcaggtgcagatgtggtttcaccttctttctcattccccttattgttgtttttggccaggttgtcaccggcgcatcgcgactcacatgtgtcatagtcaatcaggcaatgtctccgaaaagacaggaattcttggccctgtttacatcccccggcaaaattttttaccctgtcatatcgaatgtttggacatatgcatggagtattaaatataaacgaaaaaataactaattatacagattgcgtgtgaattgagagacgaatcttttaaacctaattgctccatgatttgataatatggtgttacagtaaacatttgctaatgacggattaattaggcttaataaattcgtctcgcagtttatagacggaatctataatttgttttattattaatctacgtttaatacttcaaatatatatccgtatatccgatgtgacatgccaaaacttttcacccctgaatctaaacacagcttgtctgtcggaggcatccgaactcgggatggaatgcttggaggtaggacgtgaggtgaacgtgcgttcatcgcgacacacgggtttggcagttgggccgggaaactcagcaacacgaggagcgcgacatggacctgacgtgatgtcggccctgtgggaggcctgacgtagggctgtcaaaaaaagcacgaggctcgcgagttgctcgagctcggctcgtctcagactcgattcgagctcagctcgagatcttaacgagccgaacccgagcctagctgcaagctcgcgagctttgtcgagccgagctcgagcttctcacgagcctaactgtgtgtgaaatatttatctttttatatgataagttagtagctcgaggataaattagtatatattcgtgtgaaaattgtattttggcatcatatattaatcttagattctcattttttttccttcaatattgttaattaaaattatttttttttgcaaaattttgccatcaaaatatacattgtcttatacttgatcgagctcgcgagcctaaccgagctcgagctgagcctgcttaaaagctcgaaggaggactaggctcgattcgagcttggctcgagcctgtgtcacacaagctcgagcctaggcaagcaagctcgctcgagctcggctcgttgacagccctagcccgaccgatgggtgccaactggcaaggtcacagcctgatgcatgaggaagccagcagcaaaaacctgcggggtcaaagctataaatttttttaagttttctattgttacaacacaaatatcaattttttttatctattttgcaaaaacctatggggttagctgactatacagattacatgtagcttcgtcactggtcagagggcgaatgtcgtggactcggagtgtttggcttggcacgtgccggagcggccgggagccggtaacatccgaaggctatgcgaaacagctgatccggctgtttggcggagagtagctcgagccagcgaaggaaactcttaactacctcctcggctcctccacaccaactaccacctctatctcaaaatattgctatctaagatagaatttttaggtaacaacatgatttgtttatcgctaagcttttaatattttggatagcaatacctaagaacagaagatactaggtagtagtaatattttgagacagagaaagtacatatttctgtttctgttcagaaataaaccaaccgccccaattacatatcagcccatctacttcccgagatctcctaacttcacttcgcacgatccgagaaaactgaggggtgccctcgactagtcaactcgaccgagtaatcgcgaggtgaccggcgatggcggcgaggcgatcagctaagcgctagggtgccggcttgacggcaggcgaggctctacgaccggaccaagagcaaccgacgaggcgagggagaatcccatccaggccattcctctacgggtgctctctccccccttatccccctccgaatccttcttggatcctctttgcttggcaaggaaacccttgttttcgttgctttgctaactcgatctagggatgcaagtgggtagtcccgctacccacataaaaatccgcttgctagtgtatttcttgcatggtagttcaaaatttagaagaataaatgaactagaagtgggataagcgggcaaaaaaagcccgcttgcccaccctgcttgcatccctcccgatccagttctagtcctagtcatggttgtagtcgcactaaaaaaagggagagaatcatggttattctggaatcgactattctgcttagggaatcgattactagtttattactggttaattgcaaggtgagttgcagaaacccaatgcaccgcagctttggtctcgacacgaggggcgtgaatttgagaaccctgtgctcaacaaaatttcaggcaccatgggccatggcacgcataatgcattgacatgggcgcatgacttatattatataacagttgagcacccattaattaggagtaaagtttttgctcggtggacaaaacgagagatagaaacactgaacccataagttgcgcattgtcatggtctgaatttcttagccatagtaggtgagttctgggctgctacatgttagatagatctccctccccttgagcccaacggctcaaggaggccttgacccacgccctgatcgggggcgcccagcccaatggctggtgggcccccatcaccctgcgccatataaagaggggtggaggcagagcggcacaagacacgaagtttgtcaccgccgccaactccaccccacaaaccctaatcagatcgagagggggcgcagccagtgatgggaacgccccaccgccgcgccacgcctcatcgtcgaccacgactcccactgctacgaccaccgtcgccgtcaagcacaccatcgccgccgtccacgtcaagcccgcgacgacaacgacgatggccggccgcacttcctcctcctcaacatcgaccggtcacatccctaaaccctctcactccctctttgttaatccatctattgttgttcgtctatccaaagtgttctacccgactagatctaacctaggtgatcccaaagcaatgctaacaaatggtatcagagcaaccctagcgtttggatcttgttttcggggatggaaatccaaagagaaaagcaaaagaaagaaaagcaaacgatccaacggattgaaaagagaaaccctaaccctaatcttacctcgtcgccggccgtcgttgacgccgacaacggaggggggaggggcaaagaggcaccgccaaggagcccctcgacggctgcgcgcgcacccgcgggtgcacgcgcgcgccggcgagggggcccgcggcggcgccgccatctccttcgtcgccgctactctctctcactcggtggggctggtggcgcgatgggggagaagagaaaagaggcgtcgacgacaccgctcggcgcggccgagcccgcccgagagagaaagcgaagagaaaaggagggggcgccgcggcacagccgctcgacggtagcgcactcacccttgagtgagtgcgcgcaccggcgagggggagtgcgacggcgctgccgtgtcgccgttccgccgccgcgcggtaagccgccgccggggccgtgccgccgccggcgctgtgctagggtttcggcggtcgcatgagagagaagagaagaagctagggtttttggcgcaggcgactgggggtcaggttttgttttgcccgatctctccgcgcggtcgtccgatcgaaaccctagcgatcggacggccggcggcggccgggccgaaaatagcccaagagggcgcgcgcggggggcggctttcctggcccaggcctaggttgcggcctgggggagggggcatggccgcaagcgcctaaaggcgaccgtgggccgaccggcaaaggccaaaaaagtccatattaggtccctcggcgaaggaaaagaagtttaataaatgtccctattcagaatcattttcaatatgtttaatgattgtttttatttctaagcaatttgtaaattgtgaaaattgtttagagaatagataaatgtgagaaatgcttctgaacatgtattttgtatgttttcatgcaaattacaatagaattttgaattgtttttacatgtttttcctctgtttaaatttgaaccaacaggagaatttttacagagagtaaataacatagttttgttactgttcttatggattttaatatagatcttccgctgcaaatagatgatattgatgaaaattagtgtttctaaaattaaatttcgaaccaacgggagaatttaattttaggaacattaattatgtgctatgatgttgtaattttctgacccacgttgatgattgcaatgttatagttatggctttatgtgttatgtctattttctgcccaacggtgatgtagacttaatacataatatttttaatgttaattttgttctcacaatacatgattatctcaggtgactactccttgatgggttacattaaagatattccgaccctgaaaggagataactacaaagaatggaaaagagaactcgaccttgcttttatcttgggagaggtggactgggtgttgactaccccatgtcctatagaacctgctgaacttttcagaggtgaaaaagagtcagatgctgaatggcaaaagagagagagggaaaatgcttccctcatcatgtcgtatgacattgggcatacgaaatggaccttagccaacaaggaatgtttggctgcggtaaagaacacgattgagccaaccatattgggcttaatcccagagtatgacaccgtctctaagtacctcgaaagtataaagagccagtttgctggttcttcaaagttttatgcgacacaactgataaagcagcttgtgacagaaaggtaccatagaggtggtgtaaaagaccacattcttaggatgagcaacatggcttccaagttgaagcaaaaagatttgggcatctcagatgactttctggttcatctggttatgacctcattgccaaagcactttgtcaaccttgttgtcaactacaaaataagtccagagaaatggaatattgaagagctcatctctaattgtgtgcaagaggaggaaagaatcaaagagaccattggtggctcaattaaccttgttaaagataacaaggaaaagagccacaggtcaccctcctcaaaagcaaaacagcctcagcatctgcctcagcaacaacagttcacagttgagacaggatcagtgtctccactgcaagaagacaagacattccaagaaagatcgtcctgacttcgtgacagtgatcatggcaaagaaaggtgagaacattattacatttgtaaatgaatctcattatgattggttattctagatccacatggtggattgattctggagcaactattcatgtgtgtaattgtttaaagggattccgttcgatgaggactatgcaaagaagcgaaagatccattagagttgccaatggagttgaagcaaaagttgaagctgttagagatcttcgcctagagctcacgaatggcttcacacttttacttcgagatgttttttatgtcccttctttgcaaagaaataagtgtatccaaattgtattttgatggatatgattgtcattttggaaatggcaaatgtgaactatggtataataatgcatgtattggtcttgctgtgttgcaagattagctttatttgttatctctttttgagaatgtgaatgttgtgtcctcgttgacaaaagaaaacaagaaaagaaagcgaactcctgatgtctcatcgaaattatggcactgtcgtttaggccatatttcgagggggagaattgagagactggttaagaatgtaattcttcctccattggagttctcagttttagaacaatgcatacaatgcatagaatgcatcagcgcccaaaacaccgtatgagctatggatcctccgtgtgtgggggagtcctacagaggccaaagtatttaacccaaatcttgggaaattggatcccaaaacagtaagctgtcattttattggctattctgaaagatcaaagggtcattgtttctactgtccaaacagttgtacaaagtttgtagaaacgggacatgccgtcttcttggaagacgaaatgattagggggagctcggtagttcgagaaattgatcttgacgagaggcgggtgtctgagcccgctcagtcgattcaagagccttctcctctctacctgctgatgttgtgcttgcaatgcatgacgttgcggtaccaacacctattgttatctctcctgtggcaacaatgaaagaaagtgaggaacctgttctacaggattcaacagaaattattgccacaccagaggaggagctacaatagcctcaaacagataatgtgccaaaacaggaggcccctagaaggtctgaaagagtcagaagatcggctatccatgatgactatgaagtttataatatagaagagtcgcatatgcagaatgatcccacctcatatgaagaggccataagaagcgcccgctcatctgaatggttggaagccatgaaagatgaaattaaatcaatgaaattaaatgttgtctgggatttagaaaaaattcctaaaggagccaaaacagtaggctgtaaatgggtctacaaaaccaaatatgactctagagggaatatagaaaagtttaaagcgtgacttgtggcaaaaggcttcacgcaaaagagaagggattgattacaatgagacattttctccagtctcttgtaaagtttccttcgggattataatggcactggtggcacattatgatttagaattacatcagatggatgtaaaaacgacatttctaaatggagatttggaggaaaaagtatacatggcacaaccaaaaggtttcgtcatgaaaggaaatgaaaatatgggatgccgtctaaagagatccatttatggattagaataagctttgagacagtggtacttgaagtttgatgggacaataaagaaatttgggtttcaagagaatatcgaggacaactgtatttattcaaagtttaagaatgggagattcattttcctaattctgtatgtggatgacattctactggctagtagtgatgtcagtctactgcaggaaacaaagaaattcttgtcctcaaactttgacatgaaagatctcggtgaggcttcatatgttttgggcatagagattcaccgagatagaacaaagtatgcattaggactttctcaaaaggcatatatagaaaatgtgttgaagaaattcaacatgtacagatgcagtgctacacctgctcctatagtcaaaggcgaaaagtatggggcatcgcaatgtcctagaaatcagtatgagctcaatgaaatgaaaaacaaagccatatgcgtcagttgtaggaagccaacaggatgcgcaaatgtacacacgacctgacttggcatttgttaccgggttacttggcagatttcagagtaatccaggcccagagcactggaaattggtatagaaagtcttgcgttatttgcaaggaacaaaaggcctcatgctgtcttacagaaaatcagaatcgctccagatagtgaggtattctgattctgactttgcaaaagataatacaaagtcaacatcgggatatgtgttcaccctggcaggaggagctatttcatggaaaagctcaaaacagactatcactgcagggtctactatgtatgccgagtttatagcatgctatgaggcaacggggcaggtgaactggctaaagaaattcatacccggttttaaaggtggttgacagtattgagaaaccactaaagttatactgcgatagcgaacccacagtaatgtactctcacaacaatcagtcaagtggtgctgccaaacacattgacataaagtactatgttgtgaaagacaaagtccaggatcaaacaatcagtctcgagcacattagaacagaaaggatactcgcggatccgctcacgaaaggcctacctcccaacgtgttcaaggaacatgcagcatgcatgggtttaagggaagccttatgaatcctggactatagggcccaaaagttaaagtatctgtttctgaatagagatgtgtatagtggctgtcgaatccatcggtgattaaccgtgacgatgaaacatgctctatatgcaaatctatgatggaatagaaaaaggctaaaagaaatagtgagatcaagggggagaatgttagatagatctccctccccttgagcccaacagctcaaggaggccttgacccgcgccctgatcgggggcacccagcccaatggctggtgggcccccgtcaccctgcgccatataaagaggggtggagg

SEQ ID NO: 26067 - DNA, 6002 bp, Oryza sativa
  unsure (1)..(6002): unsure at all n locations
ccccacaaaccctaatccgatcgagagggggcgcagccagtgacgggaacgccccaccgccacgccacgcctcatcgtcgaccacgactcccactgctacgaccaccgttgccgtcaagcacaccgtcgctgccgttcgcatcaagcccgcgacgacaacgatgatggctggccgcacttcctcctcaacatcgaccggtcacatccctaaaccctctcactccctctttgttaatccatctattgctgttcgtctatccaaagtgttctacccgactagatctaacctaggtgatcccaaagcaatgctaacactacagagtactatcttgtgttgaatgggactaattaccagggcaggaaacccaattttcaggagtcgaataaacaacattttttttgaaaataatcgatgccaagactagaacacactaatacattgtgtaggaattgcaatcaccttaagcatctttaatcaattaagcattgtccactccaacaaatgataattggcagtagcaaatactcctagattacagtgcaggactaatgactaatgaggcacagatacaaatagcctttctcatctcgaaggaaaatctatgttctttctagaaaggtcatatgcacaataacttttttaccctgtactaacaatatacatgatgacatgatcgtttgactgaaatgcaaaatcatcttacaactttcttcagttggcactgttgatgtcatgcagccactggcgactgatcagttcttttgctctgtccacgagagcagagagagctgtcttgcattccatgaagcccatgtcacccaagaaaaacatgtacttctcagcccttgagggtgtctcttcgaccatcgacactgaatccatcatccggaattcattgaaacacttggcattgcgagaattgcactccatcatgtatatggattgctcaagtatcaccctcctgatcccagggcaatgagcattttgtttcatgtttgcattcagtgcgtccactagcctcttaatgaatctccgcttaatctgcccgtgttctagctcttgggcaaattcttcaggaatgagtttgcatatctgtgaactaaggccaatgaggatttctagttctgccccttcagcgtctattattctttccaacacctgtagtggaaccagcaatgtcatgtagcatgataaatatagctgtacaaactatagttatacttatatagttcattggtaaataaatccccccttctttttaccaaaaatgacaaaaattaatagacagagaatgcaaaaatgatatggcatgctatacacatctatgttgcactcgtagtttgtattagcagggctcacctctcgtaaggtgtgagatagttcctttaggtctgattctgtgagctcatgttgagcgtgcaagcacatattacgcaacagacttgctgcaacatatatgtatttatcatcatggattaggatcatattttttagtttattaacgaaatctagttccttcaacataacgaagcagttatgcgaattttctgatgacagcattaccagtgcttgcccagcgacctttggcagcaagcaatcaacatttgaactaaatgatccgttagaatcgaggaatgccttcatcagcctggtaatgagcattttcatttgtccaatctcctgccttgtgtctttgtcaattgcaaggtttctgaggattcctgccatgagcctcctcagttcttggttgttgctgctgctgtctcccaagatctctgcaaggtttctcaataagaagggatgttttgatatcttgtaccgcagtgttatgccaatttccccttcaatgcttgtgagtctctgaagcacctttagtgatgactttaagagaaccttctgttgtgcttcagaatttaccattgcacttctaaagcttgtgaatccaatgattttggggatcaggtcagttactttgtcgatttccacgcagttattttgatcacattcagcaaggctatatatgattgacatgcctagtgcagggaggagatcatcgtctgtcaatggctgctccttgggaatcgaccagtactccagtatcctctgccaaattctaggtatgtatctttggtcgttgatgtgcattgatcgggttggtgcttccaacaggttatcgatgtcctcagtcggctcttggtcaccagctatatcatgtttttttatcttgtctatctaatatatcaacaaaatgatcttgatcatcatcttcaactaggagtgggtgtcctcttttcggctttccatcagcatccaggagcgtagatacaagctgcaatgttccagggacggttacaactcggaggttctttgcaagcttggcagtgaccttggcagcatataacctgatagctgtacaatggtttctactactccagtccaacatgctgattaacctggccatcgtctgtgttgaactggtgagtttctccagcagccttgccctggtcagatctctctgcagaaatatatgcatcatccgtatcccatacagctgattcttggacaggtccgaatttagagaatcaatggcaaagttgctgaggctgatcctctttgatgcaaacaaacctccttccatgtatttgtcgtaggcgtatgcgtagtacagattgacagattctactccccactgacctgtaaatccaccatttcggatgagggctctctgagggatgaacgagaagacctccagtatgccggctacaatgtaaggtattccctggctaatcaccattccatagaagatttttagagatgggacaagatgtggggtgccaccttggccgtcgtagccctttggattaaggcgcaaccctgcgagctcgacnnnnnnnnnnnnnnnnnnnntctgtaagttgccgaatgacacaatggccaaggcttctatgtcgacaaacattatcgcatatcgatatattttctcaatcatgaacatcggcatcacaattgcagcgagcatgcacgagcatcttctatatacaaacccgccggaaatggctgctctgggcggcgatttacgctgtcgtggcccttgccgttgcttggcacgtcatccagccggagcccaggggtggatttggagcgcggtcgttgcgcgcgttctccgccgttggatgaccatcgtgcgtcggtgcgtttggcatgccacattttcctttttctcgtccgctggttctctgcgttgcgtccgccacgtgttgttccctgtgtggtggcctcatttggttggtttgtgtgcggtgcattgcaccgcgcgcagggtagggtgggcgtccttgccattgttttctccggtgttatgcgttgcgtggtgcatttctttgttttttgaggtagccatggtccacagattgcctgtggctgccgtgtgggccgcatggcctctgcctgttcgtacctaacgtggaacaggtctatgctgtttgccttagctgctgtgtcagattgctttggtcgcttggtgcgcgtgtgcgctgtgtccatggcacagtttctctctggccggtgggtctgctttattctgaacctgtgtgttacggtctaggaccatatgctgttggagaccgcgcctgtagtgggattactctgtgatggcttctccgctattggtgcgtttgcgtgggttgtcgatatcaggcatcgctgtggtcctggtgtatgcgccccgttcctctgcgtcctgggccatgtccaatccgcttggatgcttggttcattcgtcttggtccatgcagtcttcttcttctgcagcctatgctgttagtctctctggtcaggttttcttgggttgtagctaggtgcgctgcacttatatcgctgataggtggggcagtgtcatctcagctagccatttgtttggttcctatttgtgggtgtttggtgtgcaggtgtacatgattgtttgcttccttgctgcagctcggcggagaaccccttctatctttgtctgtatatattactacttgcgtttctctttctttcttcccttcggtttctcctcctctcgtcggtttcttcgctccattgttctgttccttgctcgagaaactcccactcgttttgctcctgttcaacttttcgttatggcgtggtaaggcctggatcaatgcgtgtggttctcctgtccgttctgtcatttgggttttatgtttgttctctcttgtttgtttgcttatgactgcgcggctgttcttggtagcattgaccctgcaccttttgttccatttaggggaggcaatctgcatgggctgcaatggacctttaaaggttcctgatcatcttccattgcacgtgtgcgggctgcttctaagacctagcaggtacttttggttgttgctggtttcattggccttgtgttatgctttgcttcctacattcttattcactgatcatgctccgttctctgcagctctgttccgtcttcttccttgcctctgttcacagcttgtgtgttcgcttcgtggtgcgttttagtggattctgcctgtcgacgagcatattccttgctaaaggtattcccgcgctattaatctttctgtcctttatttatggttcattggtttagtattttgtttctattgcctgcattcatcgctgtctaaatctgcatgtggttgctccagagctttcggtcgttttatattgttcgttcactgtatctgtgtggtttgagccactttttttgcccgtgttctttgcttcattcttttcttgcctctgtaaaattatgatggcagttagaaacgcatgctatggatagagtgcgtagggtacgtgccagccggcagagaacggccacaaatgttctgtcccaacagagtgcaatgcatatagaacatgctatcgttccgctagggcagccccatcaggaaagtcggtgcaagaggaaatgttcgttgatggattttgcacctcagctggcaaagttaaataggcaaaggcgttccctcctgcgttcaaagatggatccgtccgttcctttggccaatgtggatggtatgctctttttgttgtctgtgatggtaggcttgttttttttcgtgcagtttaggttcataggctgttttactgtctttgttcgcagcaaatcacactgcacgagccaacggtagttcctcccggacagacaaggagtatatccgattgctaaagggttcggccgctgttctgaatacgtgcacgtaatgcattgtttttttacacgagactatttttgacattgtccagcgcttttgtggcagcatcatacccagacagatcatactatggccctccgacgtatgaatgcccgtattgtggtgccatgttctggtaccaggagagggtcaagagtgcatctgctatttcaaaaagaaaaataatttacaatctatgttgcaaaggaggacgcatacaattgccaaaactgcgtgcccctcctgagccactagcatcattattgaactataatggtgatgcacgttcgaaaaattttttgaggcaaatacgatcgtataattcgatgtttgctttcagctcaatgggtgcagctattgataaatcgattaacactggaaatgcaccttatgtattcaagatcaatggagttgtgcaccataggattggtactcttgtgccatcctgtggctcacctcccaaatttgcgcaattatatgtgtatgatccagaaaatgaattacaaaaccgattaaatatatttgaaaacgacggtgataattcagataaagcagatcctgagataattcgtgccctatcatcgatgcttgatgctgaaaatactcttgtccagagctttaggtatgctagagaacgtgttattcagcatggcaatcagcaagtgacacttcgccttttaggttgcaatgcaaaagacgatgtgcaatacaatttaccaacgaacagtgaaatagctgctattatagtaggtgatttttttgcgaaa

SEQ ID NO: 26068 - DNA, 3219 bp, Oryza sativa
cgatttgagcctggccaacaaccatctgatagagctgatattattgtgcgtgtgtttaacatgaaaggtaatgaatttataactgatattagggaaggcagaacttttggtaaagttcttgcaggtatggtcacaattttgttagtttatagcgtattaaggccattggtgtggcactcatcaacctttgttcttaatgattacagtgttgtacactgttgaattccagaagcgtggccttccacacatacattgcttagtttggcttgctgctgccactgccgatgtctcagcctctataatagatgggtttatctgtgctgagatacctgactatgacaccgaccggctaggatatgaattggttagcgagtttatgatgcatggtccttgcagtgatgcgaacaagaagtgtccttgtatgaaaaacgataaatgttcaaaacattatcctaaagatttccaagatgaaaccattgttgatgaatctgggtttacaatctatagacgaagaaatgatggacgatctatcatgaagaatgggatccttttagacaatagatcagttgtaccctacaacatggctttactgaaaaaatatgaggcacacataaatgttgagtggtgtaacaaatcaaatttgataaagtatttatttaaatatattacaaaaggccatgaccgagctaggatctattttgaaacaacaggaaaaacacaaaatgcatcaccaaatcatgaccttgctccacgcaatgaaatattagaatacatggatgcaagatttctctcaacctatgaggcacttcatcgattatttgaatttgatatacattatagagtgccacctgttgagcgattggttgtccatctgcctgggaaaaactttgtgagatacgagaagggagctgacctacgggcagtccttgagagtcctggtgcaaaacggtctatgcttactgaatggtttgaaactaacaaaaaaaattctaaggcccattcattgacatactgtgagtttcctaaggaatggacatgggagccatcatctaaaacttggcacgagcgaacacctgctcctaaaattggcagaatatattatgtgcatccaactgcgggcgagctttactatcttaggatgttgttaatgattgtcaaaggtgctcaaagctatgctgatgttcgcacatacgatggtgttgtttatggcacgtatagagaggcatgtgaggcacgagggcttcttgaaggagataatgaatggcatctcctttttgatgaggccatagtgactgcgtcttcagcgcagcttagacaactttttgtgacagtccttctttactgttctgttggtgatgttcgttcattgtttgataaatactggctatacatgactgatgacatacataacaggctaaaaaaggcccttgacaatccacactgtgtgattccacatgaccacttgcttaacatgctactacatgagcttattgctgtatttgcaaatagcggtggtaatatcaaagattttaacctgccacatccatcatctgttccacatgttcttggtactaatagattaatcgatgaagaaatcacaattgacccacttatgcttgctatgcatgcagactctttcgtacagcagttgaataatgaccagataactgtttttagcactatttgttctcgtgctatcgctaatgaacctggtttcttttttgtgtctggtcatggtggaactggcaagacatttctctggaatacaataattgcgaaacttagatcacaaaacaagattgttcttgctgtcgcttcatcaggggtagcatctctcctattgcctagaggtaggacagctcattctcggtttaaaataccaattgacattgatgaaacaagcatctgtaatataaaacgaggcacaatgcttgctgagcttttagctgaaactgcattgatcatatgggatgaggctccaatgacacataggcgatgctttgaagcattagatcgaacgttacgagatattttatcagagacatgcccttcaaattctattgtaccttttggaggaaagcctattgtcctaggtggtgatttcaaacaaatactcccagttattcctaaaggatcccgtcaggctataatcaatgcatctatcacaaactcagaactatggaaacatgtagcgctactcagcctgaatataaacatgagattactcaatccaatgttaccagacaatcaaaaaaaagaattgcatgattttagtcaatgggttttagctataggcaatggcactttacctatgacagcaaaggaaggtgagaattatcctgcatggatcacaattcccgatgacttacttgttatgactagcggtgacaaaatagctgctattgttcatgaggtttactcagatttccttacgtgctacagagacattgaatatctggcttctcgtgcaattgtttgtcctactaatacaacggttgatgaaataaacgattatattattggtttagtgccaggagattctagagtatacctaagctgtgataccatatcaaaaagctctgagcaaattccagatttcgatctgttataccccccagagtttctgaattcaataaatgctactaactttccaacgcataaacttgttcttaaagaaggtgttgtcgtaatgttgctacgaaatcttaatcaatcaattgggttatgcaatggaacaaggctattagtcacagttttaggagacagaattttacagtgtataatactgactggatcaaacattggtgaaactgtttacatacctcgaatcacacttggcaccacaaagatgaaatggccttttacactgcagagaaggcagttccctgttcgagtttgctattcaatgaccatcaataaaagccaaggtcaaacactccagcgggttggcgtatatcttaggaagcctgtcttcacacatgggcaattatacgttgctatttcaagagtaacaagccgatcagggctaaaaatattaattgaaaatgatgatggatcatgtggtacacagacaaaaaatatagtttactctgaagtgctcagcgctacagtccaagcggtgatttcccgcacgttatatcttttttttttgcttttcatcacttcgttgtattttcagcagagtaatgtgcatgtgttactattgcaggctccgccgct

SEQ ID NO: 26069 - DNA, 15313 bp, Oryza sativa
  unsure (1)..(15313): unsure at all n locations
ttgataacccagcaacaggttacaaccaggacactgcagaggaaaaaactattcaagaaatacttgccctcaatcctcacaagaacagggtacctccttgccagttttttgttcaatacatcgctgcacattttctcactttcaataatagtgatatcatttctgttctttgctttttcagagtacacgtttcattgtcaatgtcactgttaggaggatatgcagcgaaaattcctggtggtacaattcatgccgattatgctatagaacttctaagccatacggttctagctacaaatgctcaagctgttctaacataggaataccagatccaaggttcataccacacctcattccagatttttccatgcttactaattgtgctgcacacattaatatacacatgtatattacccatgtagatataaagtagtgctcatcgccggtgatgccagctccaatgctacatttatcctttttggaagagttgcacaccgcctcataaaaaaatcagtggaatctctgattgaggacaatccaccagatagtgattacattccagctgagatcgcagcgcttgtttagttcaaggagcagaaaagccatgtggtaacatgagaatcagccaagtgcatttttcttcccactacatggtatcaaggctggttgggatactaatatgcaatgctcaaactccagggcatgctatcaggtggatgaaaataatggaaaaccaaagctgtccgtgtttcttctttcaagtatcaagttcagtctcagaaaatgtccattggctggctatcaggaacctcggtgtcatccaattgcacggcttgtttctgctttgccttcttgtaactacaagagcctctgaggatggagccaagcccccctttgcgagatttctgtgatctgaacaaatggtaagaaataaaaagaaaacgtgtcagcggtcttcaactagagcaaaagaccagaaggtagccttgttcttctaagtgattctcatgacagatatatcaggtgattctataaaattttggaaatcgctattgataatgtgaaaaacgttttgaaatttgcatcaccaaagaacgatttgccactcaatgtaggcccacatgtcactgagacaatagcgaaagatcctaaaccagtgtgcacctcattggagcagcaaatcctaaagtttcaatttgttgacgatcatcaacattcagtaccatacaatatctgtacctgctcatctacattactccctctgtcacataaaaaaccaacatagtactggatgtgacacatcctagtactatgaatccatacatttgtccagattcgttgtactataatatatcacatctagtcctagattcactttttttgggacggagggagtacataaacaaaatcgaaggaaacgtaattcctacaccagaccattctctttgtaaattagagaacttacagtgatgcattgccatcgtcatcaggctcgccactatcatgggctcagaatgaaatacctgtcacatcaattagatcactttcataagcaagctaggtagcatatcagatgcactgttagaaaatatttcataattaatcacactgaatcagaatcccaaggcatatatcatgaaaagtctgctctaaacaaagagtacattgctcctgacattccatatcgtaatcaccatagcactaaaccagcattacaaatattaaatgatattctgaagatacatagaacataatactagccaaagaaatatcaacacaggaattccaagtgaacgtacgaaaataaattgcaacactagctgttgtatgatcagttctctcaataatcaagtcttcgttaactttcttttaattcatcgcttttgcattttgcatagaacagggtattttccagaagaagtataagagataaacaaagagggcatagttttttattccacggttaaacatatgcaaaacaaagtgcaaatgcaatcggagagaatactggtaagtagcatgttcagtgatactatttcaatgaggttcccacctgagtcagctgatgaggatgcatcatctgaagaagtttcaatggcagccttttcacttccgatgcccaattcatcatcagagccatcactgctggcatcattgaaaattgtaccagttcctttgtcttttttggatttgccactggtttgctcatacctttttcttggaactttccgagctgctagtaggataaatgggcgccaaaatatgtatttgcgacccaaatcaccctgtactcggctgattataattgggaactgcagcctgctaatagtcactaggagcacaaccacaaggagcaaaccgtacaatatccacatggccagctatgagctcctgtgctctctgtaaacacagaaagcaagtaataaagagtgcaaccactaggctccacagcgatatctgacggcgtagccgactgttgatgcgtaggcgcattcctagaacttcagcacatagaaactggccagcagcaaacaatactaccataatttcaatcactatacgtggccggcgtacttcccaaacaaccgtagacaccatagaaattgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcatatgtgctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatagggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaactaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagcttgtatgttgtgaataaagaaatttccaaagtattgggcataccccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacatgacaggccacacctgaaaatatgggctgcagacatattaggccttggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcggttgataacccttacggggaataataaatagtccagtctttgagcatagaaaatagacccatgatcataaattcatgttgcatgtatccggaacaagtccaaattggagacataatacttgtgtttgaactagtaagcccctgagcatatagcttgtccttatgtcgtagtcacaattgtctattgatggtagctgacgcagttggcatagagacaagataaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacaacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtccaaaccgaaatatttgaagttgttgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaaccggtagtgaagacgcgcagttgtgaagataaaagcactagtcggcggcggcataacacgagttggcggcggaagacgatgatgtccatcagtagtggtagctgtataaaccaaatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtattgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcctaacaacggcagcataataggccagccgtgcaggcggaaacaccagtcggcggcggtcgaggcagccggtcggtgaagacgtagacgcccaacaacggcggcataataagtcagccgtgcaggcggaaacaccagtcggcggcggtcgaggcagccggtcggtgaagacgtagacgcccaacaacggcggcataataagtcagccgtgcaggcggaaacaccagtcggcggcggtcgaggcagccggtcggtgaagacgtagacgcccaacaacggcggcataataagtcagccgtgcaggcggaaacaccagtcggcggcggtcgaggcagccggtcggtgaagacgtagacgaccaacaacggcggcataataagtcagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggtggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagcagtttataaatacgtatttcttctcttgttaattttgatttccccaagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcctaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactactcaatggaagaccaattggtgtagtgaggcagaggaaaaggcaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgcgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcagacggaaacaccagtcggcaagagtagtgccgcggcgttacatgcaaacagcagaaaataccaagagagattaatctgacatttagagatcaatctaataaacaacaataagttgaaaaggaaaaaacctggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcatatgtgtcacgtcctgataaattcatcccgaaataaaaatcattttctaaaaggaataatagaattaattaaaattcgaaaagaaattggcaaaccctaaaatacgtgcaagaaaaattcaaatgtggcccggagaatttttgttaaattctccttggtctaaaaggagccctcaaattttacttgaattttcagaacaccggaaataattattaaacaacaacaacaattatcaaagtttaataaaaagaaaatctaaaaataatcctcctccctttgggccaagtctggcccaaagtcctccctctctcccctcggcccgcggccgaagttttcctttcctccctctctttctctccctctccttctctccctcctcctcttgggcctcctcccctcccggcccactccctcctccctctctctcccgggctgcctttcccccccctctcccctcccggcctgctcggcccaagccgcctccccctcctctcccacctgggccgtgtcccggcccagccgagcccccccccctgcccgagccgccgcctgaccgcgtggggcccacgcgtcaggcgagtcatcgtcctcctcccgcccagccgtcctctctccctctcccgtgaaccctagcgccattcctccctcaaatccgcgcgattcaagcatgggattcccaaattgattgaggggaattaatcccctttccctcctctctctttcccccttaatttccccttgaatggtgcccccaatcgccgggaacggccgcgccaagtccggccgccttcctttgccgccggccaccattcccgtcgccgttccgccctctcccgtgctcggctcgcttccctccgctataaaatgcaaccccctcgctccgttctatcgctttagccccctcccgcggtctcccgtggtctctagccacctccccaccgtcgccctctctctcccacgttgccggccggcctccagccgcctgtgccgcctcgcccgcgcaccggccggccgcgccgtcgcctcttccagcgtcgccgccacctcctccaccccggcctgccctccgtctcgcgaggtgacccccggagctacgtttccgccgtcgcccttccatttcctccgcgccggccgcctccagccgcctctatctccctgcctgagcgccggtcgacgtcgccaccaccttcctcggctccacgacgccgctctcatccccggcatcacctcctcctcgcccgaacttcgccggaacaccgtcgcccgcgccggcttctccttcctcctcggcggcatctcccccggctgcccttttcgccatgcccatgcgtcagccggcgctgccgtcccctccctcggcacggtgacgtagccctccacctcgtccacccctcggtttcgcccggaagccgccgcacatcgccgcgaacctctccagccgcctcgccggagttgttcggccgcccgtccctcctcgcccgtgcaccggtcggccacacctccaccacctccggcatcgcagcggcaaggccgtcctcggcatcgtttcccctccatccaaacccctccgcggtccatcatcgtcgtctccgatcgttctcgtcgtcgacgtcccgtcggtcgcccggctcgtcgcctcgcggcgccgcctccgtcatcgtcatcgtagcggcgtgttccacgtcatcctcgtccccgtgcagccgctgccggctgtcctcgtcgcctcctcgccggtcccggtcgtcgtcgtcgtcgttgtcctctcgtcgttcccggtcgtcgtggcgttcgtccctccgtcaagccgttctcgttcgtcgtcctcgcttcgtcaagatcgctgcagccccgtcctcgtgttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttggtgttcccacgcctcgccgcgtggtggtaaggatccgtcctctcgcttccccgccctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgcctctgtgtactcggtctaccgcggtcctttaggttgatatgtggggtccgcatgtcaacggcgcagccttcctgtcttttccaggctagcgcttgcacctgttttataattgcaaagcttaattataataatccgcaaatctccatataacagcattaaacttcggatgatcatatcctggtcatacgagctccgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggtttccaaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattattgttattgatattaataccttgttcaccctagattaaacaaaaccccatctagtggacactctattcgtggttccactagtatgaatttaggtagatgcttcgctgattaattaggcaacattaggtggttttataactatagactttgggaaattctcatatcatttggacactatggaattgttggtttatggtggaattggatatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcattggcagagggttggtgccctgctgctaggggctcagtcttgcctgcctgtcccgggggttccggccgtaggcaggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatatggaatggtcggcctggtttggcttgggacgagctgggacccagggtcgggttgccagttcggtctgaatcatcgtaggccttgggttaaggcaggttcgtgagggttcacggccttgattaataatactgtgtagctctaggatcgtctttataaaatggctttgggcaactaagtgacttttaaatgctgtttactgcaaaacttaacctctatgttattatccccttgtactcccttgcattaattgtgcatctccggtgtggcttgctgagtactgtggttgtactcattcttgctctatctttctccccccttcagtaagagaagctttggaaaagaagtcttaggtggagtcctggcttataccccagttgagcgcctgtgaagatggagccgtaggcccgctagtccgctgctgtttatttttgtttgtcaggcctgaagcgcctttgtaataatgtaaatattatcgatataatgaagatgtgtcttttatatcatgtttgtatggtgtaccccggcttttcctgggacggggattaatacattagcgttcgggaaaaggcaattttcccggtcgcgacaatatgtgctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatagggtacccataatctccacagaaatggagaagcacacgattaccatcagcccgttccagcccagtcgtctaaaggcacctctcgtccggaagaacagttgataatccagcctattgttgcgggtgaatatcctgaaagtagtcatattgtttaatcattaaacagaagggaattgagggggtgtttagatattgtaaagtttgggcgtgtcacatcagatattatatccgtcattagcaaatgtttactgtagcatcacattgtcaaatcatggagcaattaggcttaaaagagtcgtctcgcaaattagtcgcaatctgtgcaattagttatttttagcctatatttaatacttcatgcaggtgttcaaacattcgatgtggcagagtgtaaaattttgaggtgggatctaatgagggccttaaagacggaattttaaggtaccctcaaatgattatgagcctttaatcgcttcagattcaatggatttgattttattgtactacacccggtagtagtgtagtagaaattatataggggtaaaattagaaataatatatataacattacaataaattcgtgtatcatataccatattaaaatagatgaattggtaaatatattttactaaagcttcaaataaaatattttatatacttatgaaaatatatagttagatttaaaatttactacactactacacatggtagtagaaggtaccataccataaaaacaaaaaggcgcataggagccaattatttgattatcaaaagttagtttcacactacaagtttgaaacgcttgaaatcttagcgtgtgtttggttctgggactaggtgggatgggatgaaaccatccctgattttaggattgggatgattccattcgggtgtttggtttgtagaataggacgatcccagttttttgtttggttgaagggacgagggagggatgggatgagcgctgtttgcaaccaccgataacgccgtttacaacaaacatggccgacgccgcctctgccctcacctccggacgtggtcgtcgccggcctccttgatggcgtcgatgagcttgggctggtcggggcctgggtcacacgcaccgaggagatgacggtgtcggcatcacagacgagcgggcggaggagcgcgactacgacagacgggatgacccaaccgagcgctggcggcgatggtgtcagccttcgcgcagagcagccgcggcttggcgatgacgacggcaacgaggtccgcgcgggagagggagagggagaggccggtggagaggagggcgagcacggccatcatcgcggtcgggcgggcggagaagcgcgacgacgcacggtcggcccgccgccgagttccccggctccagatccgtcgccgccgccttccccatcgccggatccgccgccgtcgccttccctatcgccggatccgccgccgccgccttccccaccaccggatccgctgccaccgagccccccgccgccgctgtcgccgagcccaccgccgtcgacgtcgcccgagcccaccgccgccgcggtcgcccgagccgtccgccaccgccgtggccgaagcggtttacggcggcggcggcggcggtgttgaacccggcggcggcggcgttggctaacccggtggcgtcttttgaagaccaaccccccaaccaggccgccaacctgccaaggggttcgctcgttcacgccggtcactcgttccaagggggatgagttggtccggccggtttggccggatcaattggtcccggatctgaaaggaatattcctttctagggaccaacccatcccactcaaccttgaaccaaacacccctaaaaatgggttcatcccatcccatcccatcctatcccagcaaccaaacactaccttattgaacagctttgcagccttatcttttcgcttacgctcatgcttatcagccgaaatttaaatatttaatcttaaatttaaagttgattttggggtttttcatcaaagtttattttttagtcttttagatcgttaagaacatgtatataaaaattttattcacaaattatttttcatttgtaaatatgttgtttgacttatttaccgaataagcgaaacgatgaggccgttgatatgattgctaggttggagtgcttctctatctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaa

SEQ ID NO: 26070 - DNA, 680 bp, Oryza sativa
aggcagctgcaactctctccccttcgttgcactcctctttatcaaattcctccattaactcgcgttgtcgttgtgtcacatccctgtacatcgtgaagacgaaagatgtcagtttataggaatgggcaggaaattctttgatcagtgtaattatatagctctagtagtctagtttgagaatgtatcatacgttggaactcggacgttgaagtgaatatactgattcccataggctggggaattccgtgcttttattcctgcagttttttagtgaaaaataaaatatgtttatcacaacagtgtacatagtgagtactttcttccagcagatataatagggcaaaaaccaaatatatcatctaacaaatccaagtatctgtgcataggatttctagcatggctcgaacaaccaacctttgcccctgaggacaaccttttctcctggttgggtaccttggcgaacctgatcaggaaataccacaaacacggtcattggtaagccattgaaataactggattacatggttagtgtcacgcagcaaaaatgaaatcaataccttgactgaaacgttgcccgtaagggttggtactgtgacagttccacctagtacagcctgaaaatcaagcagttttagaactattaatcataaaaggaatatctgcatagacagcagaattgg

SEQ ID NO: 26071 - DNA, 15034 bp, Oryza sativa
aacatggatttgttccaacagaggtgtacaaatttcttattttgtgaatgattgctattttgtggccaagtttagggcatcatatgcaggtagagtaccaactatgctagatagaacacaatggcctgtgtaggatctaggattcaaagtgtgagaacctaagctcaagaggattgctggaaggcctagagttcagaggattaggggtgcacttgagccgggactagaagggtgagatgcaaaagatgtggagggtttggtcattttcagaagacttgcaggcttgctaaagcacatgatgatggtgatgcagaaattgaggcagctccaaggaagaggtactacctacttatcttgcataaattgtgtattgccaattaccatgtggctaacatgtagcattccacttcctttcttgcatgactaggctgaacaggaaccttcatcaagctaaccaaccaaaaagaaaaagacccaagaaacaacatggccaactctgggcctaggcgggttgtgcgatcgcctagggcccaggccggcgaggggcccatcaaaccacacaccacatgcacctcttctcccaattggcgcatccacatctccacgagcgatacgattagcgagacatgcggcgcggttgaggcatcacgacgcacgcgtgatcatcggttcattctctctgctcggcgtttctctgacttgatgattccctgagatccttacgcgcgcgttgcctgaccaccgatgccacacagcccacaccgcgacgggcaaggacgatggcgggatcgactctgactcctgagcgagccaaccgctaggcacgatagctccaacgcctagtagccagcaaccatgcgccgagccctctgagctctgctgccttatcgtgacttggtgaggacttatgatgttctaattttttagtaatctcatttgcaactatttagactaaattttagttctaaaattagtatggtttcatctgttcttgttatttaatttactaaataattaatttaggagttactcccttcgtttcaggttataagatgttttgactttggtcaaagttaaactgctttaggtttgaccaagtttatagaaaaaataataatattttcgacccaagataaatttattataaaaatgtatttaattgttaatttaataaaatgaatgtaaatattactatatttctctataaacatagtcaaacttgaagcagtttgactttgattaaagtcaaaatatcttataacctgaaacggaggaagtataaggttgccaaaaagcattttttgggtgctaaaaaagaacaaaagaatacgagaagaacaacttattgaatcacaatagattttacttaaaaaaatgcttgaggaggttctttttttgagagacatttgatatttgtggtctcctatttaagatactcatactatttatttctatggtgaataggcgatgaaaattaaatcacacataatcaaaactaacctaacttactcggcttggtgagggataaacttaactaaacaactaagttatgttttgcaattctatggtgatatgggctcaaatatgtctctatgaaagtaaattgcacaattgtaaatgcaataagtaaatgagataagagacaagtaatttttcacccaaggttcggaaactcaccggtttcctaatcctcgttgaggcgagcccaacttcaccgctcaaaaccctgaagccatcgcaagccccctgtaggatcgagatgtcgactagaggggggagggtgaatagatgatttaaaactaaatgacagctaatcaaaactaacctaagttgctaggctcggtgagggtcaactctaactaagcaactaagttatgttttgcaaacctagggtgatagtggctcaattatatctctaggaaagtaaatcacactcctatgtcaatgtttagcaatcctagggtgatatgatcttaagtatgtctctagaaatgtaaattgcacaaatgtaaatacgacaatcaaatgagataaggagacaacagatttttcaccgaggttcggaaactcgctggtttcctattccccgttgaggcgagcccaactccaccgctcaaccacgaagccaccgcacgcccccttcatcaaggggtgggcaaggcaggagctggctcacggagaggactacccaagcctcgatcactcggggtagttcttccttcactccgaaggtggtgaactccaaaccactcacaaaccggcgctgggcctcctccacaatcttctcggagaggtcaccgggcatcttctccacaagccgtctaggaggcggcaacctccaagagtaacaagcaatgacccgacgtggagatgatcaatcaagtgccacactagctctacaaatggaagcaatgcacttgactcttggctagaacaacctcaaccactacaatggatgaacactaagctcaaaggtgcatgaaaaaggtgcaaggggtgtatgcaattgaattggtgccaagagagtccccttgctgctggtgggggagtatttatactcccacccaccaaaactagccgttgggggtgaaatcccccaactcagtgctctgccggtctgaccggaggtatgtggccggtcagaccgtgctactctacaacgcctagttttctagccgttgtagggctatcattgggccccaccgccctggccggtcagaccgacatggggtggccggtcagaccggcctcggcttggtcagaccaccaccagctcggtctgatcgaatacggctccggcggctcgggatcggcacaccgagacaacaccatcccggccatatggccggccggtcagaccagcccacacctgccggtcagaccggcctcgaggcggcggtcagaccggccgtgaccctgcggtcagaccggcactctaggccgcggtcagactggcccttgtcaggccgaactcagtgcaaacagggaacaacaatatatagcaagtgtgtgttgtgaaatgtgagcacaagtctaaatgcaaatgacctaatgtggcaattaaaataatctcttagctaggtcattacccctcttaatagtacaacaaagctataaataaactagcacaattttgatcgcccaacgcctcgatcaatttaaaatgaaaacactagtttacgtcttctcttccttttgctttgcgccgtcaattttaatccatcgataatcatccatgcgcgcacatgatgtgaacctaacttaaaatatatagctcaaagacaatggttagtccaaaattagtgcttgtcattaattaccaaaattaacaacgggggcctagatgcttaacctccttcgtcaaggggtgggcaaggtgggagccggcccacgaagtggactacccaagcctcgatcactaggggtagttcttctttcactttgaaggtggtgaactccaaaccactcacaattggcgcggggccttctccacaatctccttggagaggtcaccgggcaacacctccacaagccttctaggaggcggcaacctccaatagtaacaagcgatgatccgactcgaagatgatcaagtgccacactagctctcacaatgaagcaatgcacttgactcttggctaatcaactctcaaacacaacaaatggatgaacacaagcactagagagtgtgagagtagttgcaaggggtgtatgcaaataaagcaagtgccaagagaatccccttgttgttggtgggtgtcagggttacgggttaggcataccctttacccttcgatatacgttacatatcgatatggcatacccacgcgcatgcggatatttcctgtatattctaaggaaacctttcacggaatatacagacgggaagaatcctactcgggcagaactgggtcgttggcgtatcgtatagggtctgatacctccaagttctacgtggagacctctagatctgcgatataaaagggaccccccggggagggtttaggacatcgaatctcagagccaacacaacctacacagcctacgaagccggagcctacgaggagccaagtcgtcgagggctagttgaaacaactcgactacaatctcgctggatccgacaagttcccttgttccctttgtaacctatgttttctaccatataatcccacatcaactggattagggttattacctatcaaggggcctgaaccagtataattcttatcttttgtttgcttgatgtcgtactacgtagatccttgtaccaacgtaccccaataccctctatatccggtctacgggtatcacccgtcgacagtgggggatagcccatcccacaaaaactagccgttggggtcaaaatccccaactctgtgccttgccggtcagaccaccattgggtggctggtcagaccggcctacattgtaaaggctagaaaactagcagttatagtgcattaaatgcactgacagcggggggggggggggaggcagtcagaccgccatagggcggtcggtcagactaccaggggctcggtctgaccggctgtggctctagatcaccaacccatacgagaccaaccggctaggaggggcctggtcagaccggccaacaccctccagtcagaccgaccctggtcaaacaatgcaattcaatttaaaagcgaaccaagtctaaatggaaatgacctaatctggcattttgatcatctctttgtttaggtcattacccctcttgatagtatggcaaagctttaaacaaatctggcaaatttgcatgcccaaactcctcgatcaattaaaataaaacacgctagtttcatcgtctttgttccttttgctttgcatcatcgattttaatcctcggtgatcattcatggcttgcacattatgtggtcctatctcaaaatgtataactcaagataatagttagtccacaattaacacttatcattaattatcaaaatcaacgatgggggtgttgatgcgaaaaacacacactggcctgggagatttgcttaactccagtgcaggtcctaaattttgctctcgggttcaaaggcgtgccagttaatttgatcctgcaatcaacaagaaagaaagacaagaaaaccaaggttaaatccatacacgatagccgatcggctggggccgatgacatatcgttcaaactctgagtcgatgttattggcaatagatcggcgatgaagaataaagtaatataaggttaaatatattcgatcagctgtagatattaacaatatataatcatcttcttgaaatatatttaggctaagtaattgggatagattgaacagcaagtcgagatagtataaatcacttatgctcaaaagtactttaagatgaagattatatatgcgtttatagcatagccgatcaaaaagacctaacatgtgtcggctaatactccaataccactctatattaagatattaaaacaaacaagatatatcagacaacgaccataatatactttaatgcaataagatcttaatataaagggcatatttagcatgtcaatcaagcatacaaggaataaagtagctaaatcaagtaatcataaaacaagtaatcatataaaggctgaaaccccgattgctatctccattagtaatcataaaacaagctagatattgcagttatgaatattacttaatagatcaaactcaaccgatgcaacattaagcataggaataaatacaagatctaagcaagatgatgaaaacatcagaaagatggtatatatgctatataatttagactaataacgaaatctaactctatcggctactctccagtgataaatactagccaatcataggttaaatcgtgaaactaataaagattatgaagcatatatatgataactcgacgattcacataaacaagattatagtatcatgaagatggaagcactaatcctgagaacgcaagccgccatgacaagtttacctcttgttgaagatcgaaatcgatgcagcacaacctgaaagcaagaactcgtcgaaacaatgaaagtagaaaaatggtggtgatgcgtcgaaagtgttattgagttgttgttgtaaattacatgggttcgggttatatttatacccgagataaataaacggtccttgccggacacgactcttatctctaacaaactctaagatacgaacaagactttacggcagactcttgccgaaacatatctctaaagaacctatttaaaatatcctaattaatagatacagttgcctatctgtgagcttatctccatcgaggcaatcctcatgaagcacgttggttgatcccgaagacgatcctacgaccatcttcaacgaaatcggctacatcggctgtatcggctatcctctgtcatatccatcttagctgatacagtcttcagccgatgctctcgcagctgatgcgcactctgttcttcgaatacaattctccaccgaatccactttgattccgttcttgaacctgattcatgattaccaaatttggtcattaacagggggcctagatggttcaatctcctcctttttggtaattgatgacagacaccacagatacatataataaccatgaatcacatagatacaaatgtgcaaaacagagagacggattaacgcatgattaattaagtattagcttaaaaaataaaaaatagattaatatagattaatatgatctttttacaacaatttttgtatataaaatgtttgcaaaaagtacatcatttagtagttcgagaaacgtgcttgcgggaaataaaggaatggagattgggaaccttgagttctatatagaaggaattagaaaatatatgtgaattttaatctaaggggcttaattacaaccaaatcatactctaaccttacaggagcccttttttttttgcgtgattacaggagcttaaacatgcatctacacggacgcgccaccgtccggccgtgtcaggatgccggcactgtagactagcgcccaaagatgcgtcatgaactcgccgcctgcgccgagcatctcgacgtggatgtccacgttgtccgatggcgcgaggaacagtatgaactcaacccagaactcggccagcatctgccacagccgctcctcgttgtccatagccatcctgagctggccgccgagcagcgccgccttctcgatgatggtggagctgacttgtctctcggacgcgggcaccgcatctctccttgtcttggatctcctgtagcctcgcgagcacggagctcgtcgtcctacatccgtcgaagtggtcccgcgcttgctgcaccgtcgtgtcgaagatctgctgggcgatgtagctcgggtccgggagcatctctggcacgaatgccaccaagtaggcgcagtagttgaacagcctcctcgccacgagcctgttatggtggtcgtcgtcgcggcggctacggccacggccactcgcccagtcgcagcgcgtggtgacgacgtgccacacaaggatctggtcagtgaggtttgggaaagtgcacgcccaccccagccgagacgacaggccgtgccttcgcaaggtggagatgccattggtgagccgcccagagctagacttgaaggagaggagcacggctccgctgacctcccgtgtcaggtgcttggtccgtcccctcttctggccctgcctccgtggctccaccaggcacagcgtcagccacgacagcaggttccacacccacggtcggtggttgaacccctcgaggagcacatattcgccgagattgtcctcccagtaattcatcttgggcggcgcgatgtactccttccaccagaggtggcggcggcgcctgttgtaccagggccgctcgtcgcgcacgcagccgtacacggtcttgatgtacatcatccagttgctgttgaagacgataaccgcctggaaaagctcgagcgaagatgagatctttcgccttctgcgacccagccgctgcgtgaatgtacccgtagagccgtagcttcagcagtttgtacagcgtgaacgcgaggcatatgtccctggccaaatccttctccaactcggagtacccgacctgatcgtcgatccacgggtagacccagtcaatggtgacgaccgacttgctggagctgatctgcgccaggatgtcgccgtcccggctcatgggcgccacggtggcctccccgtggaagatgtacttgtaccctttcatcgtcctggggttagccggttggtctcccgcggcgagggactcctcgatttccatgtaccgcgcgatcacctccactcccatgcgccgccgcgaggccacatcgttgctccgcccaacgaggaattcggcgaccatcgccgccgccttgaacacgctgaggctccagaacgcccaggtgaccacccgatagctcatgttgtggcctctcgtcgtgttgacgatgagccagagcacgaagatggtctggaggagatgctgccgcaccacgttcttcctctggtcgaattcgggggtaatataattaagcctccatctccttggatcgattcactggtgttttttgtggtgcgatcgatcgatgtgtaatgggggtgaactaactcgtaacaggaaagtacgtagtaaggattttgctagctcggctcatttgttctctctccaattaaaaggtgagagacggatcgaggaggaacttgaggattgttgctcatgcatttttgttctagtgcgagaatgaagtggtctccaagtaaaatgtgagagacgaaagaacaatcaaagtgttgcgcgaagccgaagaatagaatgcattcacgagctagggcaacctaaagttcttttctctcgatcggactatatgtttttgcgtgccttgagccgttcatcctcgtcgcctccaatcctccatggctgacggtcaccgggcccaatcccagagagtgggccagccctaacgaagactatatgggccatgatggtgactgttcttctatcctatctaaataggaataagttcaccggaggtcccttaacttaatagcgagattttttttgaagtcctttaaccacaaaaccagaaatgtgtacccctaaactccctcaaaccgttcaccggagttccctcggcagtatttttgcccggttttactgacgtggcatcctagtcagcaaaaaaaaatttaaaaaaaatacgtagggctcacatgtcagctgcacatatttttttcttctattttcttctccttctctcctcttctccttcaggctacgggcggaggctgcgggcggagcagccacgcgccgtggccgcggtcgtcgtcggctctccaccgtcgtcgttgctgtgagcgaggctacgcggcgcggccgtccggcggcggagcggaggcagcggagcggaggctgcgggcggagcagccgcgcgccgtggccgccgtcgtcgtcggctctccaccgtcgtcgtcgccgtgggcgaggcctagagttacatgcatatatgcattcattcatgaatatatacatatatattcgatcgatcgatcttgtcactttcaacccgtgcagcctgcaaatcaatcacaagctgcttttgctttggtctttttctctctactgcatgcatgtatccctcacttgagaacccatagctagcatgcatgcgttcacgggcttttggcctttcctctctcgcgcgcggagggacgccattgccgcctacaagctcgcgagtgaagctcggctggctctctctcctctccggcaagaagggcgccaaggccgccctgcccgacgacgacgattacaagccccccgcgccgctgctcccacccggggacggcaacgacgacgaggagcccatcaacctcgtcgcatcatcggcgaagatgaggccggcgggagagggggtggtgcgccccatcggcgaagaggtcgccgccgaccgcctgccaccgctccgcagccacacttgtccccccgccgctcgccgaccaggcccctcgctccgtcgtaattgcccgccgccctccgcccaccgctgctccgcctaccgcgctcgtggaggtcaaccaacacgacgaagacgccggcggtgaagagctggagcatgacgagcgccgccgctccgctgccactctcgcccgctgccctgcccaccgctcccgccgtcccagccgcctctctcccactctcccgccaccgctggcgcgctcgctccacgccgcccgcctcctctcccctcccccgcttcttccccgcgcgccgctgtgcccgcatcgccgcctgttgccacgccctcatctacccggccgcctcactgaaaaagagatgagaaaagagaatgtgcagctgacatatgggccccacgtactttttaatatattttttctgactaggatgccacgtcagtaaaaccggacaaaaatactgccgagggacctccggtgaacggtttaagggagtttaggggtacacatttctggttttgtggtcaagggacctcaaaaaatctcgctgttaagttgagggacctctggtgaacttattccatctaaatatggcccataatcccgttttgctgtccctcacctttacgttgagtttgataaatttgtattcctactaaaccgcacaaaccatctaaattagatcccatagtaatatgaatgagtggttcgccgacgtggcatctagtcagcaaatgaataaataaaaaacatgtgtggtccacgtgtaagtggccaaccaaattaaatttgaaaatatactgttcattctttttcttttagaaataaaaaacatgtgtggtccacgtgtaagtggccaaccaaattaaatttgaaaatatactgttcattctttttcttttagaaatattgggttgcattctaaagaaaagaaatattcgggttgtaaatttttttttacaaataaatcgtcgatcttgcacaatcattgatgaaaatgatgagtgcgtacgtcacggatggtatcgtgtggggaaagtacaagaccgtctcgcgggacggaagagcgagaccgaacggttcggtctcattgattgaaacatcggcaccgtctcgctgatgcaacggtcccccatcattaggcccctcgcctcgctccccccgtcgccgagctgctcagctagctgcctgacctgatttggaaggagagaccgggagcacgtgaaaggagaggagaacagagagagggagaagatgggaggagagtgagggttgacatgtggggctcacttccgtttttgatacgtaagcgctagatcagtgaaaccggtcatttatactgtggaaggatttaatttaacccgattttataagtaggtatggctgttaaggatgtctaagacgtaaagatgaggaatgacaagtgaacttattccaaacggtgatacggttgtccagtttgggccgaggaatccaggcccaacaaggacaagagaagattggtttggtggggccccctcggcggttgagggctgctgataaaactcaacctatacttcagggacattaaatggacttgttctttaggccgcggaaggcaggcccagtgaaagaggaaggagaagatttggtttggtggggccagcacaaacgccggccgcaaacgaatccatcatctcgcaccacgcaacgccaactctccacgcgccgccgcccacgccgacgcgaggagcactcgccgcccgccaccgcgctctccctctccccccaattccatccctccacgccacgatcgccttccgcaaggtaaccgccctcccctcgccgccgcggctcggagcttgcatgcatgcacgcatcatcatcatcggctcatcgcagatgtagggtagggacggtggtaagtgcagcgccagcttgtgtggcgaaacctagagagagaacactgttacctgcagttccaactacccgttggattaactatccctctctgtcccataatactgttcatttttttggcctcttctgtttgtcccaaaataagtttattttgatttttgagtgatcattgcatcggagtttataaaaatagagaataaatgtattgagagtaagataaagttagcaataattgcattgtgattcgataaattatgggtattttagattttttggttttgtattttggtacgtgtgggatgaatgaaaaatgggatggaggtagtagcttttgtcaaattctcttcttttgggggcattgcatcgcgtcctacatgctttgatacattgccaaagcaatcacctagtcaatttttattttgtaatgagtcaatcagtaagtggagtggttgcacaattacgatgggccgcccaaagaacgaaccttgcagtttgtttgtttgtttgttgcatatatggattttcctttacatattgcaattctaacctaaaagttcactatacaatgggcccaaaggaggagccttgcaggctgcagcctgtttgttgcacgtggaatttgtttgcatattgcaatctgacctacttgaaatttcagttatttatttatgattctgttcctttaccttgtgagattcatatctttactatgcaggtttcttcttcagtgcacatgtgaaactgtacttcacctcccatatataattcagtgcagagagcattcttgaataagtatgaacccttattttgttggtcttctcgtcccaattgcggtatctcttctcctacggaagaggagaatggttgggaagatgagggcactgccagttgatgtgggtggagagcccgggtatgcaatccgcaactatcgattcaagcaaccggttgaaactcactgggaaggtgtcaccacgctcgccgagttgtttgagcagtcctgcaaggattatgtcaacatgccgctcctcggcaccaggaagctcatctccagggaacaggaatcatcactagatgggaggtcctttgagaagcttcatcttggagagtatgactggaagtgctacgctgaggtattcaagagtgtttgcaacttcgcatctggactaattcggctaggccatcagaagactgatcgtgttgctattttcgccgagacgcgggctgagtggcaaattgctctgcaggtaggcccctgtttcttcttctgtaattgtttcatatgctaatcttgtgtgttctatttctgtggagatgtgaagaaggaatgcaatggataaatacatagagcaaaattcctacgtagtgaaacatgcatagatagaaatgagtgttccagacaaggtttgtcctaagaaaccctgcaattgcaggtgttctgctctgctaatatgcttatctaaatagcggacaaccaacagtattcaactagtaacatcgtggcaaaaaaagtattgaagtagtaatacagaatgatagtgcagttctttatttaacgtaatcatgtaaattgagtaacggggtattcagatttgtcaatgggtggcacaacatttgattattatggtatgtgtgtaactgacagtggtaggttcgtaggtgtgacagcagcagacacaggaatggtatgggttaccgagcgtatatgtacatgctgtcataccgtgaaaagtatagtgcctcatgaagatactagtcattggaaatattgcacatgctgcatgcttatataaatcttaattggtttgtttaacatacatccaccctgactctgtttcctatttttcccccctattgctctctaatgttgagatcaaccttgttcctgttccattgagatctgaacttgagtttctctaagttactgttcttctatttgcaaggcatgcttcaggcaaaatattacagttgtcacaatctacgcctccttgggagaggaagcactgtgccactcactaaatgaggtaagtagacagtacagtcacttgtgtctcaccttgtctgtactgtagtctctgtcactaaatgagctaatttgcccttatgttctccagacagaggttactactgttgtatgtggtcagaaagaactgaaaaaaatgattgatataagtgggcagcttgacacagtaaagcgagttatctatatcaatgaggaaggaatctcagctgaagtttctttagctcaaaaaagcactagctggataattgagccgtttgaggatgtaggtagattgggagatacagcacctgttgatgcaaacatgcctctcccatctgacgtagcagtgataatgtatacaagcggtagcaccggattgcctaaggtttgcccaagcccacctgtttttccagtgttctcattttggaatatctttatgctacaaatttgccttttacttccaggactcatgttggcaattacttcatgatacacataccatgtgaaatatcagttaactgtattttctgcaaataaactaacatatactaaaaatgttttatagggagtaatgatgacccatcggaacgtcctggctacactttcagcagttatgaccattgtgcctgaaattggtaaaaaggatgtatacctggcctacctgccacttgcacacattcttgagttggcagctgaggtgactctaaaatagcatctatttacatcatcggttacttaagattaataactcactgtatggatttttttttcaggcactcatagctgctgttggggcttccataggatatggatcacccttgaccctgactgatacatcaaacaaaataaaaaagggaacactgggtgatgcttctgcactcaagccaacactgatgaccgctgtacctgctatacttgatcgtgttcgtgatggtgtgagaaagaaggtactgcactttaagctgtttcgtccaatgttcttcatctctttcttaatttactgattgttatttttcatattgggatggctttaggtggatacaaagggtggtgtagcaaagcagttatttgatgttgcctataatcgtcgacttgccgcagtcaatggaagttggctgggtgcatggggattagagaaactcttgtgggatatgcttgtcttcaaaaaggtgcgagca

SEQ ID NO: 26072 - DNA, 823 bp, Oryza sativa
ttcgtacattaaggtaagttttgtttttcttacccatattctaatttcagatgaattcgtttttggtagaaaccactgtgagttgaagtcttgaagatcgtccatatatgaaagaatatgttcactgttttggtttttgtgatcactgacaagctcatgctttgatatttgtaacacgctgatcttttttcagtaatctgattgatctccatattattctagtcactattatctgttggcatcacaccgatgcttgacatttttgtaattatattatccagctgattgactggtcagaaggtggatacttaacaagtgactccccaatgcctcgaggagagattgtcattggtggtcccaatgtaactaaaggctatttcaagaatgaagctaaaacaaatgaagtctataaggtatgttgtcttgttaccaatatgttcgatgactacttcacggctcatagtaataaccttctatccacaataatttacataacctttgtacctcatttatcttgtgaaggatgacgaaaaaggtatgcgatggttctattctggtgacatcgggcgcttccacccagatggctgccttgaaatcattgaccgtaaaaaggatattgtgaagcttcaacatggtgaatatgtgtctctcgggaaggtcagcaatagtcatgttctgttcagactagtagttgttagcccttcttaactgattggaccatcacaggtggaggctgctctgattgtgagcccatatgtggagaacatcatgatccatgctgatcctttccacagttactgtgttgcacttgtggtagctgcac

SEQ ID NO: 26073 - DNA, 6803 bp, Oryza sativa
tgccaaatgaacctgaatttgccatccctccacagtagccacccgtagcatatcaaaagattcagtccacctttctaaaataataataataaaaagattcaatccaggtgttctgagaaggaatcaggtaataacagtcatgttgtaccttatcccttttcaaaaacttattactgaacatatcccttttcatgtggcatacccctttgatttcctctcaatgagattaggactccaaatatgccatttaattaatagggatggaatggatcagatagggatggttgataaatatattgtatttttaacatatttctaagtagattttaactttgtggatatggaacagattactttgaattttgtaaatactatggaatcagagtggactcaacttataaatgaaccaataggcacgtacatataagtacaaaagtgataacaagcaatgatctgacatcaagcaaggatccaattagactctctggctcgcgagaaatctatatgatagaagcgacaaaacattagatatactatagaagcgacaaatggaatattggatatgctatgatggtgtacaatctattctatggtatatagaaaaattggattaacttggtcggacaatccacatccgacaaaatgaataccatattcggatcttaatatatccgttactacctgccgaatttttaaaaaggcagtcttattgaatcagaaaccgaatgaatcagaaactatccaatccgttttcattcataatggtgtgtaaatttttttcgatatatattccatgcatggttgtattactgaagaattccttgttcatgttcatatgagaacaaatgcgatgactagacaacttgcactcaccgaatctggctacttcaggagaggatgtcgagaagcaaaggcgtgccgaggttgtaggtttttctttttgattgttgtatgttctcctctgtgctcttgtatctcttttggctatgtatatcctttgtgcatatagatattagattaatgaaaatccactattaaaaaatgagaacaaatgcagctgtggcaagaaatttgcaatgtactactccctccgtctaaaaaaacttaacctaggaggctaggactatgaatctggactacccttatccagatttgttgtcctaggagtagtccctcctaggttgagtttttttagatgaagggaatatatgacaaagaattgaatccaactaattgtaccaactttaatacaagagacaactacaacggccaaaataaaactgaaaaaaagctttcttttcccatttttgcatcactcgagacggaaaagagagagagagagagagcaaactaaggtggtaaactattaacatatttcctaatttattaggaaagtacaacgcccttttcactttctttttccaaattgagacacgggagcagaacagttctagctgtccatcaacctgctgctctctcctataaatacattatagagaaattcatacttaaaaatcgctggtctgtgtgtgtttagtgtggaagcgcttaaagtgtaaagacatttttatgttaaaaaaaaaagagaaagggttgtcgttgtatctggctatctatatttgtacacatatcattacttaatgtgaagtcatgtgacatccctttaatttcctcccaatgatactgggactctccgaatgtgccatacaattgtttgggatgaaacggatgtgatgaggatggatgatcaatataacgtatttttaagtggattttactttgcggatatgggacaattactttggattttgaaacagtatgaagtcaaagtggactcaacttataaatgaaccaatatgtgcacatgcatataatacaacagtggtaacaaacaacaacctgacatcgagtaagggatccaattagactactaggttcgtgggaaatctatatgctagctagaagcgacaaaagaaacaatagacatgttagaagcgacaaatggaaccgtggatatgctatgatagtgtatgatccaatctatggtataaaagaacttggataacttgatcggataatccgcatacgacaaaaataaataccatatccgaatcatcatccatccgttgtaacctgtcgaaagaggcttttcaaatcctcactcggccacatctatccgaatctaaatcggattgaaccaaaaattatgccatccgatttcatgtatagtgacgcgtaaacttattcgatatatatttcatgtgattatattgatgaaatattctaaatttatgttcatacgacaacaaatgcagtcatggtaagatttagacaaataaactttataacatataacatagaagtaaactccacctaattctaccaactttaataatacaagagacaactatagcgggaacaaaaacctaagggaaaaaaaaagttccttctcccatttttgcgtcactcgagaaggagaaaaaagaggaagaaagaaagagagcaaacatctttgcgacattaccttttactgaagcacccctctttccctctcctgctggcatggctgtccgctagccacggccaacggcccacagctggctcgctcgctcgccgtccatgatatttttcctttttttttttttcatattactcccgatgatcatcctgtcccaaaccgcaccttattatcaaatgagtaaattttgtacaacttcatcatgtaagttatataaaaccgtgaacattttgacatgtaataaataacctttattacgatattaaagttttacaaaaccacaccattaaccgatttagcatactcctatatcaattttcttttgaaaaatattcatatagatgtaatatttatataatggataaagaacgtataaatttgatgtgtaattatagaacttgaatatacggtagactaaagtaaaaaaaatgatcaatggcatgttcgataaactttatgaccataatgtatggggttatgtgccgcgcgccaaaacagttatggttttgtgcaatttaggggttgtttagatgctatactaacattatcaccatttcccatactttcgtgccacactttagctaagttatggccaataaaaagtaggccacactttaattagctagcaaaataagagtgtattcttatactaatagttcatctcattttacatattctatcaatcttccctctttctctaaaacacaaccttagtatctccaaatgaatctaaaatcaccaatgttaataaacagaggggagggaccttttatctatatgatgtggtatgtacggatatgctataagaaaagtaagagtacactcgttgtatcttgctatctacatttgcacatatcaaaactttaccataccatattagacatctccaatcatccaaatatcttactaaagttatgtgacatatccctttgatttcctcccaatgagattggtacgaataaaatggatagaataagaatggatgataaatattataccattgaagtggattttaactttacggatatggaacggattacttcggattttgagaaacactatacagtcaaagtggacttaacttagagatggaccaatatgtgcaaatgtacaaagtacaacagtggtaacaaacaacaacctgatatcgagcaggttagactcccaggcttgcaaaaagtctgaatggtagaagcgacaaatgaacacaggatatgctatagaagcgacaaacataatagtggatatgctatgagcgtgtacgatccaaatcattgatatgatatatagaagattttgattaacttggtcggataatccgtacccgacaaaaaagaataccatatatgaatctttattggtacgtactaaccgtcggattcttgaaaagacattactggatccttgcttggtcattcttgtccgaattcggaatgaactgaatcggaaactatcccgttcgttttttatgtacagtgatatgtaaacttattcgatattcgtttcatacgtgatcgtattaattaagaaattgaaatttacgttcatactgcaacaaatacagttgtggaagagacttatagacttgtatactttatagcacaaaattaaattccacctaattctaccaactttaatactacaagagacaactacaacgggaacaaaaactgaaaaaaaaaggggctttatttttcctgtgtttgcgtcactccagacaccagaaaatgaagagagaaagagagccaaaatcttgcatcgtcatcttcagctgacactctttccctccccagctgaccctcccagccgagcagccacaggccacagccgtccatggtactggtagtcatctttttcccctttccatattactcccgatgatcatcatcccgtcgccaaccatattttatttataagaaatattatactctcctcaatctcttcttaatctcttgaaaaaaaaaatctagaatcactttcgttctgaaatggagggagtaactgtttaaccttatctttatagtgtgatatgtacagatatattatttaaaaatttaagagtatcctcgtaacttcgttctatcttgctacctacatttgcacatgtcattacttgacttataccatatcaggcatcccctatcatcaaaatatctcactgaagttatctgacatatggcatatccctttgattttctccccaagagataaggactctccaaatatgccacataattggtagggatgaaatggatgggatgaggatggatgatgaatattataccatatttttaagtggattttaactttgcaaatatggaatgaattacttcagactttgaaaacactaaggagtccgagtggactcaacttagaaatggaccaatacgcacatatgtataaagtatgagagtggtaacaagcagcaacctaacgtcaaacaaggtagttagttagactcacgggctcgcaaaaagtctatgagatagaagcgacaaatagaacactagatatactatagaagcgacaaactaaatagtggatatgctatgatggtgtatgatccaaccaatggtatatcaaaagttttggattaacttggtcggataatctgcatccgacaaaatgaataccacaacctaatcttcatccgtacgttactatctattggatcttaatttaaaagttaaaaaggcattaccgaaattctcatttgactactcttgtctgaatctaaaatggattgaaccggaacattttcatgccatcagagataaacttattcaatgtacgttacgtacacagtagttccgcatacatataaagtacaacggtacggtggtaacaagcaacaacctgacataaagcaagggtccaattagactcctagattcgtgagaagcctattgaatagaaatgataaatggaacactggatatactatagaagtgacaaatgaaacaataatatatgctatgatggtgcatgatccagtctataatataaagaaaacttggattaacttggtcgaataatccgcatccgacaaaatgaatatcgtgaccaaattttcatccttccgttactatctgcggatctttaaaaaaccgttaccaggtcctcattcggtcactcgtccgaatccgagacagaattaatcaaaaactatccatttcatttcatttcctacatatgggcacgtaaacttattcgatatacattccatgcatggaagtatcacatacatataaactacaatggtggcaaacaaacgacaaccaagcatcaaacaagggatccaattttacttctagacacacgggaagtctataggatagaaacgacaataccgaatatactgtagaaacgacaaatggaacactaatatgctaatgatggtacatgaatcgaatctatgaaagctagaaaacttggattaacttggtcggataatccacatccgacaaaatgaataccgtgaccgaatcttcattcgtccgttacaatccgtcggacctttaaaaagccgttaccagatcctcactcggtcactcttatccgaatccgagacggactgaatcataaactatccattccatctccatacgtattgacacgtaaacttcctcgatagacattccacacatgttgttcatgttaaccaaggaacccaagttcgcattcacatatgaacaaatgcagttgaggcaaagagatttggacaattatactttatgacacaaaattgaatccacctcatttctaccaaccttaaatacaagagacaaatacaacagaaacagaaaggaaaaaaagaaaaaaaaagcttcttttccccattttaacgtcactagagacgccccaaataagaagacccacatcctgcgtcggcatctctcacggaagaaggaaaaaaaaaaaaaagctcccctctttccctctcctgctgacgcgccccgtcgccgccgctcgcttgccgcgcgcggccaaagcaagcaagctcgccgccggccatccatggcggcggtggagggcggaataggagaggtacaagtatccgtcaatctcttggcttcttgtttttcttttctttttcttttatgggtttgatttttgttgcaaaacgagagggagttgtctaaagatagcatttcgttgccgagcagccgcccggattagccagggaaaggcgcctacggctccggcgatctgtggcggcgaccggcgacatggacggcgacggcgacgttggcggcggcggcggcggtggtggtggtggtggtgt

SEQ ID NO: 26074 - DNA, 4553 bp, Oryza sativa
gtcaggaggacacagaagctgccggtgacgcggcctccccgtaccaagcaagctccgcccacagcgcccgcgcccgggcctccgccgccgccgccgcagccggcgtcgccgaagacgaagacgaaggcgaaggcgaagaagccgaagaggaagagaagctgcgtgcactgcggctcgacggagacgccgcagtggcgggaggggccgacggggcgcggcacgctgtgcaacgcgtgcggcgtgcggtacaggcaagggaggctgctgccggagtaccgccccaaggggagccccaccttctcgccgtccgtgcacgccgccaaccaccgccaggtgctcgagctccgccgccagcagcggcagagcaccaacccctccactccaccgccgccgccggtgtccgccgccgagccaatccccgacgagcaaaaagaagaggtggtaagcgtgccagtcgccgccgccgcgcccgccaccgacggcggcgcggcgagctcgctggacgcgctgctgctcgacgggccgtcggcgccgctcatcgtggacggcgacgatttcttggttagttaggtagccagaaaaaaaaaagaggaataatttcagctgagaatgagatgaggaataccaatttttcgtttgatttttcaggaaaaacagttttaccacctgacattgtgaatactcgtcgatcctggggaaaatctttgcgtgaaatttagctagttttgctgcccagatgaactagttctggtgcttggtagctgatgaagttgaaaccggttttaatggatcaagggggatggatgttcaatgccaaagtatgctgcacttggtcccatttttagttaaactcaacttgtcatgatagttcattggttctaaaccacatttaggagatattatcctctttgttatagatttattggtcagtatttccaatgaaaactagatagcttcttacctctgttagttttaagtgattttttcccgtcgcgctctgcggtttctcgtatcctgtggacctccagcatggtgagcgaagttgtccccatgttttatttcgttgagcatgaaatttaatacacctttttatatggtatgtgatcgtcgttatgttttgccgccataatactggtggaattaaagcatataaaagtaagtggcatcatcttgttttgctcactacaatggaattaaagtgggtaaaagcggaaggtgaaagtaggtcgaggtaaggttgcaaggagcaactttgctcactacaatggagacccatggggcgcgaaaaaatgctgaaaaccagaaagaggaaggtatttgaattttcccaatttacgtacatttaagtcggcgtacgacaaaactacagatttagaaatgatttataaaaagctatatatttcaaaagtttttgtcaagacaacaatgttaggacaaaacatccacgcgtgcttttgtgataaacacttagttctgtgatactataccttaatatattataccgttcttttgatatgatggtattgtaaaatttcgccaatcatggattactttttttttcatctagacatcgacgtgtgatgtcttataacttgaaagttgaacttttgtaataaatttttgttgggaactcttgagctaaaggctgggatctaattccattattcaaagtagcttaaatatatcattttgggatattttacaccattatgatttagatctgtattttggtttgttcaagtatgcttgatgtaacatatcatagtactacaaaattgaataggtgccttttcatatttatggtattaggatataccactctcgtactagattaacttattttgaaacagatgaagatggagtatatatatttgtgtccttctgagcactatttaggtaagttgaatgcctcaatgtcataaaattcaaatcccaaggatgaatatgagcatatactatgtttagattcactactatgtctaaatttctccctggatctgatttttcatgggagggaggaaatacatgtcaattgccctggttgctctttttatccgaaatcaggatttgcgacgcaaggcattcaagagacaaatcgggactgtgcaagtgcgtggactttacattcttcagatagggcaagatgattgcagctagattctccaaactgaggcggcctatccaatttgtggattgtcccaaactgaggcggcctacccaatttgtagagattgcccaatcgcacaaaagcaatctgccaggcttgtcagatgaggaaactgctgtactaggaaccttttggaacttgcagtaggaactactcgtaaaagtagaaagatattattggttgagacgagagagcgatggagaagttttatattctctcatctcaaaaaaaaaaagtggctgtattctgaaacaaaatttatcgtaagaaattgctgtattttaagacaattgaaataaatatccttccagtgacacgctgaatttctacaagttgtatgtcaacaacatggtgatagaaggaatgtacgaaaactgtaccagactgaaaacaaccatgtgcgaatttaccttgcagaaatcaggaatcacaactcaagacgaataaaaagaatagaggattgagtgaacaaaagagtctcatgctcccattgcattacgaattatttgcttattcaccagattacatcactgtctagccagacccaaaaaaactgtgcataaataagattcagaccgccgccagcaccaccatagcgaaaaagaatggcaccacaagggcaaacatcccttggatacagatgtttttttgttcatgacccaacagaagaacagaaactaagacagaataaacccctagagctcagcttgtagtttcaggaatatgaaacaagaacccactaagggtttgcgtgttgaaacatgcctaatccgcacgagattggccagcgcgggatgacaggatgatgccgacgatgagcccatagagagcaagcgcttcggcaaaaatgaggatgaggatcatacccacgaacagctttggttgctgggcgttcgccctgaagacaaagaatatgattagaagtcaaatattataagtagtaaaatcatcattgctattgcatacatgccaacaacttcacatatcaagccacaaactactacaaaagtaaaacatgtttattctagataagactttgaggctaacgcagttcttaatatcctcagtacaaaatatcaagccacaaacaagttgaagaaaacttttgtgttgacttttagaaaaatttaaagcctcaaataactccacttatagttacacgctactctaaagaaggggtttctttgacaagaatatctaaacaattttaggtgagaatgttctcacgtgctgatgtgcggaacctctcttcaggtaatcaatcgtaaacatacaaataataaattcaagccttgtccagtgttcaaaactttgaatatgtttagaagaatagagttaacaaattacaaagcaacaaaaatgtacagaaaagatgccatatgaactatagaatttattacaaacaggtatgaaacaaaagttgaaatagtggtataaatcagcacatcataattcacaattccactgaacactgtattagtcataattcacaattccactgaacactgtattagtcataattcacgattgcacaatttcactgaacactgtattagtcagtcacacagagaaaataaaaggataacatattgtgctactggacccctaacctcaaaagaagaatctagggaataagtgagcctcttttagtcagatttgtatgaattaggaaaggtttctaaaataccaaatctaatattcatgatgtatatttaaatagctgtatgaatactatggaacatttcatatcttttggtccatggtggataaatacatagaatgatcctattataagcatcagaaactttgggtcgataaagaatgatccatggtgtcaatgtcatcagccctgtgaagatgttaacaccgaagggatttaatccacagtttgacagcatggtcctaaaacagctatagcacagtaaagcctgtgcaatttaatagattgaagccatgattaaacacacattcaagcttagcatttgacagtgatagcagaaagtctgctagttaacacacactttttaacacacaaaagtgtgaatttgatatatcaatgtaataggcaaagcataagacagaagctcccagaaatgcatagtttgtcatatacaacgtgttccctaaaataaaatgcatagtttgtcatatacgacgtgttcgctaaaatgataaaatctaaaacatatacaattaggtacttgacggcctaaaagattgttttcgcatattcacataaacaagtatacacttgcaaatgtaatacttcactaatagtttggtgcacttttcatctcctgatctaatcacatgcagatagattgacaataggcaaattaactatactaacaactagcaaacaaagttaatgataatcacaaataat

SEQ ID NO: 26075 - DNA, 10776 bp, Oryza sativa
ttcgcctctcctcctgctctaccgccgctgctgctgctgcgatcctttcacccgccgacgaggtcgagctctctctctctcttccttctccggtggccgcgagcagcaggaatggatcgatcggtggtgggattggggctctcgcgatccgatctgaggagaggagaggagaggagtgcttcgatttggggattgaggaggaggaagacggaggtgggagaagaggaaaaacgagaggcgcacgcggcggcgtggctgggtttggacggttttgccctcgtgaggcaggtagaggcaaggctggtggtttgtcttgggttagtaagggcatcactgtcttttttctttttcttttttttttgccccatgtcacaaagagataaaaagttctttttggctagctactactagttcgagataataaaatcctttgttaggccatcttccattttcaatgtgcatgagtttaaaatagtaagacctcacttatgctatgtacaacagtaattaaaaacgtgtttttttatttttaacaaaaataagttgctcgttattctttcaacgatccaactttaccgattttacgttggtgcaagaaaatttttataatggtacatatgagatagaatgttaacctcaattgttggactaattttgaattttaactgttttgtagggtatctatagttcatttcccatatttgacgtgcaaattgttgcatttttttttaaaaaatgcatacttagtgcatatgtcaaaagttgttgtcttttggccttgtgttatttataaatctaaatctaaatgaagttctactaggttcagttataagtttataataatgttgctttcaagttgcaccaacatattattaccttccttctcaatttaagatagcaattggtttcagatgttataagatggaccatatatctgtagacaattttgcccctctgaaagagacgtatttgctggtgcctgggcatcaggggcagtatcgtcaactcacaaaatgatttattggggttactcgtcgccacgtccgtggtttgccccctgcgcccacgtgtatgcgcggccaccgcgctgacaatccgattgggtccatgggacccacatggcagaggccccacatgcagctgatgcagcagaaatgctactaaaatttcacacatatatatttttgcccttttttttggcaccatcatacagaaactatttgtcatataatgcatacattttcacttaatttttgttccgctaatcaaacagtttctgcaattgatctaattttgctctcgtccttctggtcatgtagctacattgttctccctgacacaaatggaagaacagcttccgtgctaacttaaaatggattctcttcaatgttggagacttgatcgaagcaatgatctgaattttctgaattctgacatacatacagcctacggatttaatctttcttgaggagatcgtagaacacttcaggcttcttgtagtgcttcttgcacgcctcctgcaaaaataccaaattccagagtaatgataaacacaactcacatttttcaggtgtctgttcaaaacaaatgcaaatactaatttcagcttgaaaggaaaaaggctgttaattttcacttgcctgcattgcaaatgctatgtggagcagagtcgcctcggaccacggcctgccgatgaactggaggccgatgggcagcccggctttgtcatacccaacctgacagattgatcacaacgttgtagattcagatatgtaggtttgttcatgctgatagaagctgtaaaacaagttcagttatttgctaccatgacggtgatggccggcaaaccaaggaagtttcctgcaattgagtaccggaccaacgcggctttgatccaaaatgcatggggaacacggttaggataaattgtactaggtgtgaaattattgagtatttttctcctgaaagtttggttcattacctccatttatgtagtccagttctccgctttttagcgcgtcgtcttgcagcttgtaggcagtcacactgcagaaagatttaaataaggtaggatgaacacactctagtgaaaacaaaaaagtacacagagttttgaatcatgcatattatggcataatgcttttctgaattcagaaacggtcactgtagcttatcatgacaatgtcgcgagtgccaaaattgctttccagatttgatgagtgagaaatgtttcatgccaagtgattcatgtgaggttatctgaacagaatgggtagaggagaaagatgaaaatacccggtcattggtgagacgatcacgtctgccgtcttgaatatctccttgtggaagtacatctgacgattcctgcaaacatggataggctagcagttcagtactaatataaacactggatcactaaattgtcatgtttacaaggtattctgttctgatgatagcttcatctgacaaatgtgaactcaccggagccgttgcgaattcaggtaggctctactgctgaaggaaccatacacgccaagtgcgacccttacatcccaaccgatttcagatctcttcctgacataattcacacaagttatggtcagatcatccacaggtttattgcatcaaagccatacaaataacattattctgataactcacagcttgtcaagatatttagcaagtgatgcagtgcattctgaaccaattgtcacatagtgcgcaaggcgcatctcttcgatctccggtatggttacatccagagtcttgcagcgagaaaaaaagaatcacaagaacaaattaatgagttcttcttctgccaaaccaattgagctatcatagaattcttgacaaaattgctagtactaaatttctaaatgccaattcaattagtacttttggccacagtaatcttccttacctcccaaccatagtgcgcatgcagcatctgaagagatttgtcgcagcagcttctgatgtcctctgaactgtcattgaaccactgtttccatcgcacaattaccacaatgttcagagttaattcgtaccaaatttatttgcccacttcactcgtgcaataatctcactgacctttgcatattttgcaagcttgatgttcttgatggagagtgaagacttcagcaagggcagattcaactcaggctgtagaatcaaaggaaccaactaagtcagcaattctgtatagattaatcagtactcaccaaaactgtaattagcaaggtcaattacccgcaagtaggatggctgagactgatcaacaattgctgagtatctggaatcaaagaaccaaaaacaccacaacatttcaactcaactcctttgagagcacgcaatgtagtacaatgtacatcaatcagcacatgtacaactagttaatcgcaataattaaagatggatttgtgaaaaaaaatactacatcatgtttttttttaaatatatgacgccgttgactttttacaaacatttgtccattcatttttattcaaaatttttgtgcaagtataaaataatttaagtcatgattaaaaaacatttaatgataaattaaggtacagtaaaataatagataattatatattttttttaataaaataaatgttaaaacatatcgcaaaaatcgcgtcatatattaaaaaacggagagacagtaattaattaagaggtgtagtgtgtcactgacgcgacggcggcgtcctcgaccgtcccagcgaggatcccgggcatcccgaccgtccagttcagcggcagaactccggcgttcgacagccgccccgccgtcggcttgaacccgaccacgccgcacagcgccgccggcattcgcacggaccctgcaaaaccgcggcggcggcggcggcggcggtcagcgcatgtgcaagtcatcgaagagatcgagaccgagcgtgggagtacgacggtttgtttacctccgccgtcgacgccgagggcgacggggcagaggccggcgcagacggcggcggcggagccgctggacgagccgccggagacgcggccggggttgtgggggttcctggtggagccgtggtgcgggttgatgccgctggtccccgcgccgagctcgtgcatgttggtcttgccggcgagcaccgcgccgcacgcgcgcagctgcgccaccaccgccgcgtccgccgcgcacgcccgcgcccgccccagccaccgcgtcccgcctgcatcaccgtccgatcttcatctcaccgtccagtttaatcagagcatatatattactcgctctctttgttcatattataagtttgcttttattttttaaaaagttaaactttttgaaagaatttgtaaaaatatatagtacgaagtaacatttatagcatcaaattaattttattaaatttaacattaaatatattctaatagttttctttagttcaaaaatattgctatattcttttgtcaaaacttaagaagtttgaaacggaagtagtaattagtactaattgttttttaataatggaatgaatttcacccttgcttcaagaaagctatagccaattattacaaaatccgttcaacaaagagcatgaaaaattcagaaaataactatacacaaagtaatgaccaccgacactaaacaaagacaaatattattgaaatctatttataaatctttaccagtagttgtcaaatatctgcataacactttaggtttttgcatgcaggatgcataagtttattgtccatgtcacgctattgtagttaattactgtgattaattagttaattactcacctgtggttgggtagggcaaacagtcgatctcgtccttgacagcgaccagtatcccgtccatggcagacagaggtgtccctgcgattaatgtcgaaattaacagatcatcagtaaatataattatcacaagattaacgcacaattaagctatatgtcatgtcctgtctgtctgtctggcaccattctactgcactgcattgtgatgcaaatagctcttcttttgtcacaatttatgtagtggagtatcatactagttcataactgtccatttctaatcagattttgcatctgaatgtgatcaccgacaagcctaagaactaaccttgctagccataataactctggaagaacactgattgatctgcaaaccaatcgtatgcaaagttaacagctaactaatcggtgagacggccaggcaatgaatgcttgtcttcttagccgtctttacagttggatcaaaacatcaaatacagccagctccaagcctcccctgtcaggctgtcactgttcccttaatctcttccatcataatctccctgtaaatgtaaatgatctgaaccataccataatgtgacatatgtgatgctaattaccaacattaacatatctccattgataatgtcgttgccctttttcttgttcagagaacaataaatgtaaccagctccagcagcattaatttctgcagctccctttcctttctgtcttcctgtcttccttccattgtggatcaaccattgtgatgttttttttttcaagatgtcaaaacagaagaaaaaaaactgaagaaattgtttggagtgttgcttgtgtatgtagctgtagttgtactgcctcctggttgttaccaagtgggtacaaaaaagtttggttggctggctagaggtcaagacagaaaggtggtggtgagttggtttgagagggacaagttcaggccattcctgtgtgctgctgcttctgctgatgataattgcaacttccatgcattgctcttgcttcagatactgttactgccaactgtaacttacatgtcagtgtaaaagaatgttctttttttttacctctctggtatctcagggtggattcttcagcctgcctgatgatgtcttcagggctgtagctgatgaagaaggccatgttgaggcctgggcctgagcactccttcactgcagccaagaacctctttgcaacctgcaacaatgtagctgttcttgatcatttcttgcaatttctagtattttatcatgtgttgctacaattgccaattactaactactagtactcttcagtaatgtattcagacatgataattcagttactagtcaaggaaagagacatgtaaccatattattaggcctaataagtttagctactaatattttaaattgagaacattgtagctatccatgcaaagattgattacaaaacctgaacaggagtgacctcccctgagctgtacgccctgttgaaatccctgatcgtccagcgtttcgggctcgacggcggcgagccggcgagggtcgattcgaggctcgcagggaggcagctgacggcttcctggacacgctccggcggcgacaggtccggcttcgtcaggcacacattctgctctggaatgtctgcaggagatggatggatcaaacagtgtgtgtggttgttttcatcagattaactgaagaagattttgtttgtcagagcaggaaatttctcgcagagttcagagaagttcagagaaacaaccttcccagctgtgtgtggaagtgaacagtggaggctctgggatttcagcatcttggacaagctgcagatgatgaacagtagttggtgagatcacaaagacagcagaaagctgtgtcaaatcagagaattattcctgtctgcctgacactgctcaacgaaagctcagaacgcaactaacacactaagtaccagttgctgatgttctgctactactagttgagatgatgaaaaaaaagagcatttctttttgggtgaaactcctcaatagttctcgctgaaacctagtagtaacagttttgcatgcaagatcattgccagaatcaaaaggagtttttttttctctgaaaaaaagagcaaacttttgaggagaatttgagcagtgttgcaccttgttgatgagattatccttcttgaggatgtaaagcaccattgagccgatgatcggcatctcaagaatccacacgaagatcttcaccagcagccctgctacccgaggagctgaagaacaagaagaagaaaccaaaaaaagaagaaaattcagactcaacttcaagaacagagaattcagaatttccaagaaccgaactccagaatcaagaactagctggatgcaagggaggatcgaacctttgacgttagggctgatgtagaactcgtcgctgtccgggccgagattgacctcggcggccggcttgtacaccttggcggccatggatggcaacttgggaagcaaaggagactctcctctgcacaacgactgctgctaagctcctcccttcctgtctgattactgacaagaattggtgccttttatacgacgacaagacccaagatgaacggcaaaaacgaggagaaaagagaaaaaaaaaaggtaattgatttcttggtgaagaattaattaatcagagagcaatggacaaaggcatagattgtgacagagagagagagagaaagagagagagaggtagtggcttggattatgtatgataaacatacatacataaagtgtttggtgtgtgtgtctgtcagtgtgcagcaagagagaggaagagagaatcactgaacttttcaggttccaaaaaaaaacaggaaagaatcagtgaagtttcttgctgcaaatttggcggggattttggaggagaaatggttgcttcaatgcttggtttggcttgtgccaaagagaagctagatctgaattgtgtattactcctacatcagtattaggtactcatcaatgttagtaccatcaaatttaatagagcccaaattgttggaggcctagtttaatctttaattttttaaaacatcatttaagtatgagtatattactagtctgttcttgtgtacaagctaggacgatgtgtaatcaatcttaccatcaaatttgtcaaaattatgggtggctagtttaatctttatatttacacatcaattaagtacgagtatagtaccagtctattcttttgtacaagtaagttaggacaagatgtaaaatgtaaataaagatgagcattggcttcatcctaagctctttacactccaaagatgttatatgtttataatgtttataaacggagaggtttaaatttttttaaatgaaaataagtcagaatttgaccaagaaaattataggtgaaaatagtgtaaaatcagctacatgtacgcaaaattacaccggctttactgttatcgtttggtaatattacgcttaatttatacgctaagtttcttggtcaatttctatcggctttggtccatctcaaaagatgatgcccaatagtttttcaggttcatgttactgtcaaaccgaaccttctattttggttctggagaataatttttatgtcaactatattcaagataagcaaaaaagaaggcattaaaggaacatctctgtgctacggttgcattacgtcgattcatatcgcatcaaattaatacaacttctttcaaataaaaggatgattaattgagtcaacgtagagattaggatgagatgttgagtgtgtgacctaaattcattagccacttgacaggatttattacgtttagtgtcaccatctcttgattttggaatctgtccattactaaatgtttttttaatgctaaacaagagaaacaggtgaagcttaaaattcctaggaaacccagatgaacaattgtgaatatcttgacatgaggaaaggcctttttttttatcaatggaagtaattattttatttgaggtgaaacaccattaaagaagaccctaggtcattatccaccttcaacatgtccctaaagtaagaagtttaacaacctctctcccaccaaactcattcacaagttgtaaaagaaaaaacaataaaaacctatatgctgcacccatattctacatgaatcagcaaccaataaatgttgctggttttctagacgtgtagcatacagaaaatataggcatgaaattatgcaaaggagatcgatcttctggaagctcacataaaattaaaaagaaaaaagaaaaactgagcaaaagggatgcacggatggaagctaggaaaaggaagatttgggaaaaaaaatcagcaaccaactattccagcaattgattgggctcacttgcatcgcatgctcaattaattcctctctttcacatcctatccttccaaagatggttaacctaaaaccattcaattagtacctcttctctcaggcattaacttgcctactatgattaaaccctattgtatgctcacccaaaatggaggctggtttatgcttgtactgctatactttttgttgatttgagctatccttaattcattattgaccattgattgcagacagatccaacccttgctacgacaagagtaattcttgccttcttggatgcattgatgcatggaagctgcggtgtggtgctcactcattttggcaatgatttgtgattctccatctggttccaaatatatgacttctagatgcagttgaatttaaaaaataacataaataactttgtttccatttgtttatactacattgaaaatataaatagtacaatttatttagcaagggaaaacaagaaaacaataaaaaatatatccaaaaaaatcctaaaacatctcatatttaaaaaagagatgagaggatcagagtacaacttacatttaaaattagaggaagtgtggggtggcacttcagcacaggctgaatgctactggagccaaatttgcatcatgctacagactgctacttataccggccggtagaactacgtccttctcaaaattaatgtttgtccatttttcccattatgtgtacttccagtatttatcaatgtagagaaaattttaatagaagcgtctaatatttcagtcttaaagaaaaggacatatttccacctcatacacgttttcttgaaaagttcaacacttaaatctcatgcaataaaagatgcaactatttaggcaaatgtggtatactatcaattaataggtacatttatgaacattccctacaattttttttgtcttaattagattctagtgcttagtgggcatggtgccgactcctttcgttacttataaaccttatctattatatttttaaaacaacttgaaaggaggcactatatttgctgcggaggctagaaatttccacattaatcggagaaaaagaaaagaagagtccaacttaaaatacaatttaaaaataattgaaattcggaattaaaaataagcactattgaaaggagagtccttataagaacccaatacgagattaattaatattcggtataaaaaataaaataaaatccaaaattagaaaaaaaaggaaaagaagagtttgagtagaaataaaatttaaaaataactaaaactttgaattaaaattaagcaatagtgaaagaagagtccatatagaaacccaatacgagattactaaaattcggaataaaaaaataaaaagtcaaaattagaaaaaagaaaagaaaggaagagttcgagtagaaatacaatttaaaattaactaaaattcggaattaaatataagcaatattgaaataagagtacgtataagaacccaatacgagattaactaaaattcggaataaaaaataaaataaaatccaaaattagacaaattaaaaagaaagttcaagtatgaatgcaattttgaaacaactgaaattaaaaatacaaaataaaaatattaaaaggacacaatacgatattagttaaaattcgaaacaaaaaatagaataaattctgaaag

SEQ ID NO: 26076 - DNA, 2787 bp, Oryza sativa
tataacacatgcaattattatcccagagaaatttgtaagagactgaatttggacatttcgttcaatcaggcagaataagtatgattggtaatatggagatcatcaattacacagcaagtataagccgcacaacacaaatacaccacaatgtatctgcacttctgcagtctcacactgatactgagtttacatttttcttcccattttttctggcaccaaaacagccaacactgatacagtaaaaatctcatcaagaaggctgtgaaaaaaaaactgagcttgctggaacggaattcagcacacagaatctacaatcagtttctgtaaatgtacactgatctacctacagatgagagcatccatgaactgttagtagcatctggacagtttgttttcaccagctctttactttcttcttttgcttctgaaactactaagtgaagacaggccccctgcaaatactgacatttctgaaggtggcgaagagggctggatcgacggtaacggcgaaaagcagctgctgttgacctttggaagatcaaaatcatataactcatctgcaaatactgcaaagtcagcatcactatttctaaaatcgagcggcatttctctgatttctctgggttccagtctctcaggctccacaatcgtattgtcgatgtcggtcaatgatttcaactgacggccgagagaagctatggtcttctggcattctgcgagcttcccagcagcatttgcaagttccttctcctgtgacaaacacaacgatttatagttggatccatttcttgataaataccaggcgagtgtgttaagccaagggtaaatggtgtgatgtaaattacaagacttcagtatatatatacctgcttggccttcagacccccatttgaatttgcgagtcgccagagcttcgcgtcccggctatcccttgacagccgagcctccagcttgtggtattcttgttcgaactcttctgataacaatctctcctgtaacacctccccttggagcaagctcaccttgtttgtcagctttccaacttccatctttgctgcttcaagttgttgcttcatggcccttctctctgactgcatggcttcttccttggctgtgaagtccaccgctgaagacacctgttttttcagttttgcttcaaaagacttcaccttatcattgagctttctgttatcctgatgtgcagactcaatctcagactccaacaccctttttattgcctccagagcttctagctgcatttggagctctgcagaaaatgttttctcctttaccacctcatgctcaagtgcagtcaccataccgcgcagctccacaacttctgagttcactgactggagttctgactgaaatgattctttaatagcctccacagaaaaagttctctctgcttcgatcttcgcctccaactgtgctgaaagatcttcatgcagtgccttctccttttctacctcattttctagtgctttaacaatgtcacgcagttttagtacttcggtgtttgatgagcatagctgtgcctccattgattccttaacagtctgaacagaacgagctttctcttcttcaaacttcacctctaactgtgctgtcagttctttatgcagcgccttctctttttctatatcgttctctagtgcctgaactatgctattcagtctctctacttcagtgtttgctgcacatagttgtgcctccaatgattctttaatagcctcgacagctgtttccatcttcatttctaattctgccacgagttcttcctgcctcatcttctctttttctacctcatcctccagttctttgacaatgacatgcaatctctctacttcagtgtttgctgaatatagctgttcctccaacgattctttcgcattacatgcagccactgcttctgcttgatgctgcacagaaagagacctttcagcttcaatcttctctaataatgatgttacagtcaacgaagctctttggcttccgcagacagcagttctaattgtgactccaattcctttttatctgtgttttcttccaatgaagccaccacctgaagtaactcctccactcgtacagatttagactccagttgaaactccaaagccttcttctctgagttcaatccctcaaaatccctcaaagcatcatgcttggagtcatttgccaagtccaactccatttgcatttcaactagcctgttctttgctgccactagtgcattgcaggagatgtcaagttgatttcttgcctccattagtgccatctcaagctcctttttctcactttcaatcttctcaacctgtgcatgcaaatcagccacctgattcctcaactcttcagtttcaagtttagaggagctgtttctggtcacagctttatcagaatctgtttccatatcgaaggtagagcttgtgcgatctgattcaggcaatgcagctaacctctccatctcaaggaaatcatccattagatcaatcacaacaggattgttcacaagatttttctcatcagcatttccattcttgaactgatcaaactcagctaccagagcagatgcccatgagtcggaattccgcagttcattatcaacagcagccatgcgttcagcactgtcagattggctatcagtaagtgactccacacaagtattgtttgccagaggcctagaatcattaattaatgttgctttgcgagttagatgatgtaatctgcggcattctgcttcaagccttgcaatttttttcacgttttccaaatgttgcttgcttgctg

SEQ ID NO: 26077 - DNA, 960 bp, Oryza sativa
tcatttcagccatttctggtaatagaagtggggaaggcctacctccctttttccaaaaaaaaaaaagatgttatagaaaggatatatttacccaaaacagcctcttctgtgactttagcgtgctgcctcaccaattcctctttagcattaattgtcaaaaatgcagcagcaagtttatcattcaaactcttcaagttctcctttacatcttcatctctgacatttgaagatgactgtggctctgatgattgaccatgccgtggagaagaatcatttagtttaaatcccaatgctaacttctcattcgagggttttgtgactccaatctcttgggtcccatcatccctaacccttgaaggcattccaggtgattggccaagatgtggtgaagcattgtttgagacaggcctcagaacctcctggtttaacatgagcaaacaaaattcgaacactcaggataaatcatttattatcattcagaaaaagaaataaaacagcatccagatttagcaaaagatgccatatatgtataaattatattacaagtattaactatttatgtccatatttagtgctattaggcagctcatttaccttcatacaagaaaacacaaacaggttgacaaaaaggtacatcaatatagactgttgcagaacttaatagttagaaccttgaaaaatatgcatagatttcaagagcatcttacaggagattgggcgaattgaatttaattgtctttagttggcagatactattcagaataaattttaaggaatgaattttctcataattagaagaactctcttggagttaactgaacagggtacttaactcccttaaatactaccagcatcattttgtctgttcaaagctttttctttgcttgcacggaaaagggcattacaaatattatgaaacatcggcacatcgctacaacattttcattaatagaagtcgag

SEQ ID NO: 26078 - DNA, 4435 bp, Oryza sativa
tatcctgcctctcattttcttaaaagctaaaaaggagatttgtttataacactagaaagagaatggctacgactaaagaatgtaacaaccgcgacgtaggtccgaaaagaacatagcaactaaactgtcctattgaggtagaaagaactctagttatacaaaacaaagtcatcagacatgggatagaacctgatcatcagagtagtgctcagaatgtgacgacacagacacggtgttctcggcgcctcccgggctcttgtctgacggcttgcgcctccagagccaactcgttcgatccataaccatcaactgttcaacagatcagagctgaaacccctgatttcttaattaccaccgtatgctgcttttcattgatcagcagctcgcccagttgcaggttgctggtctggatcaaacaacatgcagtagaaaattagcaccgagaatgataacatttgattgtgaaagacgcaacatcctcaacacactacctactataaagaaagaagaatgccgtgacaattcacaagcacacaacctttttgcattgactagtagcccacagcacatgctgcaagactgtcacttatttcttttttcagcacaacttggcaaaagttaaatcagactagcattcttactgacactaaatccaatcagaaacaaacagtgccgagaaaacaaagagatcaaaacattgcaagagaagaacaatgcatcattgtaccaaaaaaacagtggaggtaagatggaatttatcaccattgatacccaatcaaaccctgttgttttactagcatgcttttgcagtagcagcaaataaaacagtaaaaaaaaagtaagtgttttttcacagagagaatgtcagagtgcaaaataacagtagccaccgactactcgcaattccccaagagaacccaagaaaccagggtgaaaatccccgaaaaagattgcagcttgacgccgaaattcctctcgaagcccccaaatcaagaggtattcccactaaatccggcggaagaaagagtaacaaaaacagaaagaacaaaaaaatattcagaggaagcgaagaagaaattccatgagggaatccaagaacgaagcgagagggagcaaaaaacaagcagaggtagagcaggaagcgaggagggatggcgggcattaatacctcctcgaattcaacgactacacggagaagacgggaatgcctcgcatcgcatcgcaagaactccgtgaagaacacacacactctctcaatctcaacaccacatttcttcttgcttcccaataactctctctctctctctctctctctctctctctctctctctctatctctatcctcttgagctgagctgggggggagagggggggaaaagcgcggggtcacagctcacgcgggcagatcggagcaggaggcgagctcaaaagcggaggggaaagaaaggcgcggggtccaggccatggccgccaccaccacctgcagctttcaccatgtgaggccagtacagctatctccctcctctcgcttctgcactcaactctccctctcccccgagcagaataaatgcatcggggaaagtgataaatgcaacacagcatccaaagctcaaaaagaaaagaaaagaaagaaagaagaagaaaaaaaaacagagagatttcacgacgaacaccgccatcgacgaggtcgaagaagaagaagaagagctcacctgcatcatccgccattggcgacccgcattaccttcctccttcccgcgcgtgcagctcgaatcggggaagaaaagctcgcagctttctcggatactactactactacttctctctctcctacccccactctcggagtataatagtgcagtgttcgatgcaaccaccgggggattaagattaggattagtagcagtggcggttgatgatgattctgtgtttcgctgctgctgctgctgctgccgactttggcggattgattgcgagattccagcgacgggtttttagctaattaattaattaattaattaatcagaggggattaagagtaggtacaatagcacactattagccagctataaatatattttaatgagataaaaaataagagagaagagcagcgggctacagatatatagccagctgcagcacggactccaagacatcgtgtgtatgatatgtgggaccacatatattaatagtgtagtaagcaaatattatatgaattaactattacattgcttagggcagtcccaacccataacactagacatagtttccataaactccacatcatcaataaactagtacggagtactagacactactcttgcaatgcaaacaccactattccatacttgaatttaatgctacttatctcacatgatgtcttagatgtggtgaagaaaccatgtctcatgcaagacatggtttccttctctttcctcatttattcacttgccacatcattttttatcctaggtggcaacttatttaatgctatagacacaatcctagtcattgggttgggaatacccttagagcatgtataatagcaggctattagccagctataaacatattttaatgagataaacgatgagagagaggagtagcgggttacagatatgtagccagctgcagcacggagcccaagacacactgtgtatatgacaggtgggaccatatattaatagtatagtaaacaactattgtatgaattggctattagattggctatagatgaattggagctagtagtgggctgtactattagacttgctcttatagatgaattgaagatagtagtgggttatactattaaccttgctctaatcgctgtgttaagagcatgcccaacagtcacccaatatttgattcccaaaaaatctgaattaggaattccaaaataagaattgggcccaacaatcaccccttcatccaagagaggcccaaaaattaattccctatcatttgttagtttgccacataagcaaggtgggcctagttcggtaccgatcgatcgtctccctccccgcaccagcgccgagacttctccctccccgcactttctccctcccacaccagcgccgccatctgtgtaaatcgcatcatcaccagccaaccagtgtcttgagtgcttcggtttctacaaaaacggaatgccaaggatatgccatagctattcgtgtcatcaaggaggtaatccctagcaaatcctagtgatatcctgtgccatagtcaatatcggtatctagttggtaatgtggagatatagtgttggaaaatattcagtttgatataataagtgattgcatagattgataaatgtagtattcctgccatcggttctctccattgcacttcatccctgtggtaaacgctccaaccctgtggcaataaaaaagagaagatgagtcgtcgaagtaccctcctccaaatgctattggatgaggagtctttatcggatggcgacgaagaatttatttctttggcggttgatatagtgcacgatgagttcgacgatgatgaagttccaaagcgtggtggatctgttataggtcatgcagtaattaatcgggaaagattggctggacatcggagattatataatgattatttttctgaagaacctacgtacctcgatgttcagtttagacgcaggtttgtagcagtgctttgttttgacaatatttgtttgcaaaattgatattaaaaataattaatatcgttaattactatgcaggtttagaatgagacgacctctgtttttacgcataatgaatgctatagaagcacatgatgaatattttgtgcagaagagaaatgcggctggtgtgcttggactgtcatgtttgcaaaaggtaacagcagtgtcacgtatgttatgttatggaatagcggcagatgcagttgatgagtatgttcgtattggaggtagtaccgttattgagagttttaacaggtttgtggtggctattgatgaagtttttggagaggagtatttaagaacaccaaacgagaacgacatagctagattacttgctcagggggaagaaagagggttcccaggaatgttgggttctttagattgtatgcattggcagtggaagaactgcccgactgcatggcaaggccagtataaagggaaagagggagttcctactatagttttagaagctgttgcctcacgtgaccgatggttttggcatgcgttcttcggttcacctggatctcacaatgatattaatgtccttcaacgctcaccgctgtttgcaaagctagctgaagggcaggctcctaaagttaatatagtattaacgggcacgactacactatggggtactatcttgcagatggtatttatccttcatgggcaacacttgtgaagagcattaagctgccacaaggaaataagagaaaatattttagcacagcacaagaa

SEQ ID NO: 26079 - DNA, 580 bp, Oryza sativa
aaggatgttggacgagcatttggagtgcttcaagctcggtttggtatagtacgtgggccagcttcgtttttggaaagcacttatctgaatcagataatgagagcttgtataatcatcaataacatgattgtggaggacgagcgcgatggtgattttgatctagtttatgatgagatgcgagaacaggtgggtggttcccatgaacgtacgaccaactttgatgattttattagtcagtccggaatcattccagacaaggtagttcgcgaccgattaagggaagtcctcatcgaacatttgtggaatcgtcatgcagaccgatattaattttacattatatattcttatagataatgtcatagattgtaataattgcatattcacagcttgtttttaaattagtacatattgagtctatagtaattatttattgacaatgtgatttattgttgaattcgatacagtacaatagactgaaaaggacagcagtgcatatcctttttcaggactggatatatatacaggatatacaccacaagggtgtacatcagaatatgcactgctacatatgcaagccgat

SEQ ID NO: 26080 - DNA, 1596 bp, Oryza sativa
atgtgtgtccttttagtatattaaagtaaaatttatttaaggagaaaaataccataaaactcttaattttctgatagagaattaaatgtatatagcacatttacatcgttgtcggcaacagtggcggacacagttttaaaatatagatggggcggagaataaagatgtttactcgataagtaatcgaacacaacacatatcatatttatatatcaatcgtatacttgtctcattattgtttgtggcgtgtatgcgttgtgaagagacagactaatatattggacgttcacaccttgttatacctaattttgatggcctataactattgtaaggggtaggaagggtcttgggggtgtgaggcgacacgggtcatagctgggacggtccacgcaccctacctaataggtagatccgcccctggtcggcaaagtctacaataggaaaatatagcaatgtcgtctttaaggtttttgtccaaccaaagacatactaccacataaccagagagggaaacatgatgagtagtgacacgtgcatgaaagaacctaaagcacacacatgaaaagggtagaaaaggttgacccttttttggacaagatgaatttgtattatagaatttttcacataataaaacatctcaatttatatggctttagtttccccttttataatgttagctagagtagatgatgttaaacctccatagttacatgttaaacctcaatgcagttgatataaacaattttgacttctctgtagtcgatattgctacttgctagtaccgtcagcatggtagaaatgaagacttattacacgtatagcatatttccgtcaacgtagtactccctctgtactcgtaaagtcgttttggacagcgacacagtctccaaaacacaactttgattacttgtttctataaaaatatttattgaaaagtgatatatgtatatttttatgaaaatatttttcaagacaaatctattcatataatttctaaattttcaaacccaacaactcgagagttattcatgatttatattcccaaggtttgactaaaacattgtcctaaacgacttcctttacgagtacggagggagtatttgctaaagaaattataagtctgttgtatttaaagtcaactcaggcataagaaagaagatatgcaaatatgacatttcttttctagatttatgtaattttgacattacgttgtcaatgttccatagcatctttaggtcaactggtatgactacaagaggaataagaatatcattaggcaactaatcccccctcttaaaataagtatttttacatctaaaacttatttcaaaatgaattcattcactactagagaaacgatctttgctgggtcgacccaaaatcacaatagtcccggttccaaaaagaaccgtccctgtttaaaaacccacagctattttataatttttaatcccggttggtaacaccaaccgggactaaaaatcatctttagtcccgattcattccctgtcagtaggatgtcagggggccgaggatctttaatcccggttggtgtcaccaaccgggactaaagatcatctttatagtcccggttgg

SEQ ID NO: 26081 - DNA, 8382 bp, Oryza sativa
agatgaatctgtgatgtatttgacttcggtgtattttctagcatttgtgatgtatttgataagcttgtatttttttagaatttgtgatgtatttgatttgtgtgtataaggaacttaagatttgggatgttcctttgaattgaggatttgaggatatacatggcactagattcgggagaaaatatagggattaactctaagaaacaataaaaaaaaggatcatctgcactgcactgccgctaccctctctttagtcccggttggtgttatcaaccgggactaaagatctatttttagtctcgggtatttgaaatctttagtcccggattcgtactcccggttggaaaaccgggattatagaggggttaccaaccgagagtaaaaagtctttctccaccagtgatttctatctttttacctactgttgatcagcaaatagatgagtttggttccttcaatatcttttatcgacctaccagcgatactactttcgtactattgaaggtatttcgatcttttttttctctatattaatttgaaacgcagttgctagaagtgaaattattttggaacagaaaatagtacttttttaaaaaagctaccactgcccttagcctcacagtaatttagcaataatgtcttccatgctatatctacattcaattcaagaacacattcgaagtgctaaaattttattcaacaactttagttgccagttggtacgaaattcgtcctacaatgcgtccaaattaaggaggaaggtttctgactgacaaacgtgcaaaagtttcaataaattaaaacagccaagtcttattttaaaccagtattttttttatcttatttatttagaaaagaagcattcttctattacaagaaagacgtacggacgcacattgttctcacatcacccattatttttaaaaaggggtacacagtacttagatcgattaaaccagcaatctttctgataattaagcagtaattaacaacgcacatatgttcattgcctaattattcatcgttcatgctcatccaaacaagaaggcaaagcctacccaaattcatccgtcaatcactaccggccagccgactactgaaactgaaaggcaacgggattttttgtaaaaaaaaaaaagaaagaaagaaactgaaaggcaatagacaaactgagattccaacgtggtcaaaatggaatgcgaaacctaacctagctaatactctacaatatctggtcaaacccaattgcgctccaaattcctaattcgctttctttgctagaaactgcaagcctgcctgccagaaaacgagattgattaatttgaaaaatacatgactaactgaaccgtaaattataatagtactgtagtgaattaaagatatctatgggtgtcatcatatttttcttgggaccaacatagctctattatttgattagattagatcagattataactccatattgtacagggtagctaggaacagaatttgcagaggtaggttgtatagatgatagtaccacattgcagcccatatgcattgtatctgtatgcatgaatccaagatagatagataaacttagcaggttaaattactgtgtctatggcggcacaagtggttaattatcacttggtacttatccttactcttcttgattctactaccaatcagggttggaaatttcggtatatcactgacttccgatcaaatcggttaaaccgaaaaagtaaacctgctgccaattactctacacatgcatagaaacaaatcttctgacacaccttttattctgactttcaatctatgataatcttgacatgtggacttgtttgataaatgatttacatatatcagtgacccgtgtttgaggaaagtaagtcgtaggatcttaatcctacatacatgcacttaacctgtatttaattatcctagatagcttaattagttacatgcatatgctttaggttattagcgatttccttcgtttcaggtcacgagactttttaactttagttaaagtcaaactgctttaagtttgtagataaaatggtaacatttttaatccaagataaatttattatgaaaatatattcaattattgtcttgataaaactaatttagtattataaatattattatatttgtctataaacttaatcaaacttaaaatagtttgacttatatgcggctagcttgcatgtcttaccatcttgttaggttgtacatgccacctagctcacatccatgcatggaagctatatatatcactcgccattgctgcccctgcaatcaacggaagcttagctgagttgggtttggtctcgccgctggccggagtagagcggtccatgtgctgtaccggcgacgaggtggcgggacccggagagcagcggcggcggccgctcgacgccgacgccggcggcgacaagggcgcggtggcgacgacgtcgtcgtcgttgttggcggcgccgatgctgtcgcggcggaggcaggcggaggagatggcggcgatggtgtcggcgctggcgagtgtcgtggccggcggcggcggcacgtcgttgccggcgaagaggccagccgagagagagcccgaggagggcgccgccgtggagggggtgtggtggtcgtactgcagtgagctcgccgccgccgccgccgcgccgtcgccggcggctccatttccggccggtacgtacgtgtacgtaagcagagcagtatagtaaaagttgaatgcaacatgattaattaaagtctacctcggactttgttaattaaccaaactaatataatcatgattacattgatcacaaagtgacttgcttgttctctctatcaccttttctaattaaccattaggttgatgattaacattaactaaaatgcatgcatctctcttttcctttggtgaaaaaaaaggaggattgattttgaaccttattgatatgaaaaattacaattgagaaaatgatgaacaaaacagtaaaactacgtatactttgcaattttatatgactaataataagagaaattttaatgactgattaagcacaattaaaatgaatgataaagctttttttttattattttctctttgttttattcaaaagtaatcacaaagatgttagcctggtaggagtatattgttatagtttagtggtgtttacactaacacacacgacgtgcacgcatcttgcagcatatgcataagcaaagcatatgggttggtcaatgtgcacgtgtggatccacgcgtcacacgagcagaggctgctccaaccaccgccacatcgcaactaatataatcattgttatggacaaaattaagagatcccatgggcttaatttattcattagggaaaaagattaagagaaacaatgggatgggtagctcactaacaaccaaacacgtgttccttaatcgccacgtttcgtcattcttagcatcaaacacacgaaatgaactttgttttaaaaacaaacacacgaaatgaacttgtgactagttaaaaccagtagtccgcattgacattaaaatataggaacattctgatcatccaagagaagtttgcatgtcaccttttgtattagtttaacacaaaaacagagcaagtgagaagaaaatcagagtatctcaaagagagagaagcaaaacagagtaaccaaattaaccagatcaaattacttttaaaaatcacagctcaaatcactgtgttacaaactttttttactacatagtttctggatattattagtatggatacatgaaaataattgaattttattactatagataattaagcgctaatcaaaacaggttcttgtcctaatctcccctgttttttttttcttttttttacgcgttcgcaggctacgtgccatcgccggggcaacactcgcctgcgtcggcggcggccggcgacgaggaggagctcccgtcgccgtcctcggccgactccagcggcggcacggcgaggaagcggtacagaggggtgcggcagcggccgtgggggaagtgggcggcggagatccgggacccgcacaaggcggcgcgcgtgtggctcggcaccttcgacaccgccgaggacgccgcccgcgcctacgacggggccgccctccgtttccgcggcagccgcgccaagctcaacttccccgagcacgccaccctcccaccgccgccgacgacgacgacggccgccgctcaccggtgcccgccaccgccgcggacggacgcgctgctggagtcgcaggagctctctcccggcgccggcggcggtgacccgtactctcagtacgcgaggttcttgcagggctccggcggcgacggtggcgaggcggcggcgcggcccggcggtggcgcctcgcaaagaacgccacccgccactacactgctctacagcttcgagggagacgctgcttccgccgcctgcctctggcagccggagagcggcggcggcgggatggggtggccggcgacttcgccggcggcgtggttggagtacggtttctacccgccgccggagcggcgcgacacggacacgtagggttaatcacgatgtgatcctgagcggaataggcggtgacgctgacaggtggggcctacttttgccaggtgcggtcaacggtcaacctgaagttgacgtggcatgccacgtaatgcggcggtcaacgggttcagacggaagtgggtcatggacggcacgagacgccgtcagaaataaatgctcgaaactgacacgatggattacattgttcgtcaaattctcagagggccacatagttgcaggagggggaattattattcagcattgtttttttcgtaaaattcatcgctccaaaaacatcacacatctcaagcttgtacgaatgaaactagtgcagtctgaagattttctttttctggttttatagaacaaaagatttttgaagaaacccaatcctatgaaaaaaaatttcttatatgaaaggaatgggcatccaaaattcctgtaaaatttctctgaattggctcaaaacatggctatgacatggcttgtgtctcatgatgaatgtactccgtcctaatttgcctttgattaataattctctttcaaaaataaatcctcttgggaaaaaaattctcttattattcatgtagttttccgtaagatttggagttctaggaaacttgagtcctataccttctttgactcgtattatttgagaatcatgtattcatataagctctaaaattggctattacccaagactgtacgactcgtttgttgttatcagtgttgtgtaacaaggagtcttcaaaaaagaaaaggaaaaagaaaagaaacagcaccgaggaaattagtatcgacatcaaagaaataatgaaaaattacaaaaatctgtcgaccgctccagttgacaaaaattcgtaatattttgttttttatgatagagccactagtagctaggtactcttactcgcatgtcattttgttctcttcccttttcttccgtacgaaaaccgagtgtacttcggcaaattcgttacgcctcccgccacgacacaagagccaatcgcgatatcgcaccgtgtgcattcgtccacgtcagcaccagggcatgcgtacacacctgcaccacgttaacgaaagaaaaaaaaaagatcagtcacaatgccattggttgataatatcttattataaactgtattctcttcgtttcacaatgtaatactttctaccattttccacatacatatagatgttaattaatctataaatatatatatatatatatatatatatatatatatatatatatatatatatatatatatatattaaatcattaacatctatatgaatgtagacaattcttgaaagccttacattataaaacggatagagtaagatttaatagtgattaaaaaataatttaaaagtataaattttatatatgtgttcttaccgacttaaaagacaataaaagtactctttaattaacttcaaaactaaatttaaattttaaattttaacaacgatttattctttataggggaacaatgaggccctatgctaataaggaccatgactccataagctgaagaccggtgaagacagacatgacacatttttacaggtcaatgcaaatgcagttgacgctatcactggctgatggatttggttcctacgcagtttctagtatgacattttagcctattagccgcttacacttattagggaagacattcaaatagcgcacgattagttaaaagcagttgcatcaacaagaacacaaatggctattccttgccaatttcaacatggaatatgcatgcgacactgccccttttgcataagtacagaatttttcgagcactcccaaaggtgttgtgactggagcacatgaaattccaaagattagctgtccttatgctgaagatttccaaaattcagctcagtgtctttcgaacttaactgaagcggtatggaattttgattcctcaagtgactcaaggcactgaccagcatcttctcgatggcaaaagtcagtgatttgtgcatactaaatagaatcatcctagcaagtatcgacatttctttttctcataaggatttgttctcaataaacatactttatatgtcccctgaagggaactcttttttcaggggggacccgaagaaatgacacctgacattatgattgtggtacattgcacagaaatttagaacctttcttcagtaaacataaaatatgtttgcattttattttccatatagaagcttggaggtttttccactaacatggcaaaatttgaagagcatactcaacatagcaccacgcgtatccacacaataaatacttttcaagaacatgtacatatgtactgatatttgaagagctatgggaagtgatattttgtttcctccaggttcaaactaagtggtttgacattttaatgatatctgcgtctgcatgttcttagaaatttctcaatttgcaaaaatagatgtgcacgactttttgttcaaataagattagttaagatagatacacatactcaatcatcaccgtcttcgttttcttcttcttcgctgcgctgttggtggtagcttctcagaagggccacaaggaagtgtagttcctgtttcactctctatgcgtctcttcagctcctgtagaattcggatttggcccaatttctctggagataacttttcccagtaaatccctgcatgcagaagttccccaaaaatctggtcacataaggtttttttgccggtttaccaaaatattaaataatacaatcattcataccttgtggtttcgcgatcgtggtatttgtgaatatgacctgagttggagtgcagataatgtcaactggtacatcatgaactaacagcttctcaactggaatgtcattcactaattgtttgtcatgcactgcagtcatagacacagttggcaatttacattagttattaatcaaggaacaaatgagctaaaaggcaattaatttaaatttgataaaaaatatataaaggttatccaagaagggataaccagctgaatcaatataaaaaaactcaccagttgttactatcatggttgaatcgcttatagatcccatataacgcagcatcccatattccagctctgcaaatccctatagaccattttgatgaaataaaggagtgggaataagtagtttcagtagatagagcatgattcaacatttcaacatagtgccaacattggacagaagtgaaaagcctatcgctcaatttttctctcaaaggaagaaggaaagcaggtcaaacctcattatttcctctattaatttcttccatacaaatgtacaggagagaaacaaattaaactctgcgtcaagtcttcaactgcagaaatgcaattacaagcagagaatagttacctcgccctttcctagtcgtgctcctgtgcttggatcaactgcaaccgatccaatcacaatcaaatccactttaattttttcatctagacctataggtctcccgtatttggctgcaccaacagaagtacatgcttctggaatacatccaatgggtatcatgtgagattccagaactgagaaaaatcctgtccttagccgaggtgcggagtcagcaactttttatctcctgtgaggatccaagtttaacctgattagtgcatatggctatcatagatttataattagttgattaagatgcgcaacagattcaaaagcaacaaatggcatttaaaagcatcaagcactaataagaacagtatggtttgtcttgcaacacaaaagtcaacaaatgatctgtcttcaccggttttcatcaaatgaaacaagaacctacagagccttgagaaaactgctaaaaaaaccactaaaaaaaat

SEQ ID NO: 26082 - DNA, 16934 bp, Oryza sativa
  unsure (1)..(16934): unsure at all n locations
cacccttaaggtatcagcaaactgacctgagagtgttaagaagcgaacttgcttctgaggtgagtggggattgaccttcacacattgtgcatcctggaacacgtcgagtctccccagctggtgaatgttttaaacattccacatcaatgaagaaacataagcaaataaacagtggttaaacaacaataccaagaaatgatgtgtaagaggcttgaagggcaacaagggaaatccaacaaggagcccatgtactatgtagaagcagacatcaagaataaacagaccatgttcgctataaagtaataggagtacagatctaaagtacatcatatttggataaactgaacacagtttcaaaggaccaacataatttgtaatgtaggtttcacaccaattctgcatctcaggtgcttgcctgtaatctgtatgtgctagccattctttatgacacatcaggtgaagccagaatttttcactcatccagaccaacagaccccaatggcttgtaaatatacccccacaccatcttgaaagtcgaaaccgtgttcatttgggactgatgtttcagggatcgaaccagacaacgattctgcatgttattcggactttgactcctttctgatacatatcatcaaacacaggtgcgcatgttgcaatcccatcccctacaactggaaatttatgatgacatggttcccaatcacccatcactactagcaaccgaagatgtgattcagatgcgattgcattttttttatgcgtattacatatttcgtatcagtagttcgacacacagcctacagcactggtgcactacgagtctacgactacaagcagcatccccaaatccagaagttaacgcaggcgatacagaaattcagaaatgaagccagaacagaaaagggcatctaggtttacagttacaggagggaatggatgcatcatgtaatcatgtatgggcgagagagagagagagagagagagagagagagagagagagagagagagaggagagagaccgagacagcacgcgcgtaccgagtccgcggcggctgcggcgccatcgaagttggggatgcggtggtggacggggcgcgggtcgcgcgcgacgccctccgcctccagcgcgtcccacacccgcttccgtatcgcccacttccacgccttggggtccgccgcctccgcccccgccaccgccgccgcggacgccatcccggcccgcgcctctgcgtcgaggcggagccgctcggcctcgaaccccgccgcgtcgaacgaggccgacgaagacgaagccgcgcccctcgcagctgcgcacgtcacggcgcggccgcgacgagaggctgccgccgccgcagccaacgaccgagacagcgacagcggcggcggcgacgccggcaggagaggcatggccactcgcgtgtggacgccgtgaaggtgagcacgtgtgctaatcgagcaccttacccacaatctcctttggacactgacaggtgggaccaataacaaggcgagtacgctcacagctgacatgtgggaccactagctcagagagaaagcgtgaagtgcaacgagagcatcgagctgatgcaacactccaccaaaacaaatttcaaatttgattcaaccaattggtagctgaaagatgcaaggcaggcgaaaaaacataactatcgagttcaaaattcataaatctcaacagtttgatcatccgcagcaccagcagctcagagtagcaaagcatttaaactgggtactcaaaatatctgccacaaaactcaggacaagtacagaaactgggaaagctatcaggtgaggttcgattgaattctgatggcctaggccttgagcttgccgaagaacctctgcttctcgtcggtggtctggaagcgaccgtgcccgaacttggacgaggtgtcgatgaacttgagcttgatctcctccagggcgagccgcgaggtctgcttcagcagcgactggcggagggtgacgactctcttcttcggaccgacgcagcaacccttgatcatgaggtagtcgcccttcaccacaccgtagtgcgggaagccgcccatcggggtgatgtccttctcagtcctgcaagggagaaaggtcagatgtcatcacaaccttagaatggaatgcacataacattactcaaggccttcaaacgttctaaagatgtatacctgtcgaactcggtgcaggccgcatgagactcctgaccagacttgccaatcttgtaaaccttcttgttcatctcagtgcggtggtggtatccgttctgaccagcacgggcaacagtgtaggacaccctggctggatgccaggcaccaatacaagcaaccttgcggagacccctgtgggtcttgcgaggaaggcgggtgacaccccaacgagtgacgacaccttcataacccttacccttagtgacaccaatgatgtcaatcatctcgtccttctggaagactgcatcaacagggatttccttctcaaagaacttgtagccatagtccaccttgtcggcgatagtgccaccgttgatctggatctccatgaggtgagccttcttctgcttcaagcccttcatctttctgatctgaattttgacaagaaatggtcagcaaaacatgataactcttcagaattcagaagagtacaagaggcaatggcaatctcacctgagtgtgggcaataacacgaacaatagatgcgtacttcttcatcttctcaagttgcatctggatttctttcttgccagcatcactgtcatacttaagggcatacttagtgaaagccttcttcttgcttttgcaccagttcttgtagaaccttctccgcacctcctcgctaaggtgctgggcccagacagagttgagagagcgaagtccacgaggtgtcttgacataggccacgagtccaacaatgacaagcggaggggtctcgatgatggtaacagcctcgcaggtttccttcttgtggagctctgcacattgtcaacatatggtgttaatatgttcaaggcatacctccaatgaacacgaatgcaagatgcagagcaacttactggagccaggcttctcgacctcacgcacaatgtgtgtcattccagccttgtagccaacgaaggaagtaaggtggcagggctttgatacgtcatccttggggaaggacttcactgcaaaaacataggatctagtgtcagcgtacaactgaatagtaactaaattctccaagttccacagaagcaatatatatcccattgggttatgcctatgtcctgaaattttaagttgggttacatccatgtacagacattttaaagacaggtgcattcttaactatttatgtaccacatcaataaaacaaaaaatctatgagcatgtgtcaatctaggtatgttagcagcatatataccaaaaggattagaaaataaagcgctatatttaggaacacatagccaaacgaacatccaaatgattgcgaaaatactctaataagaaacacctgtatctacctaacagaaaacatacgaaccatatcacgcgtacacacttagatagctgaatctattagctgcacaatatggattactacatcatgccgcactagattatgattcgcagagcataacgaaatccctcgtcagatcaatacggacagtgaaactcgcaatcaactcgctgggcataaacgaaatccgtcttcagatcaatacggacagtgaaactcgcaattcatgcatcaccaatcaagcgtgtggaaggcaaaggattcacgtacccttgccgcggtggcgggaggagcgcttcctcgggaggaagccgagggatccatgcctcgggtgctcgaacttcctgtgcgacatcttcctcctccttacctgcaaacgaaacccacacaagccatgagatccgcaaccaagaaaatgcccgtaaaatcaccaatcgcaagccacagcgatcaaactacagcaccagcgacgagaattcgatctcccagctagctcactaacaactaatggcggattgcggacacggagcggaggcaaaatctgaatcgaagcggggattggaggatgaggaggggaggagcttacctgaggagagtgacggcgacggcggcggcggcgcgagctgagtgcagaggcgagggaggtaaaccctaggggtggtatttataggcggctaccgaatggagggtttcgctgggtcgggcggaaatgtaggaatgggcttgaatgctagggctttgtgtggaggtcgcagactgggcctcacactaggtaaagcgaatgggcttttggactggatcgcttggacacgaccacaccaacttgcttacggcccaaatacgtctctttctgagtgttttgtattatgacagtggaatattgtgtactttatctgttcacaaatataaacattttatgttttttaaatttgttcacagatataaagatttttagaatagtaattgcttcatcaatcacctcacgttttaatttctttccatcttactctcagtaatccttctaatcccaaacatacttcattttatgatacatgtcaaagcctttttatcctcaagtctaatatctgctaaaaaaaactaaaattgtttatattctgttggaataaataggttaggccaaatttaatttaattaaaatcttaagatcccataagtattgttagagacaataatactaccttgaaaatttatgtggaataacctcaacttaaatagagtgatattggagaatccatgttgaccggttgaggtgatggttggactgccacacgcgcgcgcgccgagtcggcctcggccgtgggcgtggcgaggcgaggcggcctgccgagccaagcctcttgttgctcttccgttttgtaacagacgaaaataaagtcaccattaacaaatgaaattcattgtgtgttgtaacctacacaacaaatgagagattcattgtgttgtaacctccacaacaaatagagatttatttgttgtaacctctacaacaaatagattcattgtgtggtaaccttcacaacaaatgagatttatttgtgtggtaatggagatctctctatataaataacgcaaaggaaaaggctctcaaagattgagtcttcctcctgctgatgttccttggcgatattctccttttgttcctgcgttgtctctctgtttccccggttctgtccatcccgcacgtacggtagatcggaacgagcaggtgcctccgaaacttcatccgcttgagaacctgcacgggtaggcgggcgattaagtttttggggagcgctacgtgcgactgcttttgttcgtctccctctgcatcatcctcgccaacatgacgaacaccggcgacaacagtaacactggagacaaggagaaggaggctcccgttaacaccaacggaggcaatactgcctcaaactccagcggagagccattctcggggtataacgatttactattaccgtttgttcttcgtttcctactactgtcagtcgcaatgttattgcgttgccttgtctatgttgatgcttattttatattaagcacactcatattgtacacatttagcactgccactagatcttctcaaattgcaaatgtcatgttgaaaggaccttgatgtcgcctagagggggagtgaataggcggttttaaaaaataaatgtggaagctaagacaaaacagggtcggattgtctgatatcaggtcggatagtcctatgtgatcagatagtctgaactgagatcagactatctgacctgcacaacaacaatacaaacaagaaacaacctaaaagctctagatccaatccacaagcaaggaggtgagctcaaccaacaacagtaaaagcatggcacaaagcaatgcaacaagaaggtaaatatagtgagaatatcaccgaggtttacgcgatgatgtatttcccggagttcaaatccttgaggggattctagtctccgttgaggggctcgcaaagagacgggtctttttcaaccctatcctcgtgagattgcacaaatgcactcctccttccactaaggatatctctttccttgcggaggcgagatccggccttcacaaacttctcttggccaaccacatgtagatcggtggcccaagaacaacacctagccatctaggagtcctcaacctccaagagtaataaacaccacacaactcttggacaaatcctagtgctcaagatcaagagaaacacacactaggctcccaaactccaaatccacacacaaagatctaagtcacaaaaaacaagagagatttcagatagagagggagagagctcaaagatccaaagcatttagcacaaagcttaacccaaaacaagatttgaatgaaatgtattttgggagaccctagaaaagggttggtggggggtttatatagatcccccaaaatgtgaccgttggaggggaatctttcagcccacgtcggatagtccgatacaagatcggatagtccaatattttaaacctccaaggcaatgagaaacagagaatgaagttccatgaaatttcggacttaccgagacatcggactatctgatgttaaattggagtatctgatattttagaagtaaaaacttcgtcctcaaacaaagactcaagttccatgaaatttcggagtctctgtatcatcggactatctgatctaacatcggatactccgacacctagaaaaactcactcgaaaggatttttcaaacaaagacagagagtgaagttctgtgaaaaatcggatagttcgatacatcggatagtctgatttcaaatcggatagtctgatgttgctcaagtaaaaatgcaataactttttactccgaactccgatttcgaagatcttggactctatagaaagctagtttcgtgggctatcaaacccaacataaaaaatggtccaaaaccttcaagagtatataaaaaacttgcaaagaaacccggtgtaagtgttgtgacaagtgaaacaactcgggattgaaattttggcttaggtttttcaactcacacaaagatgaagcattttgagcactaatattcaaccaattatatgcatgtggtatccctcttaatagtacggcatcctaaactcaaatttaaaaggcaaagttataccaataggagtgccttcacaccatattgtttcttcacttggagggttaccaacgtcaaggtcatttgatcatcgaaaagatctcatcttcttgatctttgacatttcatcttccatttctcaaatgattgatgtggataatccatggcttcaaatggcctcgcacggttcatcacgacacagtcttcactcgcccttcaccaccggtttcggttcgtcggcgccaagccccttgcttgcccttcaccaccgcatggtctattgcagctgagtgtcgcttgcgcttcaccgtcttgccataagtagtcacttcatacccgcatcttcaatatcttctctttaattctcatccatcaataagtccatttcctagcttcttcatcggactaatcacttgcttatacactcaataagtgcattagtcccttaatcgtttgtcatcaataaatcaaaacccactaggggcataaatgctctttcacatgtgttttgtcttaatattttagattaaaatatgtcgaattatgaccaaatttccaacatattcatggactgtgtgggagtacatctctatacattgttaaaggcatactcactctgtcgaaaattaaatcaaattttatcatcccgagccaagtttagtgatgatatagaaatatttaagtgggcttcattaatagaaaattctaattgatgggttgataggtatgtgatattgataggataaacttcttgatttacggagtgaggataagtaaatggataaaaatcgacttattttgaaacaaaatatgaactcttgtaggatcgagatgtcgactagaggggggtgaataggtgatttaaaactaaatgacacctaatcaaaactaacctaagttgctaggcttggtgagggtcaactctaactaagcaactaagttatgttttgcaaacctagggtgatagtggctcaattatatctctaggaaagtaaatcacactcctatgtcaatgtttagcaatcctagggtgatatgatctcaagtttgtctctagaaatataaattgcacaaatgtaaatgcgacaatcaaatgagacaaggagacaagagatttttcaccgaggttcggaaactcgtcggtttcctactccccgttgaggcgagcccaactccaccgctcaaccacgaagccaccgcacgcccccttcgtctaggggtgggcaaggcgggagccggcccacggagaggactacccaagcctcgatcactagggtagttcttccttcactccgaaggtggtgaactccaaaccactcacaaaccggcaccgggcctcctccataatcttctcggagaggtcaccaggcaacttctccacaagccgtctaggaggcggcaacctccaagagtaacaagcaatgacctggcgtggagatgatcaagtgccacactagctctacaatggaagcaaatgcacttgactcttggctaatcaaccctctaacacactagatggatgaacacaaagctcaagtgagtgtgagagaggtgcaaggggtgtatgcaattgaattgggtgccaagagagtccccttgctgctggtgggggagtatttatactctcacccaccaaaactagccgttgggggcgaaatcccccaactttgtgctctgccggtctgaccggaggtatgtggccgatcagaccgtgctactctgcagcggctagaaaactagccgttgaagtgctgtcagagggccccatcggcctggccggtcagaccagcgttgagtgggcggtcagaccggcctcggtctgaccgactatggctccgtcggctctgtatcggccaccccgaacagcatcatctcggcctccagggggccggtctgaccgcacatgtgccaccggtcagaccggccttatgcgccggtcagaccgcccgcttggggccggtcagactggccagggcacgccggtcagaccgccactatgtggccggtctgaccgcccctggtcaggccgaacccagtgaagtgtgtgtgtgtgtgtgtgtgtgaaatgtgagcagaagtctaaatgcataatgacctaatgtggcaattaaaatcatctctttgctaggtcattacccctcttaatagtacggcgaaactaaaaataaactagcaaatttgattgccctacacctcgatcaattctaaattaaagcgctagttttaccatcttctttccctttgctttgcgccgtcaattttaatccatcgataatcatccatgcgcagatatgacgtggacctaacttaaaatgtatagctcaaagacaacggttagtccacaattagcgcttgtcattaattaccaaaattaacaccaggggcctagatacttcaactctataattatttaagttgggagtaaaggagtggatagtagttattaatgatacttatgtactcctgtacactctattttatacctttgtaaatttcactttgagccactttttattaccgatgttttgttgtataccgccctttaactaatgtttttactttggacgggtatttttacctttgtggcactatggattaccttcaaatattttattcatctacatccaactttatcatatgccaagaaaatggttttacatatagctcttagagttaattgactagtatgagccgatgtaaccgagatccttcatatggttgagaagagagtccggtgtacaaagtgaaacagaggcaagattaccctatctaaagtgaaatcattggttaaagagtgtccaaagtgaaatgtcggtaataaaatatggcccaaagtgaaatttactctaaatttaactataggtcatttttattgaattattaatctttatatgaattaccgaccatcttaaacgatcgtggacaccgttcctatcatcctgatcttagacactggtaaaagttcaaataaatctaattttatggctcctttgaatcaaagaattttatgtaggaatttcataagattcaaatcgtataggaaattttcttatgtggtcatttgattcaaaggattaaagcttttcaagtcctaaaaaattcctacggaatggctcattgcacgtaaattttggaggaaacttagcaatagttccaacctcttggaaaattttattcgagtctatctatctcaaccgattcctgtgtttttcatgtggtccaatcaaatggctattcctgtgttttcctatgctttgcaatcttttgttttaaatttatattcatgttagaattctgtgttttttctattccttcttttttcccaatcatgcgaaacccttaaggtaatgacccgacataagtactcaacgtccaacctcacattcaaagggtgcctcaccctcgttgctctctgacaagaatgacatatactccctccgtccaagaaaaaactcaacattggtgaggatagaatattacctaggcaaacgaatctggacagagggttgtccaaatttattgtcctacatgatgcctagtcctcaccaaggttgagtttttttttttgatagagggagtaggaaatagacaaatgagttgtcttctcaatgagtacatcctattttgccatttaaatgttgtcttcaaatctcatatgtaaactgtgtctgtttttttcaacttaaaccagcaggaaaactattaaattatatttcaattaaaaacccaaacgggtgtcaaaaacaaaaaagaagagaaaaccgtctttgagcaagaagagatatgccaagccaggatttaccaaactgtatgggatacggtttccgccgcccaacggtttgatggttatcgcgagatatactgtggttccaaaaactaaaaaggttaccgtacgtgacaaccatggtaaccgcacggttttgtaaaccctgcgccaagtaccgtgtctggtaagcttattgtttaaacaatgctttgacctaattattttctgatatggatgtagaggaaaaagagaaatggcctgtattttcaacaagcgatgcttgagcacaataataagcataaccccaacatcatatttaactactacctccatcccagaatggccgcatttttgtacagtttatgtatttaaaaatttttatgattagtatttttaatgttattagaggataaaacatgaatagtactttatatgtgactaatattttttaaaaaatatattatattaaaaaataagacggacggtcaaacattggacacggaaatccacaactgcacataaaatgggacggatatagtagtgataaaatattatactcaaaaggtgttaagagtattaattgttcaattaaacttttttgaccacattattactaaccgtgtttcgctttaaatcacccttcagacaatattttcctttaggtcaagtaatctttcttttctttcactttggatcaccccaacttttttctcaagcatatcaacaaactcaagtatggctcttacttattacagaaaaactaatacacggaatcctgtcaggggcacgaaggcattgggataaaacagggtgaactttacatatcttctagatccgtttcccctagatatgtttcccccaccgagcaggagcactttgtcttcctcctccctctcctcaactccttgaccatcgtctccaataccgacgacatcctctatcatcttttctcccttcatacactggatcaggagcacataagatagcggaggttggcaagggcatgggggttagagcaaaggagggagccaactatggaagcgaggttgggggttgtcatgtgtgagcagaaggaaagggaggcggtgaggccgagggggatgaggtccttagcgtcgataggagggtggagacggctagtctcgatgtaaatggctaccttggagttgggtttcttcttgctccttgccaacccatcacttctactcgccggtgctgtgcacaggtacgtcgcaaactgataccttaggtattagggggttgatactcggggtcttatacgttgggtatcatacatggtacccaggtaccataccagggtatggtctggtctagtaccttggggtagcctgcctggtacctcatgtaccagttggtacgctcagttaccatgcgcatagtatttaggtatcgggtctgttacctatgttatgaagtaccgggtcaagtcatgggaaaggagagcgcgatgtcattgtctgccttactggcaagtccccgtcaatctgtcattgtctcatcttctcttctcccttcctctcatcgctgccttcatcattcctctgatgttgctatgactggtgggagcaaggagctacactgattgtttatttgcaacgtgggagctctaacatggggaagacggtaggtgggggattagatttataaagtatcccgttagaacggaatcccgtgctctagcaatcctcttattaatattaataaacttgcacaactaaatgtacaatattttttagacatataaaaattggatgtagatgaataaaaaagtggagaacgatacaaagtaccaaaaagttacagaagcagaattaccttattcaaaacgaaaacattgattaaaaaggtaatctaaagaaaaacattagtaataaatgatggtccaaataaagaaaaacattatttgacatgacgtcagggaagcctattaaacattttctgggatattggtagcctatatatgggcctgtttagtacccaaagaaaaaaatttcaccctgccatgtttagattataacttttttcttcaaattcttaattttttgtcacatcgaactttggtcgagtttagtttcaaaatttttcttcaaacttctaacttttctatcacatcaaaactttcctacacacacaaacttgaaacttttctatcacatcgttccaatttcaaccaaacttcactaaacacaccctgtgtttagttcacttcactaaaattggaagtttggttgaaattggaatgatatgacggaaaacttggaagtttgtgtgtgtaggaaagttttgatgtgatggaaaagttggaagtttgaagaaaaattttggaactaaactcggccacaaccattcatacacacacaaacttccaacttttccgttacatcgtttcaatttcttcaaacttctaattttagtgtggaactaaacacagcctctgtaacattgaatgtttggacatatgcatggagtattaaatatagaaaaaaaactaattacacatattgcgtgtaaattgcgagacgaatcttttaagtctaattgtgtcatgatttgataatgtaatgttacagtaaacatttgctaatggcggattaattaggcttaataaattcttcttacagtttctaggcgaaatctataatttattttattataagtctatatttaatactttaaatatatatccgtatatccaacgtgaaacgccaagaattttcgttcgggaactaatgagcccatgtccgtatagtcctactgtatggcttggtttccttctcccagaagccttggctaacaataaaggcatgcctactaccccctctcatcaaaatccaacggcatatcatcttctcgcgctcaactccggcggcaatcaaatcacgcgctcggcgacgacggcgatgctacgggagctccaggcgctgtgcagggtccacggcctccccaccggtggctccagcgccgacctcgccgaccgcctcgccgctctcgtcatcctcccggtacgcacgcgctcgcagcggcttagagcaccgatcgaaccaccacccctcctccgactcgctcctccattgattcttacgcgctcgctagctagctgcatgcgtttgatccaatgcaatgcaggggcgtggtgatgcggcggcggcggcggagatgaccgcggcgaggtggggtgggaagggctgcttgaagcggcccggtggcggcgggggatctgggccgacgaagaaggtgaagtttattctagaggaggaagaggcggcggcggtggcggcggcggcggcggatgccgggatggaggtgaggcagagaagccagaggctggctgggaatccgccgggggatgcctcctgctagctgcacaagcaaactgattaattagcaaatgggcattttggtttggtgattttgctcgttagaaaagatcaagtgttgcattgctcttgtctaaatgtaagatcgtgcaaaactgcagcaaaggtcggtgcggtttaggacaagtacaagtcccaggtaatgagatctgtctcgatcaagtttatctagctagatcttcagtttttgtttttggggacaatcggacaagatgtacctgtgtagtactcctaactgatagtaacaattaacaactaattcgagctaaatttatctgttggttagcttaatcagtacattgtcctggcaaattatttctggcatctatttggcaaaatctttgtgtgaaactgagatcagagtagtagtcagtagtgcattgaaagttgaaacttctcaatagccactggaggacttttctcttttctgtggttgaacattgataccaaacatcagagttgctaattaatgtaagactatatatatatatatatatatatagacacacacacattaatataggtaatgctagaaagttttcttacattttaaaacggaggaagtactgttttttgaagctgtatcagaaacttctcaatagttcaccggccatatattagttactgaagtcctgtttttaagttgaagtgtggaacattatcgggggaaaaggacatcatatcagacattttgccttgagaaattacttcaaatatcagagctatgccatattttttttgttgcctgatggagattaggtttgcttaagagattaagcgtcactgaccattagttcgtgaagaagcctctcgccgacatagatgagttgttccgcactagtggatatagattattgactggattattgtcttgggttatctacatcatcatgagaataagggtgtgtttagttcacaccaaaattggaagtttgattaaaattggaacgatgtgacggaaaaattggaagtttgtgtgtagtaaaattttgatgtgatggaaaagttgaaagtttgaagaaaaagttaggaactaaaccaggcctaaattaaatattctgtgaagtaaacttttaaaatagtttagaacaattggcttaagtaatgcaagaagtttttttttagaaaacatatcttcagatacatggagtagataatttgctgcaatgatatgatggacggcatatttgcaaaccaaatgtggatcgatggctgcactcggttcccaacttatcaggtgtatatttggcatatcatgagcaaacctagcgagaaaacaaacatacataaattccatacaactatataaactatttatgttttatgcagacaaaattgatacaagctaactgttagggtctgtttggtacagttctaactcctaaatttaacttaaggagttgggtttggactggagttgtggagctatctaaacccagctcaacctctctagttcattttatgagagagatccactcagttacactcccattttaggtggagctaaaactgtttgcatgagctgtttgcatgagctccacctctctagagctggagctttgccaaacatgcccttatttactagaataaaactatcatgatcgattaatgtagcatgggctagttttttttttatgttaacgttggtcctaattactctgctttgctagtaaattgggatccacatgccaacgatgcaattgaatcaaaggatctgcttccttgaagtcattggatggtgaatccgccaagtaatgcaaggaatgaactagtgaatatggtctgaagtgattatgataattccgtttggttcatagcttcaacattaggtaaattatttttaggagaatagtcaatatggtcctaaagtttcgctcctaagtcattttagtctttaatctttcatattgttcaaacaagtcacccttatattagttatgtctaattcacccttatatttatttttctatgatatacgtaagggtaaattggacaattcatcatagattttgcatgaacaatgacatagcatatccatatgatgattttggtggacccaaggactattctaggccttatgataaagtttaagaatttttttggactatttaaaaggttagggattaaactgatcttacagagaaactttagggactaaggtagctattctctcattattttttttatttttgtttcaaatggtaataatagcatcataatttgaaaaatataactaataggaggaatgcaacaacgggataacacattatgtttaaacttagtttgatatgtaaaatatctgtaacattattttttttatttttgcagcaacttaaataagcgcaacacagcacaagacaacaaccaaagttgagccagctgagtttagcaaatttattgaatcaagacttaagttcatttttttgcaccgtgtttagtttcaaagtttttttttcaaacttccaactttcatcacatcaaaactttcctgcacacacaaactttcagcttttccgtcacatcatttcaatttcaaccaaactttcaattttggcgtgaaccatccaaacnnnnnnnnnnnnnnnnnnnnnnnnnnnnnnnnnnnnnnnnnnnnnnnnnnnnnnnnnnnnnnnnnnnggg

SEQ ID NO: 26083 - DNA, 9209 bp, Oryza sativa
tctccactaacaattctgcattcaactgagttatcacttactccccctatctcacacgtgatatattataatacaacaaatctggacaaagataagtccagattcgtagtagtataatgtgtcacatcccatcctaatttttttttacggggaagtagacctctagaaggctttcctttcagcaaaagaagagagagagaagaaaaagaacaaaaaagaattaaggaggtcaatattcacagtaatattcagaacactgagctagacaggtagtgagcccgtactatgacggccgaactggtacggcagaaaacggcaaaatttatagcaaaaaaaaaaaccaacttgaaagtgagtgacagccacctgaccgtggaacgaaacagcactgggaaagtcagacctctcgtcatcccacaggattctggcaccggcagatgattcatcgccttgcgaatagcacccctgaccggtcaaaaacgaagaaccaaacaaaatgttactaacccagggatgacattgacctcatgtcaacatacgagaaaatgtttcgatgaagacggttgaaaaatataatgcatttctagctatattttgaaagccatcaccactgaaattcatggttttggtcactgtctgcctcgttcaccttctgaatcttactgtactgtactgataggccaattcattaacatgtactgtaccattcatcaggctcaccatgaattttaggcagccactaaagcaaatgagtaacattcggtgctgcatggttttgagatgatgggtagcttcaagatcaacatctgaatatccaattatcctctaacaacaatcgagcgactcaacgcagaacatattttctttaatcaagtttcacacatcttcccccatttgttggcatggaacaggaaccacacttggatccagttggtacctcagtttttgtacatttccctgcatgccaagctaccagccatccacacgatcgagttaatttaagaatgattctgctgcctctgtataatccgcacgatgaactacagaagttagtaaaatgccatgttgtatgtgagcttccgcttgtgctgcttctcaaatgtaataatcaggtcatcaataatttcctcccaatcttcatctgccccttcaagctgaaaaaggaagcaatatatgaattaacttctcgtggttcaccaagtacattatctcatttcaaatatttcaatagtcccactttacagaagtgaatccttttaccagtctagcccgcacaaactaaggtaaaaaaaatattgtagtaggaactactgaagagaagcataatgagaaaacaatagtaatatatagatcaaattctactttcacacaatggattgctagtgtgcagattgatgtcaaaattcatttacaacataatcataccatcagatatgagatagctattgagacaatggttaattagtaatatgcagatgttatgtaacgcattcaagaaacagatgtggatagcatacaggtccaagaaagcaaagaagaatcatataactaaacttgttttaggaaagtataccacacacaaagaaacatcaaaatacacttcatcatcttttatgaaatggaaagttctttatggtgagtgttagatttgctccatagtccatacatggttttcaccacaatgagaatattcatggggactttttctatgttaatttagagcaacttggaggttcaaagttcattatactatataagtgattgaccatctaaatatatgagtaaacaaggttaccctgtctttattcctagaacacacttaccagcgactttgtcaactttcgaacagagtaggaaaaaaaacagaagtagcagttctctttttatgggaggaagcaacgcgaaacacattagggtcaaggatcgaacccgagtgggcaaaaaaataggtcgcagctagccacccgagcagcactcggctatagaaaataaaaggaacagcttggaggaactagctatcttttttaatagggagaagcaaccatcaacagggaacacctagtcgggagtcaaacatgggtgggtagcatttgagaaacatcgctatccaactgagcggcggtcatttgtcacttcccaacagaaagtcaaaagatcagaatgtagatatttgactgaaaaagtaatatgcaagcatttaatattctacaaacacaaatttgagcatgtcaatccacaaaaatagcaatcacagaagtatagaacccagcaaacacaatcactgagaataataagggaattcaattgggcttgtccacatggcctatgatttgaagggagcacaaggatgttattgaaggccaaatttgtcgccgatgtggaaacaaggaatacaatctattggcagaatattcttgacgtggcagtgaaccacttacattaagccctttgagtatacaaagacaccctttagtgccaacaatttcaatcctagttactagattcggcacaaaccaagtaaatagacttgttggactcaactaactgaacctttgtaggttatgaactttgtgtttgcaatgtaaattggctgaaaagtagtaaatttcaaagcaatccttgtaagccacaactcagaacgaacaacatttctggtaaaaacttgatcctagcatctaaacgttttgatttgggcttcatcttcatcttcacatcaagtagaatttgagcctccccgatatatatctttctcaactgaagccatgcatgtgtagtagctcatcgttgtgaaaattagtaagacacaggtacatagtacatgtgagaaatttgtgccatattgtcttgcatgatatgagatgtgaggcagtagtaggcctgcagtgagcttcttaagccttaagataataaccaactagagacattcacaaccctgaatgtggtattaatttgcatgtgttccctattctagagataattcaccaaccctcgatattggggtaatgatttgcatgtgctcccagtctagagactgcggatgagactgcggatgaggtacactacataaggctatgctatagcatagtgcatccagaaaattagtgatcttggcaggttcccaaattaattaatgatgcaccattgtgttataaatgtagggcagtacaagatgctattttttctctggaaatttgacaaaggagacatactgattgacattagtttgtttttatctaacactgctctctaattttgtatttgacacatacaaagacccagcccaacccatctagcatgtgttgatccaagaggctgggctgccgaacacaaatcacttcattaatatcagtagcaaacaacaagattaactagatcaataggtaaacaacataatcgaaggagtagctttatgagctatatatatgttatggtacttataccttctgacacaaatctaaagcaagctttgcaccaacaccagcttcttcatggttatctttcacatccatattgattatcagcgcgttctttagcatcctttgctcacggttatgcatatctgcagcaaaaagagaaaaaaaacatactagcccatcttagtgaatgattacatatccacgtaaatactagtatatggatactacaactgttactgtgatgcatttgatagaccgaaaaaacttgcccctattgttaattgttatcagttgattaccatcgacgattaagtcgaagaccctctcctcaaagctgaatatcacatcaaacagcccatcgccggcattgtcctgccacctctgcggcgccagcttgactgaggtgttcctcttcagcattggcagcaggccgttcctcttgtacctgaatggcacaccacataataatgcattaataagaaacttttctgccatttccgcaaatcaacaaggatcgcatatcgcaaaatcaaatattgtgaagagttatctaagccctaaggagcaatacatttagaacaaaacccccaaattgcaagacaacagctatctgttcccatcatgaccatcccagatttccgccaacaccaaccaaatcaccacaaataactcataaattcgaaatcgactctaaaaaggagatcctgccttctccagtgccaccaccaagagcccccggaaagaacacagaatcaagaagggaaaagagcagtaggacggacaggtcggggtccttgcggcggaggtcgtcgtagatgacgttgtagggggtgccgaagtcgtagacgttgggctcgtggagggaagggccggggagcttgacgtgggtgccggtgccgtaggaggcgacgtcgagccccgcgcggccgagcagcgagtgcgcctccatgctccggttcatgttcgacgagcacaccatcgcgaacctcatcttcctcctcgcctccatgcccatccgccgccgccgctcgccgccggcaaggtagggtcggttcgccgccgccgccgccgccgctccgaccgagctcgcctgtgaggggtgtgtggctgtccgctttgagattcgtgtgcgaagggagtgaacggactggatggcttggagttaggacgtgtagagctttgggctagcctgggccggcccagttcactaaaatactgtttcgggcctagtataatcatgttaacttgagagaataaactattttgcgtccttcaactcttgtttcttgttgaatcgcatcccttgaccgtaaaaccgggtataatgtatccctcgtctttaaaaaccggtgtatatcgcctcttttggcggttcgggaggttgttttctgatgtggcagctttgacctcgttgaatgcctgagttatcttgtagaccccatctgtcagtgacctactccatcatatcttcttcctcacctttcccctctctcacctcacagctgcatgcagggaggagctcgccggtcagccacaatgtgcgcacaggaaggagattgccgatagtgccgctagcgggccgcgggggaggtgttgccggctgcccgtgcgcggggaggagctcgctgtgtcctccaccaccttctcgcgagaacagatccgcggtgccgccgccgtgtccgcaaactccctatcttcctccctcaccttttacgtcgaggcctagtcaccaccgagcgttgcctcctcacgcaagtcagctcgcgggacgaccatcgacacatctacgtgaatggcacgcacgtagggcagagaggcacatgaactcagctgcgaacgttggattgctgttgtcgagcagctactcgtgaaaggtaactggctgtacatttttttcccatgtgtcactgacatgctgggcccattgtatacggtttcccatatcgcactgatatgtgggtcctatctgcaaaaaccacttttcaaaccaccgaaggattctatttatatcggttttgaaagataggggatgcgttataccggtttttatggctgagggatgcaatttcaacctagaacaagagatgagggaggtaaaatagacttattccaaatgactaatattgtatgaaagcactttcaactataacttttttttagcataacaagaactaagggcatcaccaatatatatggcaaagtgatccatatagatgaaacccacataaatagtttttatctatgacaatctccacaatgtatatggaaacgaggtatcattaggagaagagagaggagtagagatagataatataatttattccatatgggtagtccatatgcatatagataccttttgttattttttctatatggactagttgcacaatggtaataggtggctgaatggaatattctattgcttatgaactacttttacaccatattgtggatgccctaaatacattcataattttacttccaccgatcaaaatccataaagtttacatatatatacaccatataaaaacagcagaaagaaagaaatgtgtgttaatataattaagtaatcaatactattattataagttgataaaaatcggtgcaattttccgacacgtgcgaaagacctaaaaccctcgtcctcccactttgccgtgggacccaaccaaccgccctcccttctccccctccccaccaagtagggtttcaccgccgcctcctctgccgccatggcgcgcgccgccgcctccaggctcgccgccgcggcaacctccacctcgacggtgagttcgcccctcccctcctcctcctcctcctcttccatccggatccccggctcgctcaaggctaaccatcccctttgcctccttgctgacagctcgagatgttctcccgccacctcgcggccgcctcgtcggcgtggggcatcgcttcgtcgcgggctccctatccaggtgagtcgaactctctcacgagccccacgcatttcgggcgtggtgaattgaatacgtgttgattgtttttggtgtgttgctgatccggttggattgggattgattggacagggagggagaggaggagcgcgagctggtggtgccctaccaggtcgttccatggtatgttctctggtggttttgatgctctgttgcagatactgtcgtggtttccgtactaggattcataacagtaagccatttgaggttggcgagattcatttttgttacagccaatttttattagagtggaaagttataactccagaccaaaatttaatgctatattttttatttgtgttagtgtgcgtggttgctatctttctaggtcttgttaatatttagctttagtcggtaaaaaaaaaaggaactttgaagcttttatcgggtcactatgtctatgctaacttactaagtcattcgtatctgcacgatatgttatgtacttcctctgtttcacaatgtaagactttttagcattgcccacattcatttagatgttaatgaatctagacatatgtatgtgtttagattcattaacatctatatgtatatgagcaatgctagaaagtcttacattgtgaaacggagggagtagtcaatatgtactacatgatctatacaaaaaagttcagtagatgtattaacagtactacacatatgttgtattgtcaagttcccactgacttgttgataatgtttcaatcaatgaatggcaggtttgttcactcttatttcactttactatgattatataaaagagcgattgttgtcactttttttatttttgtttttactatgaatggggccattgctgatgctaatatttgtgatagttggctaatgccatttgtctgaataaacgaacaaaactcatccatgatggatatacaaatttataagatggatgccatatttatttgttctttttgccatttccctgtcaatgtatttgtgctttttccggttaaaaaaatgtagctgtgcctattcaaggctctcagacgcgatgcttgtgtaataaaatctctgatttgtaaaaactgcactgtatttgatttttgaaatgctagcatgattcctttattctttttgtctgattttgttattttggcaaagttctatgttcattctgtttttctttatgataattgattttgtttgtatgattttagccacaaggggaatgaatgcaagggattactatgatgttcttggagtgaacaaagatgcatctgcatcagacataaagaaggcatattatctggtatatatatactttactttttcttggttaaggtaatgcgatattgattactctagatttgatttgattgaatttttggagggtcctgctcctgtataattcctgaatgtttgtatgagagtattgaatgtgaactatggtctaaattctaagccaaatatatagagaagtataatgtgttgtttggcattccaccgtatgcttacacttaatttttctgatctacaatcttgactacagtgctcgagaattgtgtagtgctggaactcttaaacttcatattagcaggggaaagctgttatcttccctatggctttctgaactgtttctagtgtttactggctgtccagcaccatttgaatatgacagcatgggatggtcatacccagttttaaattttaagggcttctgcatagtagattaggcaggcagtcatgggcatttgcatgccagtttccagctgtacagaccatagaggtttgctctatctcctagattatgtgtgttctaacttctaagcctctatggagcaagagctgtgtatgtagttgcatggtgttttcaagaaactaaatattgtatccaactttttgtttcttgaattgtgtatttgctcatttatcggcatgctatgcccatgccacctgtggatttagcgagcatggcaagaatgaagaggaaacacttgatccttctcttgacttcatactaagatccagaacttttaggatgttgtctattgattagaaaatctagatattaccctctcaatgttttattagattgttgtcctgagaggtatgtaattcataatcatattatttgaatagaccattaggttagttgttacattcacacaaatactcaatttacagtcagtgttttatttatttctacatccaaaggtttttataaataaagaaaaggttacttcctgaagaggctcagatgatggggcttatgggagaagatatccctcactcacaggagaatgtgtcctgaaatcatattgcagtaatatttcttaattcttattgagtggtcaggcatttattgaatgctttgcttgctatacgttattctcaataacctgtgtttgctaggtatatttttgtctgtttctctacatttccctttattttttactcaaagttttaactaaactgattatgcttccccagctcgcaaagaaattccatcctgatactaataaagaagatgctgatgcagaaaagaaatttcaagaagttcagcatgcctacgaggtatagagtcctggttatgaatatttatttttcatttgattaacaataggacattcttattttaaaggtgctattcgttgtgcttatctcaggttttgaaggatgatgataagcgtgaaacatacgaccaggttataaactatttcctatgactatgataatatcataataacatgctttactctgcatgtgcttatctttttaagttgctctaggaacataaatctagcttcatggtaatttattttataaatcaatgaaggaa

SEQ ID NO: 26084 - DNA, 1572 bp, Oryza sativa
aagttgtgaacatgtaaagaactagtactttgatgttatagtggttaactagttatcaatgatagccttttatttggaggaccaaacatgatccaacgaactttcaaattcattatctatatttggcaaaaatttctgatctctttccagttctctaagtgtgtactccgtaattacttctgtacaacctctattttataaatgcctgatagttttcattttgccatgtcaaccagatgtttgataatccttttgccatgagaggaggtcgagatgtcaaggttctattgttgttcattaaatgatttgtttaatgacaaagaattgattattggaagcttacttttttctctttttttccccaaatataggttccaatcaaactatcattcatggaagccgtccaaggctgcagaaaaactattgcatatgaggctgatgttttctgcgatacttgcagtatgtgtgccacttgtttattctttccttctttgatgcaggcatgtcggttatctttgtccaccccatttgtttgtttttatggcttaagcttgtcatttgtttgatgcagatggaagtggtgttcctcctggcactgtacctcaaacatgtaaagcctgtcgaggtgctggtgtggtatgtatcctttgacaatcttttccccgagtatgccacatattgatatttatatatttactttaacaaccttcaaaatgttgtcattgagtgcagatattcatgcagcggggtataatgagtatagaaactacttgttctaggtgtggtggaagtgggaaaattgtgaaggtgcatttctgctttaattacatatttttatttatttgtttcttgaagattctatagttcttcatgataaataaagtcccatctgtcatggctgtctttgttcaacaatttcactcagtggcggacccagcacaaaattatagctatggcgaactttctaaatgtacttagtaccgaaacattttttttataaaaaaacacaaacataccaaaacattagtatataatgtatatgataaaaataattagtgtgcatatccaataaaactataagtaaataatttactgttttcaatataggtgaagatttattcatgaaggtgagagcccctagagccatccaaatgttcccattccaaattattctccaaatatttgtggttagcgttaaacaaatagtaattatacttttgctcaattccttaaagaacaattccaaccgatgcagatgcatcatcacttggtcaacatgacaacttgctccaccataccagtattagcttgtactagtactaatactaaaagattagtgcttattgcccccatcatcacggtaaccaccaatgaaacagtcagtagtgttgttgtttagttgatagttactgctggcagataggtatggcagctgccacaccttgccacaagggaaggtccgccactgatttcactgaaaaatggtaaacatcacttctatgagtgtattttgttcgttacaaaaagatctacttcctccgtttcacaatgtaagtcattctagcatttccc

SEQ ID NO: 26085 - DNA, 1235 bp, Oryza sativa
aatgtctaaaaaagaagacaataaaaaatttctaactaaatactccctctgtttcacaatgtaagtcatttagcattttccacattcatatagctgttaatgaatctaacaactatatgaatatgagaaatactagaatgacttacactgtgaaacggaggaagtagtaatgaggagctttcttagaaaaagatcaggttgtttagaataaagcaacactctggttcctagaacactagaagaaacaatggacatttttgttgggtaagaacctgtaaaagatggaaggggagatttggaaagacccaaatatataaaaaagaaacagccaattctaaaataaaaaaaatctaattgatgtttttaatgggggtacttatcctacggtttaatagctggttaagcaacacgtggaacggcatatgaaattgatatatgcattatacttttcagtgatcgtgaaacgccctacttattataatttcctgaaaataaaaatcacatgctctcttggcggtaatttgaagtttggaatatccagcaagagctagtgatatttgacattatagagtctgtcaactccttgcaaaacacgacgccacatgaattaaacactctatttctttgagaagagccagtctattgtacgccctgaatttgatgagtcttaaaaaacacccttgaacttttaaactggataatatttaacactaaattattaaacatccacttctcaactttgatcatatttagagtagttttaagcaatgtggaaacacataacaaggttgtcaccatttttattcttaaattagcaaatggctttcaattattcagggaaaaaaaatacttacacgtatttagagtttgagtattactatagaaatatttgattattaattctattttgtaattgtactactccctccttcccaaaataaaacatagcaacatctagcgtttaaaatttatcttggaacctaccgcttcatctcaacaatcacaatcatgtatattcaaataatttttctacctattttctcatcttaaccgatcacaaccacccctcatttaatttcacgtattttcgtaatcaccttgtacaggtgacgatgccacttttatgctttatagttaaatttatcaaatcccaagtatatggatatattcagaaagctaaatgatactccatcatgtagccttgtcatctactaactagctgggacatcatcact

SEQ ID NO: 26086 - DNA, 4907 bp, Oryza sativa
agcccctcaacggagactagaatcccctcaaggatttgaactccgggaaatacatcggcgcataaacctcggtgatatcctcactctctttaccttcttgttccattgctctgtactatgctaatattgttgttggtcgagctcacctctttgcttgtggattgaatctagatctcttaggttgttctcttgtttgtattgttgttgtgcaggtcagatagtctgatctcagttcagactatctgatcacataggactatccgacctgatatcatacaatccgaccatgttttgttttagcttccgcatttatttttaaaaccgcctattcaccccccctctaggcgacatcaaggtcctttcactagacaattctaagatcctcgctatatctcttatccaagaaccacattgtggctatctatttctcgccccatttcaccactgtgcttaagctcgacatcaacaaccccaaaccgaagctacctgttgatgcaaaaaacacacactggcctgggagatctgtttagctccactgcaggaccaaaggttgatgagatgcgggcgtgccagtcagtttgaccctgcaactgacaagatatacaaatagcaaatcaatgagccgatcggctgacaagccgatagattacttccaaccgatgttgataccagccgatagcgatagggttttgagctatcggctataattctgatgtagattctgatgcttgatgtaaataacaatataaaggcaaccggctgatgataatgcaagaaagcaacaatataattcaatagaaaccaatcggctaacaatgatatgatagaacaagtattgatccgaaggttaaaacatacatcggctggaggtccgatatcataaaatccacagattaaattaaacggtgaaatatttgttatcattggctaaatccaacttatatgcaatccttgtaagtcgatgcaacatccaaatacctcatcggctgaaaccccgatgaaacccttattggcagtcaaaaagcaggctagggattatggttctaaacacggcttagtagatcaaacttaactgatgcagcactaagtatgaaaagaaacacaatatcgagacaattaagccgttgactgatgtttagggtggtagatgccttagctaatctaatctagtaaaacaatttagccgataccggcagaaaccctaaagcgagaagacaacagattgagctaaattgagatactaagactagattaattaagacatgttaaatagccaggcaaatatatcaaccaaaccagagcaatccaagaggtcgaatgtactgatgcagccttgaacgacaccgacatagacgatacaattgcctgggccggcggaacattggacttaccccttcgccggagatcgaaaaccaatgcagccccgcgtcaggtgccaagtctcgccagacgataaaataaagtagaaaaggtaaaaggcagcgatgcgtcgaattgtattgatcatggagagatgttacaatgaccccgggtgtacatatttatacccatgggtagatactagtccttgtaggacaagaaagaaactttcctaaaagataaaaggaaaacataaagtccttatgggacactaacaaatattgcctaattaatagataaactaccatgtcgcattctcctggaactcggtcacttctagataatcttcctttaatatattaattttttaaccgaatatagcaggaatccgactattggcgacgtgataattctctttgaggcttaccaaattttactgttaacactaccgtactcgatatcccacttcagtgtacaacccttaatatacccccgcctaccactgactccatcatggtgaaagcttcgatctttaactctagcgagaaaacacgtgtactgacttaggtatgaaaccaaatcaaatcaatcctaacggaataagctaatttcacctcccaaatcagctcaaaacaaagcaaattggacgacattgcaacggattacaattgctcaccttgcttccactagatccatcggccccatgacctccatcggtggaatcagatgccctacccctccatcaccaccgagtgcctccttcctgtccctgcacttgcagtacgccttcgtcgtcacaccccttgctgctaccgacgtcgtcgtcgttgtcaccaccgcttcttttagggtttgagggctcgagggagaggtgatcgggttgcagctgcacaagccgattcggttggtatactaattcaaccaggggcaacttaatccaaacaaccaagccatagtcaaatacggtcagattaataatggcatggatctaattaacccaagaatctattggtggtttgagaggtggtcttttggggacaaaacccatccaagccatagcgaaagtggaaaacataataaaactagcagggtgggtgcgtgcctagatttagagtttactaaaaaaaactcagctagtcgatctgttaatgcgctcgcgattttatggccagtgcatgcatatggtgtttaatgagtttttaagttcggggtcaatggtacggtttttttttttagaattacacagtacaacgcagacactcacaatgcatgcacactcacccctatgaacacacgcacgtaaaccctacccctataaggactggtgtctgattgtttagttttaagaggaaaatgcccgccaaaaaaaaaaagtttcaagaggaaaatccaaatacataccaacaagtcaatgttcttttcaatttctcccaaagaacttaatttcgtgcatgtgctcctcacaagttaatttctcttttaatctcctacctctatcagttttcaacaatttttcacaccctatgagccccactcaaggtttactaagctgtttggggtggggttaccaccaccccatggtttgacggttaccgagataaccatgcggttaccacgaggtataccgtggtttcaaaaactaaaaatgttaccatacatgataaccattataaccgcacggtttttataaatcatggccccactattgcaataagcaaagtggggtgtatacctcggcttccttccaccttccacttttacacactttaattccactagcgctatggtgttgaaatatgacatcaatcacatattatagaaaaagtgtattaaatttcatgcccagcaagagaagatactatcgagatccacataatgcaagaaatcactaaaaatcaaaatctaggcaaagatgggagtggggaatgttttaatggcacggaattaagttgtattggtagattagaaagattcatgacttataagaggttgtttgaattttttatcttagttttttttattagtgagtaggcgaagataataatagagttggaaaggaaatgataaatattgatagttagacataaatttagtatttgtcagtgcagtaagtaaaaggaaaatatgtggggcaaaccacctataatgcaaagttgataactaccccaggttaaaaaaaataaacgttaaggatttatccacgtccccccgagtaaattttttacttcaagtaaacttttaccccgagagtaaaaattttactcggggtggcgtgaacatatcttttatgttcatttttcaatcctaaggtaatttctagatttgtactgtaaatgtggtttgcacggtatgggatattcttccgtaaatgaagaactccaatagctgcttgacacttgtactcagcggcctcgatctgtagaagagtaagcttccttggatcgattcagaagttttcgatggtttgatcgatgtgaagttgcatgtgacggcaatgtcgttacgaacaaagcttaaggccctgtttagttcaaagacaaaaactttttatcctgccacgttaaatatttgtacacatacgtagagtattaaatatagataaaaagaactaattacacagattgcgtgtaaattgtgagatgaatcttttaagcctaactgcgccattatttgataatgtggtgctacagtaaaaatttatgaataacggattaattagggttaataaattcgtctcgcagtttatatgtagaatctgtagtttattttgttattagactacgtttaatacttcaaatatgtgtcaatatatccgatgtgatacgcaaaaactttttaccttgaactaagggcccctttgatttggaggaaaaatataggaattttagaggatttcaatcctataagaaaatttcctatgaagccctttgaaacaaaggattgaatcatatccagtcctttgaaattcctatggaatggacaatcctatagagattttggaggaaatttagcaagagcttcaacctcttgctaactttcctttgagtatatctctctcatccaatttttgtgtttttcctatggttcaatcaaacggtcattcctgtgtttttcctgtgttttgcaatcctctgttttacacttacatttctatcaaaatcctatgtttttcctattattatgttttcttaatcctacgattcaaaggggccctaaatagggcctaatatgggccgcacgtgagcaggaaccttttaactccacgtgacgcgcaaatgctgtttcataacgaactgctatgataaagttacagtagcatattgtttatggcatgccacacagtcctgggctcgtttgttacacagtcctgggctcgtttgttacacatgaattttataagaattctgtatgtactaattaaacttctgtaaaaatcaataaaaaaatatttctttcgatgaagtcctacaactatagccttgtttagttgcaaactttttcttcaaacttataactttttcatcacatcaaaactttcctacacacat

SEQ ID NO: 26087 - DNA, 371 bp, Oryza sativa
caaccagctaccgtaggacacagctcttgtgagcaaactgaagatgctgataccggcaggaggtagcctgaaattttggagctgtggttgttgatcttttggagctagcacaattatgtgtagcctcatttcacacttacttctgggtctcagccatattctcttgggaatttacattgttcaaaggaaaaaaaaaaggcattctacatattatggggctattatgaacaccaagaatattactccctccagccaaaaaaacaagtcgtttgtaatttgtacatgttcgagttaaactttttaaaccttaaatatcttttttttaaaaaaaatatatttagaatgaatgtattatgtattagaaaaaaaat

SEQ ID NO: 26088 - DNA, 524 bp, Oryza sativa
gaaaagataaagctataatagtttctagaaaagcaacttgaaagcatcacttcctgtgtggctgtgctacacaaaatcctttctataatttacgcatattaactaaatgattcctccatgttagttattttgtaggtaaactttagaaactgtgcacttaattgatccacacttccattcattaatctgcaaagttacttctgagtactgaattgcgtttgtaaaaattgttgtaagagatcaaattgatttaggtaattttatttgtctttgttgcatattactaatcttgtcattgatatacattttttaggttgggaacaagctgaatctgaagttgctgccctaaagaagctacttgaagcttcagcccagaagaatggttccctcgaggttcaagtcagccacttactgaaaaaaatgcttctctcgaggttcaagtcagccgcttagatgaggctctgaaggaatgtgtcaggcagctgcacctagcacaggaagatcaagcggagaaagtccatgat

SEQ ID NO: 26089 - DNA, 3890 bp, Oryza sativa
  unsure (1)..(3890): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaatgcattctcaatttgtaggttgaaggaggaaatgacactgtaaatgatgtggcaaatacagtaatgcagaggttttgggattctactcttgctttggagtctcctgatgaggaatgcgatagccgtaggtctgttgatggttttcatttgttgaatgtttcgctcacttgctctcccctaatacaattctcttctacatttcccagtgaagtatcattgctcttggcatcagaaactggagatggaaagagtagcatttacccccctgttattggaaattcgtttgcctttaagcttcaagaccaaaagggacgcgtgcatagattcacttgtggtaattgctctcctgatagtttgcacaagtatgttgattgttctcatatcattcaaacataactgttcttaacttcttttctcttgctgcaggctcagagagcttaaacgagctagcgtcttctataaaacaaagattaagtattactgacgaagagggcataatgcaactcctggtacaactgagtatttgtcataagaatatttctagtgctttcataatcatgtgtaacaaagagacgaaatattcgctgccttaatgtactctacttcgagagcgaagctattgctatgagcttatatgcatgtatttatgtcctctaaacctgtaattattgtctttgcactgcaccactaaggcacttactagaggacagccaatatttcaagcacttccccacttaatcttgtttgttctatgtagtacgaagacgatgaaggtgaccgggtgctactgacaactgatgccgatcttgctggtgccgtgctccatgccaaatcgtccggtttgaaggtatctgttgttcttggactcttggtactatagtttactctatgtagcaactcgtagagctctccaacttttcttgcttccatctatctcactactatgaatatctcattgtcaggttctgaagttgcatatcgacctgtctgaatccagcacagaggtgacaaagccatcacagcagctggcagctgcacgcaggagtcggttgtcgcctgttcgtgttgggctgatggctggtgtggtcgctctcagcggtgcagcagtgatggtttacctgaaacgagctaaagtgtgatttccccatgaattactggtaattttttcaaacctgtattttttccagttcctggagctaattatgcatcatgccaaagaaatgacacattggagagcaaccaaagttgcatcagatgcactgaaactctctgacgccgggctgaagaatctgcctatgttggtttttgtttcctcaatttgcacgcatatcagcaaatttcactagtactgtgaaatgtataaacattaggatgttcctagttcatatttatgtacttgtttacagataaacagatatgtaaactcattttgaaggacagaagtaaatagatccttctctcctatctggctttaagttcaagctagagagttattgtgatgaacatggccgtactgacgaggagatgcattccatttttccattgtccagtgtcactgtactgacaagtgcaactgtatgtgtctctttattctaacaaggcaagatgatctgtaatccgattcttgtactattgttcaagtaaactcaacctttaagctacactagtagctatgagaaagttaaaacaatagtattaacttctgaagtgtcaaacatgacttaactttccagtgatcattacagtgtccccagtaagattagagtggcccctaaccaactgtgtgattgattgataattaagacatgattgggtgagtgagaaaaataataaaaaagaagatatgcatggtgtgtggctcaagctaagttatggttgcatcttgcatgttggttgtgttggattttttggtgagctttttcattcagttggctagttagtttcttaacctcctcgatcggcaacagcagctttggcttagagtgtagtctcgtgcttcttttgccttttctgcctttcttgtatcttgaaaggcaatgcttggattagcagcatgattgcattttaatttgttcttcattttccacattacattttattaattaatacgcatgcatatgctctaatccatataataaataacaggggtactagctactactattcattaagggatgataataatatcagggaatatattgattatagcatatatataccagcagcatagcatgttggtagttagcacgtcaaattaacaaaataatgcagctgctaaccacacaatgattaggttgtaatgccatctcacactttgggtatgtgctctgtacgactgtacatggaacacatagattagcagatagcggcaaggattagggcacaaaatcttgtgtttgagtaggttgttgacacgtgcttatggcttggacacactctcaaatcaagaacaggagcatgattgagtgagcttaaagtgagaacaacgtgctacctagcttagataagggtgtgtttggttcgtggtcaaggctagataggatatgaccatctatatttggagggatatggtggtccagttttttgtttggttagatggatatggccatccagtttcttgtttggttgggtgaatgggaatggattgaatgaaaacaacatattaattaataataaaataggttaattatcattaatatagctatagtttatactaattaacaataaaatagagtatatatctaatcaacactaattttgacaagttaattactaattaacaacaatatactttaattattgctaatcaagaactaattatcaagattagctaaggtggatatcctcatccggtcaatttggccggatacactcatccagcatcttcgtggaatattccctctttgggccgccctatcctccctcgcccaccaaccaaacacactcaaaaactggatcgccatctcccatccagagatatccctccaaccaaacacaccctaagctagtgtggtgtgtaccacttcctctcgtccatgaggccatcattgccgggagatcacatagcatgggtactggccttgttgggaagttagatttcagaataatgttattggaccactgctgcatatctgttatcgtgcaactctagtatacatttatggtagtttcgtctaatatatcgatgaatagatcttatatgtgttttaaaaaagtatttatggaagagaaagaaaattaaagaacaaaatagaattatgttttcctatcacattcgactcctattgatttgtgatcggttagtctaacatagttactccttccgtcctaaaatataagatattttctagtactacgaatctggacagatactaggaaatatcccttttgattctagcttattatattttgggatggagtgagtactaatgaaagccggtgtaattttataccaacgaaacaatggtttggcttgtttggtttatggtcaaaagtagataggatatgatcatacatgtttatttcacactgatcattgcacggttggaggcaagaggaaaggaaagcgtgtgggaaaccttaggtttacttaaggatatggagagattgtgtgagagaaaaaaaaag

SEQ ID NO: 26090 - DNA, 1193 bp, Oryza sativa
aaaaggaaaaaaaaatccatgcatgcatacttgtgagttgtgatgattaatacgggagctaattagatccatttctaatgtaccaaatcctgaatcaaatgtacaagtacgaacacctacaaaaaatacagtcacattattaccgtggaaatactcagtagtataaggtactccgtacaaaatactactctacatcaatagtacacgtacagagtatagaagcaaagagtacatccccacatttacacatcgccaccacttcgcttgcagccacacgtacgtacgtacacacaacacacacgtcatcacatcccgtgccgctacccgtgggccccaccacccctgagtcactgacagcgccggggcccaccgcgacgctccacgtcgtcgtcgcgcgcgggcgacacgagggccccccacaccgcgtctctgagtcactgacaggtgtgggccccacgggcgaaacccagagtgaccgacaaactcgaaccgtcgtcgggtgcaccaccggaatctcgccgccaattaatcactgtacttagagcatgcccaacagcttcctttttcaattccctatcctgtgatttagggaattttgatcaagaaacagatccaacagattctctaactaatatcccaatatctctggttcctcagtccgcatatatcgttcctcacaaacagggaagcgattttgttcccaatatttcctcgtcggtctctctcgcgcgcaaagcagtctctcgcgcgcgcaaagggaaaatgttcccgcgcacttctccgcgccctcgctcctcagcggcgaagccttctccgcgccctcgctcctcggcggctacaccttcttcctcggtgggggcaccctcttcctcggcggcggcgtcctcttcatcggcggcagctcccttttcccttttgcaaggcacggggcgtggtgtcccgatgacggccggaggtatgccgtttccgcggtacggcgagttctggcccggcggccatccgtgccctccaccaccgcctggcggccatccgcgccccacaccgccgcccggcggccatgcgcggcccccaccgccgcccggcggccatgcgcgccctccacaacgctactccggttttcaggcatccgaggccatggagaagctgacatctagcgagccattggatcccctttcacacgaagcttctatcgg

SEQ ID NO: 26091 - DNA, 4140 bp, Oryza sativa
  unsure (1)..(4140): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccccctaacagttccatcatggttccttctatcaaagtactccgtatcaactattgtgttgttctgaaatttgagcaaagagctagctatagataagcacctaatccaatgcaaatcctattaataaagtcaaatagatcacaataaactaatcacttatcaaaaagaaattctcattaacacttcctatgcttctgttgatcagtaaattgctgcgcttgctaatgctccttgttacccaaaaaaaatgccgacttcgccagcatagcagagcaagcattccactgcttcaggctgaggaacacgagcggctgcctgtgctggccggatcctagatccgcccctgcgtctgccacaatacatctggttgcgttgacatgtgacatatacatacggttatacctaggggtgaaaacggtcacagaaattcccgatcaaccaggcgccgtttccgtttaaggggtaccgtttctgaccgtaccggttttggctatttttaaattttgttttttctaatttctttccgcatcgtattaatgtcgatactgagtagtttaagggtccctttgaatcgcggaattgggaaaacataggaataggaaaaacgtaggattttgataggaatgtaagtgtaaaacaaaggttgcaaaacgtaggaaaaacacagaaatgccgtttgattgaaccacaggaaaaacacaggaattggatgagagatatagactcaaaggaaagttagcaagaggttgaagctcttgttaaatttcctccaaaatctctatatgattgtccattccataggaatttcaaaggattagataggattcaatcctttgtttcaaagggcttcataggaaattttcctatagaattgaaatcctctaaaattcctatgttttttctccaaatcaaaggggccctaaatgataagggaccctttgaatcgcaggattgaaaaaacataggaataggaaaaatgtaggaattgaatgccatacttattggattcctatgggattttgaagcacaggaaagtcttcaaactgtcgtttgattagcacacaggaaaaacgcaggaatcttagacacatgaagaggaaaacatgaggtgagacctcatgcttattttcctccaaaattgctctagtaagattcattccataggaatttcaaagtaattgataggaaacaatcctttgtttcaaaggactctataagattatttcccataggataaaatactctagaattcctatggtttttcctttgattcaaagggagcctaaatatagtcaattaccgaccaatcgagcatcgtttccgaagatatgataccgtttccgatcattttcacccctagtgataccactgtgtacagtaccgctgtgcacggcttcgtggcttcagctatggctgcggcaaatcgaatcgagcatgtggatggattggactgcagtgtacgtactactgtacaggtgtacaggagcagtactggactagttgctccgatgcctactacagtactactactacaagtagcaacaggagtaattaccgcctaaacttctcggacgacggactctcggcacacggcagggtccacgcccgtcctgctgtccaaggagaataaaaaagctgtgcaagttcgatcgtttcagtggggctcgcactgggatcgctcatcgctcttccacaatgtaggagaacgacccgtcctgggcccgtgcggccgtgtcgccgctggctcctcccgtcgagtggcgcgcgagattgcagcgcggtgctggagcaccgaccacccagtcggtcaaaattagctcttgggatgtagctaacagtttgtgcgcgcgcgaccctgcgacgaagatacggagagaaaaaagagaggacaaggcccatttgaatcaaaagaattatgaagtaatttcataggattgaaatcttataaaaatttttcctatgtagccctttgatttaaaggattgaagttttccaaatcttacaaaattcctatggaatgacttgttgcatataggttttggaggaaacttagcaagaggtccaacctcttggtaaaaatcctttgagtttatctctctcatccgattcctgtgtttttcctatgttccaatcaaacgattattcatgtgttttcctatattttacaatcctctgttttatacttacatttctgctagaatcctatattttttctattcctccgttttttcaatcctacgattcaaaggggccctaaaactggcgtatccggcagaaattttactcaagcagcacacttagcctcaaaaatatatttaattctttttggaaagggtgatatatatgcagcatggttttccacaattgtggcgagtgatgacaaaatatagttctacgatgaatggtcaactctcagggaagtagaattgcacacatttttttttacaatatgcaggaaacgttttttttcgttgtagtcggtttcatttgaaatagtgcgtaatattatattcttggcgttgtaattagtatcttttttttaaaaaaaatgcaactagtgggcatacttcataccgtgcaatgaaacatttttgagtaagtaaaggaacactgctcaatatttttctagggctcgaaagttcgacccctagttgcatcgttttggagataagggatgaaagatctggagatttatttattggtagatgatacctgcgcggacatatatctatttaagtaaaatcaatgctagtgaagcttgtctaatacaaagttgtttttttaaagagattttttaatagaaaatttatattggttgaaaccaccttgagatacaattcatttaggtgcatgttgttatctatatagggttactctatgttgggctctgtgtatctaaggtttaaagaacaattaggtttgtaaaattatactgtattcatattgatggtagtaaaaggtatacttttttttttcagcataaagatattttcttacacatctaattttagaacgaaaagcaattaactgacgaatcttatcgattttgacacatattgcgaacaatattatcaaagacgatccatgaaaatgtagtgtctaacagagatctatcacaggaaaacaaaaaggcttcgtacaaaaatccacactcctcaggcaacacatcaaatggtattagcttgagacggatgagtacaatccttgtaccaacagacatcattacaaatccaaacttaaacatcaacagtatcacagaagatgggtcgttcgagagacgaaggttacggctacactgctgcgttgtgtttgtggcgctattcgttccaagcagccgagcagcccagataacacgaacattgaaaagttaggtggcggtgaaggagggacggctcgccgctcgccggcgttgccgttgaaactcggacaccaaatgccaacattgaaccaccagatctgtcatctgtgcaagtgtaagagagccagaggagagagcagttggcggttaaaaccaaggcaggacgaggctgaccacccccccagccccacccgcagtttgttggcccccacgctttccccacccacgagggcaaagagaggcaagccaaaggcggtgcgaatgcgatgcgtgccctggtcagctgccacggcgacgggcatcaccacctggcccccatccatccatcccgtccaattcatcgccaccgcatcacgcgcacggcgcggcacacacacacacagcacacacacacaaccgcagcgcagcgccgcgccggtataaatcccgcggacccaaccccggatagggacgg

SEQ ID NO: 26092 - DNA, 1060 bp, Oryza sativa
agggggagggacgctggcggcggcgatggcgagggcggcgccggggcggcggcgatcccggcgggggcggtggcgcgcgcggaggaggcggcgggcgaggtggtgcggcgggtgcggcccacggaggcatccgagcggcgccgcgcggcggtcgtcgggtacgcgcggaggctcgtcggcaccgcgctcggctgcgaggtgagtgcccgggcggttcgcggcggggcgcgcccttctgcccccgtttccactccaatttcgggtttttgaggtttctcgggattctcatcctcgtttgattggggcgttttattcttcatttttttttgtttagtgtttactctgcttccgtcgctgtctgtgggatttgacgggaattctctccacgggaggattatcctttttaattaatcggcttaggttcgtacggatcaagactgattcctaaactatttgctcgcggcgcgtcgttgcaattctgccttgttttattttcgctgaccttcacgggggaacaaaatcgggatcatttttttatttcacattttttaattactaataataaactactattaactagccctcgtgaatccaaactgctgaattccgaactttagctgaggccaccgtgcgctcggatctatggccttttcgctttttggtttaataaagggttttctttttctgatggaacgtttcttgacgcgttcaagtatttattttctgttggcacaataatgttttatgttcgcttgcaagcatcacttccagttccaacgaaaaggcacgaattgctttataaaatccaactttctacatcctaaaagttcctttcaggcggaaacaactttcttctgctggtccagaagagagacaaaaagaaaaagaaaaaaaaactcctttttcttgttttggttctgtttctgctcgtgatgatcttgactgcctgccaggagaagcagtacccttcacggttcactctgtccatggtgactcatgcatccacgtggatttatccaatagtgtggcaactgatcaatgctgtagctgaatcttctgg

SEQ ID NO: 26093 - DNA, 6755 bp, Oryza sativa
catgtagttatgggtaaacaattagaaagaaccatgtcaaatctgagacggtattctttaaatcagccatctcattgagtttaggccagatatctagaggaacaatataagttgtttatctgcactatattaaagtagcatttgacaaaaggaacactattttgcatttaaagattcgtctagattagggacacagcactctggataacagggttacatgaactctctctagccaaggatataatctggtctcaactttataatgattcttggatttccctttttttattgttagtcttcctttgttttattaaggggggagagggcgtacagaaagtaccaggacaaagataaagtaaatggcagagagtatcactgcgacactgtaaacacattaactccgaagaaatttaaagattaccctttcttagtgttcaagcccgttccaactgcagttccaccttgagcaagctgctcagcaaaaaatatgatcagaaatcattcaacttttgcatatcattctaaaaacaaatattgaacattagtgtagtacctgatacatccgtggtaaggtacaaacaattctatcaattccatatttcacctatacatggagttcaaaatagcttataacttataagtatttctgtcaatcataaacgcatagcaattaataaaataataacaaattactggaaaatttcctacttgtgtggcgtaaccgctgaactcttggccaagggtcaatggggtggcatcttgggtatgtgtacgcccaattttaattatgtcttgaaattcaacagactgttacaccaagttgaaacttttgttagaacagcatagatgctatatgaaggaacacactgcatatcatctatcttctggtgttgccaaccagaagtgctaaaataagggaaaacaataatcagctgaatggccagcatacattttctgtggatttattttattgccttcactgataagtaagtgaaccgtttaatcttaccaattaatttgcacgaaagcattcatatgttgcaatttcttgctcattatgaagacaaattaaagtaggttgtgtctaagtgctgagatcttgaggtaacaagtaaaacaaaagtctgccccagccatacacggatacgtcgtaaacaatatgaggttcaattgagagacttcatggagaatggacaaaatattaataatagaaggccttgaaatggatagaaaaacaaaatataaatcaataagaaataggatgatgtgatatccatgcattattgggctgcagttgtctgtctagcagccaaagacatgtgcccaagtaatgtgatccaatgtagcacaaggaaaaaaatagatataatatcaacttgtgatgcacttgatttgagtatcttagaaatagattcaaatgcacagttaatagcagaggtaacttaagaagattgctgcaaattggaattaagccaataggtgaaacacgcacccataaatataaaaggcacaagacaagaatggattttaatgttgggaaacaagagacaaaaaaaaatacctttgaatcaagtgacttatgcaactgttgcaagcttgggacaaaccttgaattgatctctgtggctgctgctatgtgcatgacctgaaaatgtcagcaacataaatcataacatcagcaaaggtaaatgcacattaaaatgacggccaaaaaaatagtgaaatcttacagtgggaaatgtatcatttgaggactgtgatctgttcacatgatcattagggtgtacaaacttctcgccacgcttatgtccaagaatctcagcggccctatttgcaataacctaaattgcaaaagcagatcagaaatggtaagatattacagtataataacacaaacttagctcacagtaatgttaacatgagaattaaacatgataaaataattcaataaagaacagagagatttagtttgcccttctattcagacatcaaagctttaacgcacattggcaggtaccacatttaattattagtaacaaacagtatagacaattcatacaatagtagtgcataatgggaaaaaaaaacctcattggcgttcatgttgctttgtgtgccactcccagtttgccagataacaagtggaaagtggtcatctaactgtccttcagcaacctcctgagcagcctgcattattgccttcccgattgttggatcaaggccatactccatattcacctttaaaaaccgaatgaacaagtgagatatacataacacaagtataaatcacctaagcaatatcatcaacagcacaatctgaaatttagttaaactaaaattcaaagcatggcaatgtgacattcgattagctgtcaactgatgtaaaatattagcagaaaactgaaacaattttgcaacaacgagatgtaacagggaaccaacgtggttttttaccccaaaaaacgtgagctccattgtttattaaatatgtgcacatcacgcatttgtttacatatgttaacatcacgcatttgtttacagaaactatccacagcacataaaaatcgctttccagccttgtgctccacaggacaacaaaataaggccatcaaattcatctactcgcccccacacacgcaggcactaaaatggtatagtctcgcttaataccttagcggcgcactttttgagcaccccaaaggcgcggatgatgggcaccggcatccgctcgcgctcgccgccgatgtcgaagttctgcagcgacctctgcgtctgcgcgccccacagcctacaggatacatacatacaaccacgaaaagcaccccccatcaacagatcaatcaaaaccaaccacggcatccgtcacgaacagatcgaaacacctcctagcaatccatgcgggaggagagagaaaccgaaaccacacgcacttgtcgttggggactcggatggggccgaaggtgtcgcgctcctcgcggaagccggtggagatcgggcgagccagcgccgggcggagcagcagcgcggccgcggccgctgccgccgccggcgacggggcgccaccggcggacgcgcccgcgaggcgccgcaggaccatcgccatctcgtgcgccgcctctctctctctccctcctactaggaggtgtcgtacggcggcgagggaagcggcggctggcgaatgtggggagagaagtcagagagagaaaggcaggcaggttggtggacgacggaggggggaggaagagaacgcgttgcgactttagtactgctacttacggcccattcttactgcacacccaactcatgtaggccggcacgagcgtgcggcccattttgattgtgccggatagctcagtatatcggtttgctttttaggaaataagtttattaaaggtccctcattttgacgccaggttctaatttttcgttctcgaaccatataacgcgtcccttaactttaaaaccagtgtacttgaggtccaagtaatatagtactcggttttacttgacgtgtcgagtggaaacttatatggccccacatatcaggcccatttcttcttcctccaacatcccctctctctctctctctctcctctattccccatcaacggtggggaagggacagaggtagccggtgggggacgggtgaagggaattagagtggtacaggtggccgcacggtagccagcatgagatcgccgctgacaataaattgatggacactttatatatagtattggaatttgatgatgaaatttaaactcctcgtcaagatgagaggcctaatgtgaacttatttcttgtttttataggttgatggagagaggctgcggggtctagctcacagcccacggcttgtttgtctgagtggccatacagatgttcaattatgtctaatttttgtctgtgtctgaggactctgagctctagacttctctccacagttatgtttaattttcttaaatcaccacgtaatttttagaaaaccatttaacacattaatttaaccctagcttaaccgtagtcttgatttctggccccactcctcctgaccgcctgaacagaacacttccctcaaaggtgagcgagcatcgtactgaaatacgtactccctctatattaaaaaaaaactcgtactgaaatacgtgctccctctgtctaaaaaaagataacacgtgacccctcctaatacaatgaatctggacggagggttatccagattcgttgtaaccccttataggttactttttttttttggaagatgaagtatgacccctcctatattgtcttttttttttatgatggagggagtatgcgtgtgtataaatcggagtacaagctttcaaccaactttgatgaaagtgatgtgctcattgttctgcggccacaccgaaggtgtctttttttattaattaaaaaaatattttcagtctaggatgatgttcatacaatcatacaagttcgtttctacattgaccacaagtcgatttcacggcgatgcaacatggtcggtatcaattgaatgcgttgttttcattacctaaataaaaaaatcgactggatacttttttttctgactgttgaaaatagtacactctctgcccggccaattttccactcacgaggcaagaaaaacaggggcatccagttcattaaattaaaattaagtttctattaacaataagtgaatatgcccctatcacgaggtacccaacaaggcaacaacagaccgtaatggcaccggtaaagcgacttgtgaataagtgaaggtagccggagagcttttttttttttttgcagtggtttctcttttaatgacgtgaggagatgttaggttgggagaacaaaaactgaactgatttttccctggaataaaaaaaatatttttgaacttatcccttctttcagttgttggtacgaatatcacaattgaattctgtttctcagaattttgcattgccataatttgttaattagtaaactgtgcaatactcttctttctaataagaaaaaaaaaggaaagaatctcttttattgaaaatagaacggatttgacatactgcttgtgacagaaaacaaagagaaaaactttcgaattcttggccatccaatttgctttaagatttgtgcacggatgaagaattaaaaaatcaaacggcccacgcaggtgttattccacttttgggctgcgagtgtgttttgtagttatattgtgactacactttacttacagtaagtttacagagcatcaagattgtcaggatcgggatactaggtagtgtcattttgcttaaagtaatatcgtatcatagtatcgggataccatgagattttctttttttaagtttaattaatatttatattaattatatatagtcattctatataaaaaatgtagtaatgatatatgtcatgcaaataaagacatttatcaaaagaaacatgttggttttgatatatttaactgatttttatataaatttgagcatatttatttatattattttcaaaccatgctattttaaataatattttatagtatcgtagagatcgtagaatcgggataccacctaagatttcgtaggatcatgtagtaatgaatagtaggatcgatatactatgaaaattaggatactaggtgggatcggtatcgtttcggcttggtaggatcgtagtatcgtaagatactaggatacgaatcgggatactgacaaccttgcagagcataattacatgacatgccaataaaaatataatattactattgtattatatttatatctgaaagttttaaagaaaaacttacaacaactacatcaaatagaaagggggatgtcggaatcgaatgatgcacgaacaagagacttgagagttggaaacatttacctcatcttaaaccaattagcattttttcagcaatattttgcatcatggtcatttacctcctcagacattgtcttgcttgaaaattgtcactactacatatgtagtaatactacataaatcactactacgaaccgcttgagtgactgttgatacgtgctatcagaaatttttttaaccagatcacccaaattcagaccaaaacctacaaaaacaagattatgggattatgaagagaaccacattgacaagatttatattggttcagacccctcataaagagaactatagagattacagtagagaataacagaaccgatgagttaccgattagacctttcttgagaacaacccgacaagatcaatcagcgagttggtttcgagttctccggattatttctgctatgaccgatggcaatgctatgattcgataatcctatacccttagggagccttgtatttatacctcaaactgccttggcttccaagtagaactcgaagaatcttgcacacactagatcacaaggcccaaatcccctccgaataggactctaacaccttccgaatagtcagttttctttcccattggccaaattccttaagactaaggtagcattcccgcatatttgagggtataccatattcatatactctgtaacccaaagaataggaaatatgccttatccataaccttgataaattactaaatttatcatgaatttattataataaaaaatataaattccctttttattataaattgtgtgcatccatcttagattataggatcatattaaaaaaaatcactttgtccggattacatgtaaattccgtgttgttttggacaaaatttgactccttggatttatgcc
